United States Patent 6,812,339 (POLYMORPHISMS IN KNOWN GENES ASSOCIATED WITH HUMAN DISEASE, METHODS OF DETECTION AND USES THEREOF) - sequence listing, part 31

SEQ ID NO: 13292 - DNA, 66065 bp, Human
  misc_feature (1)...(66065): n = A,T,C or G
caggagttcaagaccagcctgaccaacatggtgaaaccctgcctctactaaaaatacaaaaattagccatggtggtgggtgcctgtagtcccagctacttggaaggctgaggcaggagaattgcttgaaccccagaggcagaggttgcagtgagccgagatcgtgccactgcactctagcctgggcgacagagtgagactctgtctcaaaaggaaaaaaaaaaaagactaaagttgatgtttcccagatttggggttttctcataattataacttctctgaggaggcacccattcaactatgactcaattaaaacctgtcatcaagtggtatatttcaactggaatcatcttccccctcagatatctgctttgtctgaactattctttattctgagtctaagcaggcaacagttgggagggcctttaaaatgaggttctaagtagaaataaaacctggtgacttaaagccagcgtataagtatcagaattttaactaggtttctcttctgtttgaaacagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacaggtactacttatttggagagcttcatatgaaataagccagttcacatatctcttattagagaaattttttatactcttgatggctagaaagcagaaattctaaattaggcgtaaaactagtgtgatgagtatatataatcaatatatccatattgggttttatagttttatcatgtaatagctttgttgttcataaagggaggtaggaaagctgaggctgaaaatctgctttttagagggtaaaaccaaaaagatggctaaaaatttacaacattccatatgtgaatcttataagagatttgtgagtttgttaacattgttatttttatttttatttttgaaagtgctctattttcattagggcatacttggtggctcctgagttcaagttgacagtttctcacagaaattacaaatcattaaactatcaacttgatttttgagtgccattgtctctaatttgttcccctaagtatgttttacactgatatatggtaaattcatgaaactattatcctatgaattattagaaatcctacatttacagtggtgaaaatgtagcattaaaaacagagacatttcccctcacttcatctttttctcatctaatgtatttgcttattggaacatggtaatgccagtcacaaatctgttgtcataattatgaatttgagtaaaggactcactgaaaacctgaattcagtattgtggtttttttctacttttagtttaaattatgcttgtgagtggaattagcacagttctttttttttcatattgtgatttctctttcaaaacatctgctatgtctgcatatcactctttttaatttttacatcagtgacacagtattttccttacccagtcttcctctttggagttgaaatacttaaaagctgtaacaggagtcataaataagtgctttataaacagaggtgtgagaagtttatttttcaaccaaaaaattattataatgttaattgtgtatattaggcttagaaattgtttaaaagaacatatattggattttttccaaaaccaagaaaaatttttacattatattttacataaaattatattttacatataactgagaccattatcaaatgtaagagtcgataagcattatttcttattaagtggtgctaatattttacagtagttttttcttaatttaagaaacttttttcttaatttaagatggtacagaagctctttacttgatagcttgcaatattaatgagatcaatggtcttgttttagaatatgtatcataaaaatattttaatagaaacaaatgaagatgtttgaataataatgtctttttccccctagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccaggtgggtaactgcttgcttcacagaatggtcattcttagtaattttttttttcatttattctattccatctgtagaccagatatgaattcatactatgttttatcctatccattgggcatatattaagaggttagtatcaataactgatcacaggatgccctcagaagttttctttagaacttcagaaggctacagttttaatgcagaattataaaaaaggaaatttttctttctctataaaatcagtgttcacatctttagacattttttaaaataccttccctgcccctctctcccagccctacctattgaatctaactctctaggaataaaacctaggaaccaaacctaagtctgggaacccctgatgtaaatgaagtgggagagaaatgtaaggagatggacaaggttacttagtctggcttgttttttatttcctttgaagcatttcctaaggctgttttttccttctcatctgattctgaccaccctcagcaatcagagaatagggacttgaatattctgggtaacagaatattgcccttatgtaacatgacctgaaacagacgtaaataaagacaaacctttccataagttgttatggattagaaacctttatgtttaggatggggtgaaagtggtgtaaaagtaaacaggtatcttcatttattgtataattgcttatggactctgaaggaatatagtttaaaaaaaaatatggcccttcctaggagctttcaccttatttagagacagaatatagacattcattaatcagcagacaatgtatgtacaaagcagtttatccacgagactccattctaaagcatgagtcacacttagtatgcataggtccttcggtttcttgaatcagcttagttttctgctctcatttcacaagaatcactctcttccctcagaaatactgcattctaggcagatggaagtccttgtcattcctagaataagccatgtctcttctaaacatattctgccttgctcttctttctgtgcccactgaacttctactcatccttcacaaaccaattcaaataacatctgcataaagccttccccaagtatccctagttagacatttcctgcttctgtccttttgtggtgcttcatatcatctctgtttactctttgtagtaacactattttgactggttctgtgcatgtgtgttctttgaggataaggctgtctcgtgtttcttggtacaatgaaactaatttttaagcagaaaacagcattaaataataagtatatttaaaaggaaaagatttataagataatgccattgtgttcagttctggtgcatctgttttgtgcacatgtgtatgtatttctgttgagctgcttcttaggagtagaactacaggataataagatatgcatatgtcctttttcagtagataatgccagttttcctagtgtatcagtattttttctagttgctccaagtccttgttaatacatgatattatcaatattttagatttttagctattctgaggtgtgtgttctaatttgcatttccctgataaatattcattggtcatttggatatcttcttttgtaaattgcctagtctagtctcgtgaccattttttaatgtgtttttattttgcttattgacttttaagagttctttatgtatgagtcctttattggacatatatttgcagacatctttttagtgctaaggcttaccttttctttctcttactggcactttttgatgaggtgaagttcttcactttaatatagttcaatttgtcaatcttttcctttatggttaatgctttttgcacatgtgtaacaaaagacatgttcacaaatgtttttaacagctttattcgtatcagccaaaaactggaagcaacccaaaaatccatcacaatagaatggataattatgttgtgacatattcatacagtgggacactattcagcaataaaaatgaatgaactgctgctaaatgtaacagtgcccaaacttcagaaatataattaaatacatatatgtaattctacttatatactctagaaacaaaaatttcagttgaactagataatgaaacccaaaaagtaatcatagtatagcaatattgtgaaataaaggccagttttcttctctacataacctaagacagatgtaggaactccctatttattcttttttattttattttattttatttatttatttatttatttttgagatgggagtctcgctctgtagcccaggctggagtgcagtggcacgatctcggctcactgcaacctccgcctcccaggttcaagtgatcctcctgcctcagccccactagtagctggagttacaggcacgtgccacgatgcctggctaatttttgtatttttagtagagacggggttgccatgttggccaggctggtctcgaacttctgacctcaggtgatccacccgcctcagcctcccaaagtgctgggattacaggtgtgagccatggcacccggcctccctatctattctaaaagatatgtttcttattaagtccttaagtgggaagtaaccattgtgatatctttaaagctgataaataatttatgaaaaagttttccaaacttttttaaattataaaatagttgaatcaatataagtttaaagtaagtcattttatgaaattttgaaaaatatgacaggaaaaagtcacccataatgctatcatcataacacagtactactgacacttttttccagtccaatctttttttatacatagatttttgtaccaagatatagtagccaaatatatgtgtattatttatatcctgcagtatatgaatactatatcagaagcatccaaatattttccccatggaatagttagctcatgtaatttccaagtagccccaatcattctaattatttcttctttcttcattctctcaaagtcacactgaattcatagagtttaaagaagcagcatttttttctacgttgtttcaggtgaaagtgtaaaatatatttcctctaactttggtttccattcttagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagtatgttctggggacaacacctcattttaaacgtttagtgataatgtggattagcattttgtctctcaccagtattacacagatcctttgcttaagagtgaaatatctttttattaatgccactataaataataaaacagttatatttaggcatgtgaacatcattcatcatgtgtattttaaattatgacctctatccttttgtaattaatgttaaggtgagcaattgatgttaaggagaacaattttgtcgtctcacccaaaacaccccataacaggactttcagaaatacagtattgggtcagattgtttccagatatcttccttgaaaactaatcctgtgagttgcagaaataaaagattctgtactaaaatacactgggcaaatgctacatgttccatacatttcatattgatgttttaatgcctattagcagttttgagaagccttgtattaaagaatgtagtttagatttcttttacccaacatttcccaaactttcctgattatggaatttcttttctcaagtaatacatgttataccacagaatgagttttccatgaagttgcttaggagacaactgtgttaaaatatgttattgttctaacccaagttagcattttcctagttgagagacactttgatagtttaatacattaaatttatgaagataaggctgtcagatttttttgcccatcacattttgatgttgaaaaaaccagtggtaagaattccattgtatgaccttgaaactaaaggaaactaatcagcccactttcaaaattagtctggattttcaacgttagttctatcccttttctgatggtatcatatgtgggacttcagttatttcagtccaactggaacttttaactgtcatgacccaattactgatagtttgccaggatttcagacagctgcgaagaataatcttgaatccatctgtgacatttttggaggcagtattttagctgaccagagtattagaggaagagtcagaagcctagattcaaatctcacattctccagtcattaacagtcttacctcaaggaagtacattttttgaaccttattctctttatctgcaatataagaattagattaaatgattttgaaagtttcttctaatagaagcagtgaggctctagactggaatgtcagtcacaattgaggaaacagtaagatgcaaggctgaaaagagataaaatgaaagtctgcatattgattgatttggaggtctttatctccttccccatccaatatgggagactggaagaattttctcaggggacattgaatgggcggaaagatgtctggatgtgagtatataagtacaaaagccattctgctatctcatcatccaacaatgaaggctcccagaagagacaagcctggcactcagccctcccagtccatgtttaagaacactgactgaacagacacagtcaagaatcatcagtacttggaggaaactctgcaacttgaaagggagaaaaagaaataaacagaaaaagtatgcagtggaaatatataatgaatgcataaaccaaaaaagaaaaaaactactagaaattttagaaagataaaaatgtattacccctgaaaatatggaaagggaaaaaaagggacaaagaacagaaaaaactcttggaaattaggtatccaacttttttttttaatgagggaaatgtaagatgatacagctgagaaaagcttccagaaagaacaaaaagatgctcccagaaagacaaatgggaagtagggaagaaaaagttaaggaaattacaaggtccacctcagagggccagtaatgattaagaattacacaaacaggccaggtgcggtggctcacgcctgtaatcgtgcactttgggaggctgaggcaagcggatcacctgaggtcaggagttcaagaccagcttgatcaacatggtgaaaccctgtctctaccaaaaatatacaaaaattagctgggcatggtggcaggcacctgtaatcccagctacttgggaggctgaggcaggagaatcacctgaacccaggaggcagaggttgcagtcagctgagatcgtgccattgcactccagcctgggcgacaagagcaaaactctatctcaaaaataattaattaattaattaattttaaaaattaaatttaatttaaaaaaataaaagaattacacaaacaagggtgggaaacatcaaaaaatataagagaattttctgattccccagattacagtgtttcaacaagtacccaacacaaatggaaaaaaaaagtacttgtaccaaagcttgtcatcatatcattctggaacatgagagataaagaaaagattctaaaacctttcagagagaagttaattccatacagtgaatcaggaattttcaaaggtaatattggaactagaagacatttatgatttgagaaaaaggacttctactttcaactatgacagcaataattggcactggtctagtcctcccactgtaaataacgggaaaaagagcaaatacattaaacaattcttgtaagccaatagataataggcagtgtgagactgtgatctctctgagaaggaagcaagtcaggtgagctctacaatcatctcagcttttttcttggagatgtttaccaaaccaagtacaggtaggaggaacccaaaataagcacggatattttactaaactccgaaaatagtgataggagttcagtgacagtggggcagctagaacttgctgaacaaagtacccgagaagagaaggatatgtagaaaatagcaacaaaaatctgaatcagggttcttttctatccttggctgaatactacactgtgcatgtattcaacgatactccatcaggtggggcaaagaacagtttgtgaaggaagaacaactatcaggaaggagtgagctgaacaactaccagaactcacacaagattggaagataatcaagtcctgaccaatcagagtcggtagaccttcttgaacatctgggacatttagtggaaaatggcctcactttaagagtggatttaccctagacctgctttgacatcttaaaaacaaacctcaaaaggatcaagcttatgtacaagtaaattaactgtctgaaagaacactattcaatagtttttaaagaagacaccaaaattcagacattcagcagcattatattcataatttccaacatataataaaaaaaattaagacacatgatgtagcaagaaactgtgacccatacccaaacaaagtcagttaatagatccagaaatgacagagatgatagaagtaatagaaaaagatttgaaaatagctattctaaatatgttgaagaacttaagggacaacatgaacataatgagggaagagatataaactacaaaaaaaaagagccaaatagagctggtagagctgaaaaatacagtatttaaaatgaaaaatttgttggaggagcctaccagcagattagacactgcaggaaaaaaagagcaataaacatgacatagtattagaaactactcaaattagaggagaaaaagaataccacaaaagtattgaaagacctcagtcacctgtggaacaatacaaagcagtctagtatacacataatatataaataatacataattatggaagaagggggagcaggtgaaatttttgaaaaaacagccaaaatatttacaaatttgtggaaatttgtaaacctacaaatccaagagtttaatgaatcccaagcaaaataaacacaaagaaaactactataagccatgtcataatcaaattgctgaaacaaaaatcttaaaaccaatcaaagaaaaatgacacattatgtcagataaacaagaaaaaactttctatacttagtatcattcaaaatgacacagagatgaaaaaagatagaaaatgatataagatgaacaaagataagaaaacaactaactttctgtatccagtatcattcagaaatgcaggtgaaataaagatgttttcaaacaaaccaccctgagaaaatttgtcaccagcagattacactattgttcaagctaaaataaaatgaatccagatggaaactctaacctacagaaaataataagagagccagataagtaaaggtatgaataaatggaaaattcttttttctcatttgttagtttctttaaatgaaaaataactgtttaaagcaaaaataataacagtgaattatatatgtaatatgtagaagaaaaatgtatgacagtaatagtaccaaaaatggggtagaataaatgagacaatactcttttctacaaaatagtataatatttgaggctagaggctaaagttaaaaatgcatttttttaacagaaaaatattctataagtgtcctgcatgtagaaaatcctaaagaagtgagaggaaaagctacttgaactaaatgaacttagcaaagtcacaatatgtgtactcagtattttaaaaaatcaattgtatttctgtatatcagttacatacaattggataatgatatagaaaaagcaatttacaaaatacataaaatattaagacataaattttagatggaataacatgtgcattactctacactgaaaactactttgctgagagaaattagaggggggccaaataaatggagagggataccattttcatggattgtaagacacaattttgtcaagatatcagttattccaaaatcaacccatgtaaatttaatgtaatcccaataacaatcccagcaggcggccgggcgcagtggctcacgcctgtaatcccagcactttgggaggccgaggcaggcggatcacaaggtcaggagatcgagaccatcctggttaacatggtgaaaccccgtctctactaaaaaaatacaaaaaattagccgggcgtggtggcaggtgcctgtagtcctagctactcgggaggctgaggcaggagaatggtgtgaacccaggaggcggagattgcagtgagccgagattgcgccactgcactccagcctgggtgacagagtgagactccgtctcaaaaaaaaaaaaaaaaaaaatctgagcaggcattttagtaaaatttgacaagctttttctaaagtgtatatgagaatgcaaaggtcctgaaataacaaaaaccacttaaaaaaaaaaaaagaaaacttgggagtatttatactgcttgattttaatacttctataaagcaccagtcatcaagatggtgtggttttggaataaaaatagacatatagatcaatgcaaaataatggagagtccagaaacagacccacatttatatggcgaattgacattcaacaaagacaccaaggtaattaaacaaagaatagtcatttcaatacatggtgatataacaactgaacatctatgtagaaaaaaatgaacctcaacctctctcctcatcccatacacaaaaaaatgaacttattttgagttgatcataggcttaaatataaaagttaaaactataaagcttttcaacaaaaaaaagtcattgagatagacacatttttgataggacacaaaaagtgctaatcatgaaagaaaaagattgatacattagacttcgttaaatgttaaatcttctgctctttaaagaccacctcttgaaagaaaatgaatcaataatcaataacctttcaaaacagaaatcactaggctaaacccagatgggttcacttgtaattctaccaaacatttaaggaagaaattatattctctctaatctcttccaaaaaatagaagcaaagaaaatatttcctaactcatattgtaaaacacatatctgatataaaggagtgatacccaaaataaacaaagaactcttaaaatgaaacaatgagaaaacaagcaactcaatttaaaaatgggcaaaagatctgaacagacacctcaccaaagaagatatacagatggtaaataagcatatgaaatgatgcccaactcatatgtcattagaaaattgcaaattaaaacaacaatatgctggcgaggatgtagagcaacaggaactctcgttgctggtgagaatacaaaatggtacagccactttggaagacattttggcagtttcttacaaaactaaacatactcttaccatatgatccagcaatcacactccttgatatttacccaaatgagttgaaaacttatgttcacacaaaaacctgcacatgaatgtttatggcagctttatccataattgccaaaacttggaagcgatcaagccatgaaaagacattgctgagaagaagccaatctgaaaaggctacacatcctgtataattccagccgtattctggaaaaggcaaagctgtggagacagtcaaaagatcaggagttgccaggggtttgttgtcagtggttgccaaaggcaaggatgaataaggagaacacaggggattttatgtgataagtatcatacctaaaaatcccctgtgttcatatcatgtataaataaatgtacatagacatatacacatatatatatataaatcatgtgtatgcaatgacatgtatctatcctgtcattctgtattggtcaaaatatcaaaatccacagaatgtacaacacaaagagtgaactctaatgtaaactgtggactttagttaatactaatgtgtcaatattggcttatcagttctaacaaatgtaccacactaatgcaatagtaggaaaaactgtccaatctaaacactgggcaaaggattttaaaagatatttcacaaaggaagatatgaaaatggcaaatcagcatgtgaaaagatggttaatatcttttttttttttttttttgagtctctctgttgcctaggctggagtgcaatggcatgattgccgctcgctacaacctctgcctctcaagttcaagcaattctcgtgcctcagccttccaagtagctgggattacaggtgtgcaccactatgcctggataattttttttgtattttcagtagagatggggtttctccattttggccaggctggtctagaacttctggcctcaagtgatccacccgccttggcttcccaaagtgccaggattacaggtgtgacccactgctcccggccaagatacttaacatctttaatcatcaaggaaatgcaaattaaaactacagtgcaataccactgcatacccattagaatgcccaaaattttaaaaactgaccataccaagtgatggcaagtgatggcaagggtgtggaacaatttgaacttttacattgctaatggcatgtaaagtggtatagcaaatttggaacattgttcagcaatttctcataaagttaatcatacatttaccatgtaacccaacagttcaacttttaggtatttaaccaagagaaatgaaagtccacgtccataaagatacttgactacaaatatccatacagttttattcaaaatagccccaaactgggtgggcgcggtggctcacacctgtaatcccaacattttgggaggctgaggcaggcagatcacttgaggtcaggagttcaagaccagtctggccaacatggtgaaactccatctctactaaaaaaaaatacaaaactaggctaacatggtgaaaccccatctctactaaaactacaaaaaaaaaaaaaacaaatcagccgggcggctactcaggaggctgaggcaggagaatggcctgaacccgggaggcagagctggcagtgagccgagatcgcgccactgcaccccagcctgggcgacagaatgagactctgtctcaaaaaaaaaaaaaagccaggtgtggtggcgggcgcctgtaatcacagcttctagggaggctgaggcacgaaaatcacttgaacctgggaggtggaggttgcagttagccgagatcgcaccattgcattccagcctgtactacaaagtgagactctgtcccaaaaaaaaaaaaaaaaaaaaaaaaaaaccccaaaccggaacaaactaaatgtctgtcaacaagtaagtggtgtattcataaaatgaaacactgctcagcaatgaaaaggaaggaactataatactattacataggatgaattactcttggaaacatgctaagtgaaaaaagccatatatattcagattttttttaagctctcaaacaggcaaaactaatctgtagtaatagaagtctgatcattgtttgcctgagttaggaagattgatagccaaggaacatgaaggaaattttagaggtgatagaaatattctgttttcttgatttgagtggaaagtcctgggtttatacctttctcaaaatttgttgaactgtacaaaatttgttgaacttaaaatgggtgcattttattgtatgtaaattatacatcaatgaagtttagtttagaaatatctgagagtagaatgatttccagccaataactatcacatttcttgtagttgtaaagatagaataaagcattttcagatataaaagacctcagattttatctgcttgatatattcaccttttctagcaaaggtcctggaagatgtccttaaacaggggaaaaccaaaagagacaaaaccaaaagagacggaggaagcaaaggatctgaaaggaagcccaggaatgacagctgatccacaagattagggaacaaccagtgcatattgaaccgggggcctggcgaatcctctagaaaggaggcctccagagaagaaatgaattgatctccttgagtttatagaaaatattattgatagatttatgtcagaatgttgaaacatctgataaattctagaaccgctgacaaatgaaaacataagaaaattattaactccagaaaaaagaaagtatggcacaagagaggaggttcgaacaaagtgcacaatttgacttagcagtgagcaatatttgcataatcataatcaaaatattagcttttgattttataaaaaactatgatctctgttagggaattgggaaccaggatggtagtaagagaggtacatgtggaagaactaagacctcatctataatgaggggaagtcagtaaatctaaaatggagacatcaagaaatagcaatatatgcatatttagaaataaataggcaatgccaaagaaaacagttttcagagttgcagatggttgcctctattgagaaggaggtaactaagtgactggaaggggtgaggcaagaaactgctttatttattatgggcctcttggttctgacttataaaattatgtgtgtgtgttaacttgataaaaactagagttaatagaaatagtatctgctagctttgcaagttgtgaaagtggggtgttttctgtcatagtctgtattgaggcaaacagcttttttctcccttgaggcttcccctccggagtacagctccataagtgaaagtatgtaaataggccagaatctgtttcacctcgtgctaatatgttcgcaaaggccaagagcatagaggggaagataccaaggtagatatgggggaggtcagtagatgcagacaaccagtctacaatgtgtagatatagacaggaaagaaaaaagaattcagagaccataaggctaaggaaacaagttgggtgtgaaaaaggaaaaaagaattaaggattgcagaaggaaaaagaaagaaaaaagatgggaacaaaaatatgatagcgtataaagagaagaagaaaagaatcacttctaattctctgccccactcttacctctaaattgtcccatcactactgtctactagaaccagagtctattattgattggcccacatcttaagtttgtgcccgcccaggaaaatcaagcacctttccttactttagtcttcaatcttagctgaactgtgtcacgtacaaatatcttgcataggatagtttaattatcatcctccttcaccacctgagatacacagttagaagtaatggctctatcccccatgacacttatctttttctcttatacttttcttttccttgccattttgcactgtattctgagagaatctctgagctcaactttccagatcaaaactaaatcttcagctatgtccatcctgcccttcagtccatctattgagatcatttcatcatagctataattttaagatttctaaacattctttttcttaggagtctattactttttatggatgcaatagactttttaatctgtatgatgatatttattgtaatttggggttcactcattttctatactaactcttttttcttcaacattactttcttcattaaagttgctttctttctcctgttgacttttcttgaatgtttggtaaattttgactgtctctccatatatattgaaaaagatctagaattttaaaatactggtagctagtgtatttctttagctaaagtgagaagcccttttcccctggcagtgaatgtagattctgattatagaagccctacttctcagttgttgtgaggaataggccttggaggtggggaaaccccttgtggcagccctagcaccccctttgggagattccctgggcagaactcccattttgagtcatatgctcacaattgtaatcccatggacaggtgccagagtcagctgcactcagagcaatggcctggcagcagctgttcagccatccataattatccagcaattgcccatggcctgttcctttatttgctcaaatgaccactgagcctggagttgttctggtgttctgggaaaattcctctctttggaaaatctctttctcctgttgcaagtgttttagtttagttgaagtttcacaatcagtttgtttccatttgtgttttgtctttcagaaattcttcgttgttttagtcttctgccatgaaaatttcttctgcctttccttcggctgtagatttgtgttccccttttttctttcttgagttatttcagtggtgtttttgaagagaaaataaaatataagtgatatatctgccacattgaaccacaagtctccttgggttcgtttacaaatgagaaaacaaaggtccagagaaaagggagacacataaacacacacagacaaaaacttccccaaagtagtatttgtagaataaaccaggatttaaatctcaatccacctggtttcaaaacatgttgtgtgtatgcacacacacacacccaagcagtgtggccaagtgatttaagtaattttgttagaaatgttctaccagagcacatccaggtaaatactgctttttcaatggagatagcttttatgagggtactgttgatcagaatgtgtacagcatgcctgtttgtcagtaccttcaaaacctttgctgtgtccttttgactatcttcaaatccctattgtttgagggtagatttcacttttgaaaatttccagtcatgtggaaccaaatacgttgatctaaaaagaataatgctgttttttttaaatcaaaaactaaaaagtgtacctatgaggaaacttattttcttgaaggacctgtggactggttgagatagttcctgaagaattccaaaaatatttaagcattgacatcactggaataagtgaatgaccgtgtgaggcagttgtttttgtgttctgtgaacataaacattctgggataatttttttttaatcttattaattcacagtaaatcaaaaatattgtataactataaaaatcactattttcgtatgcaacattttcagtacctaaaaagatccatttttcagcttgggcaacatggtgaaaaatgggcaacatgggcaaaaaatacaaaaattagccaggcatggtggtatgcacctgtagtcccagctacttggggagctgagacaggaggatcacttgaacccaaggaggtggaggttgcagtgagccgagatcatgccactacactccagcctgggcgacagtgagaccctgtctccaaaaaaaaaaaaaaaaaaaaaaatcctttgaagttacatttcatggtttttgtatatttgtttatttatttttagtgattaagatattcacggttcaacattcaaaaaagtttttaaaatatatagtgaaaaatatctttcctggcagtatcgttttttctgtaccttcaaaaattacgtacatagacttccctttttaaaatacaaatagtgtcatactatacacattagctgttctgtatcttagtcactttttcacttaatgttctatggatgtcattctgtatcagtgcataaagagcatctttattctttttttatagctgtacaacttcttacagttgtaccagaatttacttaaccagtagcctgataggcatcttttgctatcacaaagctgtaatgaataatcttatgtagagataatttaccacatgtgacggtatatctgagatacaagttctgaatagaattgctgggtcaaaagatagatattgccaaatagtcctttccagcagttgtttcagcttacaccctaactgataatgtttccatttctgcatatccttgccaatacattgaattatgtactttctcatttttgcccatctgatggttttattcttttaggtatctcaatgtcattttaatctatatttcttttattgtgaattagatcatattttaatgattttataatattcatttatgttcatattctctacctattgtcttactgggtttttatcctattgatttatagaattttttatatgttagaaaaatgagttctttgtctacatcatgttttgaaaaaaataaaacactgtaactgctgtgcagttactgccaaatgtaacacaaaactaaaccagaaacttccttaacaacagctgaagaaaattaactgtgaatatcaaaatcagtagatactaaatcaactgttagaagagtagaatgtgcaaaagccaccctcatggttaagaaaatgctttctacttggtgtacagaaatttttttctatatcctaatcttggaagtgacagaaatttttaaattatttcttaatataaggggggtttttttgtttgttttttgttttgttttgttttgttttgttttgtttgctgggttcagtgtcccttttagctatattttaaatggaggaagtatgatgttgagccctttgcaaatatgataacgaatgttaatagcttgatcgggggatccctagggcttgttttctgcccctacttcagctgcctgtttccagcagaaatgactgtattgtcctgtattacatgtatacttactcatgtttgtgtcacagaaatgaccaaaaatatttcatttattctctggacaaagagagagagcctgtgtatttcctagaagaaatacgtgaagcataccttcacattttttacagaaggcagtttctaaagaaagtcgcaaaaggttgaaatgactttcagaataaaaaccaacttcttttaagcatgcagtctatccaaacaaaacttttttttgacttaaaattttattagtatggggatttttttgtttgtttttgtttgcttagtcaccaaactcagcatatgaatcttattttgaaaatattttatccaacttattttcttaacatttttttcaagactagtaaaattagatactgtgtcctattactgagtcaaataaactatcttgcaaaacttagtattgctagtagacagtggacagccatgtaaattttcttagacttttaaattaattaattttggttataataattaagattagatttcttgaaataagattgaggaattaacatgtaggcagagccaatgggacagttttagataatctttgaccaactttctgatttaaataatgacagaaagtaagtgattatttccctttttttttgttgttttattttgttgtgtttttcagaatcctacagaatttgatttctatatcatttgtcatgatagagatgaggttaatcgaaagctgtaattatatacatttaaaagtaaatgtgtttatgtaacttttatttctcagttatactaaatattgaatatattcacttagaagtgagccttgcatgtattatgtagttaataatgttcagtaactagcattaagtacattttgggaagcatccttaaatctacttattcttcattcattcgaatgagaaattctacctcaataagctttcccttaaaactccaaggctgttttagtttttaaaaaaagattctatttgggctactataacaaaataccactgactaggtggcttaaacaacagaaatttattttctcacaattctggaagcctaaagtagttttggtttcttctgaggcttctttccttggcttggagatggccctcttctctctgggtcaggttatccctctgtctgtattttttttctcctgaactcctcttcttggaaagacactagtcatattggattagggcccactgtaaagacccattttgtcttagttacctttttaaaggccctgtctccaaatatagtcacattctgagataccaggggttaggacttcagcatattaatttggaggggggtacaattcagcccataacaatgatcaattaatatatattcattttagaaatttcaaataaccatcatagaaagaaaagcagcctttaatctcactacctaaagtggacctaaagtgtgcgtgtgtgtgtgtatgtgtgtgtgtgtgtgagatcccagaatttttttatattaatatatatgaaatagtttataaaaacagagtcatcctgaaaataatgttttggaatatgttttcttttttcatttaacagcacattgtcaatatctatgccataattcattaatcagtccctaagtttctggaatttaggttatttataaatttttttctagtataaatagtacagagatgatcataaagctttccaaaaaagcgttacagaaaaacgttctaaaatgcatatactattttcttcaattacaaaacataattcaacttcttttttcatttgggccatcattataagtctcagttcttatactgttattgtacagctatattctaagattagcaactgtagagctgtgttcatttgctacatggcctcagattctagtttctgttcctgcctctgatagaatgtattttatcttttgctcaccactcttatttcgtggtgatgacactgtgttacttatagcatattctgatatgtgactgaaaagcagataaccaaaattgttaaatttatctttaagataaataatttctgacaaagtcctgagtgattctggataacagtaacctatgtacaaactttaatatcagattttccttgattcagaaatcttttttcactttctcatttacttttttattatgtggtcacactagatagtttaaattgctgaataagtgacctttgtatcattgaagtaatattttaaaggagaaatctcactctccaatatattatttttgaaaataccatcattttatcctccactgagataatgacttcttaccttttcttcttaaatcaggattacctgagctggaattggaagcaattgataaccaatttggacaaccaggaacaggcgatcagattccatggacaaataatacagtgacagctataaatcagagtaaatcagaagagtaagtaatacattttgtattttataaggtatcagataccaacttctaaacagagaactattttttccaaactacatttcagtctacagtggtattttgtgagatattaatagatgtaaatacttactaaaaaaaaaaaaaaaaagtgggcccggtgcagtggctctggcctgtaatcccagcactttgggaggcggaggcaggtggatcacctgaggtcaggagtttgagatcagcctggccaacatggtgaaaccccatctctactaaaaatacaaaaaatttgccaggcgtggtggtgcgcagctgtaatcccagctactcaggaggctgaggcaggagaattgcttgaacccaggaggtggaggttgcagtgagccaagattgcgccattgcactccagcctgggcaacaagagtgaaactctgtctcaaaaaaaaaaaaaaaaaaaaaaaagggtggcggggacaagggaaagacactgaattaaacagatttattgactgcatgaccacaaggctagtatacgttgtaatcaccaagagattgatataatatgtagctattgttttatatttcatgtattactttaattgattaccataatgtatctgggacctatggatgaattggcctcagtacaataattatattgctcttgaacttttagttatattattattttgtccagcatttctcttcgtttggtgcaagaagttataagaaaggaaagtatactttttacatctactcagtgtcacatcttgattagaattgaatttcttactccccgcaggcagccatattccataacgcaggctgcgtctcatacctgccaaccacaggaagactagatagtattgattgtggtttagcgccttaactatgaactgtattcccatttaccttctcaaaggaagaatgcttataattgtattattagtgttattaggattagtattattttgtatatatttctgttttatgtatcagttggtatctatttggattagactgtatatttcctacatgtaatcagtgaataatttgttgcttaatacctagcatatttcatttttccagtttgatttcttttgtaaatggtaatcatgtcatgttaacaatcaaaatgatttgatcatctttaaaagttaatataatatgtactgttttgattgtggttcagttattaacaattaatggcattcataaaaggtaaataaatagaataagtagaataaatctgaatataggctaaatgattttttctcagtttttggctgattttgtttttacttttattaaaagttatttcccctttcttaactgtttggttaattttccaggctatttctggaacataaagaatatgggaacaaagttcaatgactgacaaaagaatgaaaactatattcaagctacataccaaatactcatttaatttctacacattaaacatagaacattccatggcattagaattgccaagcatctcaacagtgaattttctaagaccaaatttgcatctatatatgtatataaagattgaataaattatttgctatgtcagtctgaaactttcttgttttttaatcctgcagccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggtatttattaaagtcaacattatttaactgatggagccctaagaagctagaaaattattttaagcaagattttaaagtattgtacccactatgctttagctgttttataatttacctcttgtgaaacttatcaaaatatatgagttttttttttaagaaaaagtattacagtaattagaattagaaataagtcttagcttttcactatggaacagaatcttacaagctccagccagaatagaatccagatttatagcatcacttctcattttagagcttaatttatccttcattcacgcttgtcttctgccagtatattccatggtattgcaacttccaggttagccttttttacacgatagggtgataaaatcactttagtgcatcttgaccagcatttttaaatggagtagaatagtgtagaatacaaagtatgagaatgcatagcccataaaaagaagtcatgttttgtgaaactcctttcagctgcatacaaacacacacacacacaagcacacgcgcacgcgcgcaattaggtcacaatttatatttcttacagtgggtaatagtgaaaacatttggaaaccataacgctacagctttctgttacatgagctgtggatttttttttcaaataaaagcatgaattttatatctgagatagaaaaatgcctgcttgatccctcctttaagaatctacttcctatagtaagctattaaatgtaaagtttattgattcttaggctttgcaatgaagttttttcccaaaccttttagttttatttcattgatttggagcctttattttaactatattgccatctctttactgagattttaaatatctcagctaatccgttactccatttcaaaagcagcttttataaatgatttctttaggtagtaaacttctggagagcatgaattcagaatgaatatatgatggtgctttctagaaatacggaagcatgttacttattggcagaaatttatttgtaaaatattctggcttcttttctaacaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcaggtaagtgctcttgtttagcagttgatactttttttttttttgagacgaagtctcactctgtcaccaggctagtgtggctagtgtgcagtagtgctatctcagcccactgcaaccgccgcctcccaggttcaagcaattctcctgcctcagactcccgagtagctgggattacaggtgtgtgccaccactcccaggtaatttttatatttttagtaaagacagggtttcaccatattggccaggatggtctcgatctgttgaccttgtgatttgcccacctcggcctcccaaagtgctgggattacaggcgtgagccaccgcaccctgccagcagttgatactttttaaaggtatataccaaatctctctgcaaggcagcccagttgctacaataaaagtgtcaagtccactcccagaactttcatgaaagacttgaagagccatccttcctctcctaggaaagggataagggaccttttcattcaattaaagacctttcattcaattaaatcaattcattcaattaggctcctaataaagcacttagagacctataacttaaagaacaatttaatttttattttttgagatacaaactatttaaggggaacatcatacaattattaaattaagagaaacagcttaatttacaaagtagagcatcaagagatactgtttatgattattggaaaagaaaataaagtttatttatattgattgaggttggagagattgatgcccagtgatgttactatattaggagaatgaaggagaataggggcctgggagttgtgagtgagttaaatcttctctctcatgacaggaaatgagtaggcgtagtggcataaatatttaagattgtataagcaacagatatggagataatcattaaggaccacaagagcaaacagttaaaaatgtctgctgtgggccgggcgtggtggctcacgcctctaatcccagcactttgggagaccaaggcgggtggatcacttgaggttaggagttcgagaccagcgtggccaacatgatgaaaccccatttctactaaaagtacaaaaaaaaaaaaaaaaaaaaaacgggcatggtggcacgtgcctataatcccagctactctggaggttgaggcaggagaatcacttgaacccgggaggtggaggttgcagcaagccgagattgtgccattacactccagcctgggtgacagagcaagactctgtctcaaaaaaaaaaaaaaaaaagccagctgtgggaagggggacctgagctgtagattgttgctgcttgttatgaatcttgtagtttctaaaaccatatttgtatattgccttgaatttttataaaagtatttaaagaggttccctggagacttactaattcaggaaggaagagaaagaaggagataaattatactggaaaggcagtatgatgtaatggttttaagagttctagtttcaagtcccagttccaaacttaagtgggttgccttaatcaaatgatttaccttttaaaacctctaattcctcatctataaaaagagtctaataaagaactcctttccctcactggtggttgtatggaataaatgagacaaaacatgtaaagcttgtagcataatgcctggcatattgtagcagttgataaatattagctattactataaagttgcattcaataaacataatatgtaatataaaatgtgcttccattctgtttaaaaaaaggaagatgacgaaagagaagagaaaaggagaactaagaaagggaaattttttaaatgatagaataacaataaaaggaataattttttaaatgctagggtagaataaaggattcaaagaagaattaaaggaagagagaggaaaagagaaagagaaggaatcataaatgttctgagatattaattgaagataaactacttcttgtagctttccattcatctttagatagagggcaccagaataagaaatgcttaacagtttccccgtgtttaatttttcacagaacatatttaaggggactacactaggtactataaggaatacaaggaataaaagaaacaggcaactgcttggctttttgactacaagacctgaaaaccattttgactacatacctgaaaagttaagtgacgctgcaagcagtatgtgattaagggctaaaccaaaaaagtaaaggaaagtgtaggtgtgctagtttctcattttacaatgtaaagttctgtaaatactgcctaatattaaagggtcaatgagcaaggccagaccaagggtctaggtcaggttcatgaatgaatggaatgatgattcatgcttgattcagaaaaaaaaagttgttttggcttccatttgctcctaaaacagctgataagcagagaagccctgcaaaggtatgagaataagatgcaaataagtgaaagttgctgctctttgcttcccttaaatctcatggatgcctatccagagatggcatggtaacctaacagagtaaagtatccaccaagttgaagaaacacagaatttggggctcaccatgttataagccccatgtatgtctatacgcaaaaacaacttctactgcaaactaagacagtaactctgctacctaacgagccacatatcggggcctgttccttctcttttaagccataagttcttactgtttcagcactaggtcgctcagcttcacttgcactgcaagtactaggagttttacatgtgtccacttaagggctttctgtgagcaggtctggccaaggttctcagtcagtgtcttggttaagatgctttcagccacaaggaaagaaaaaaagatcaactcagcatagtaaaacaataaagaaaatattttgacccaattgacaatccaaaatgaaagcagaccaaggtgtggttacttcagagattcagggatgttatcaaggacccaggttctttctctttttgctctgcaatccttggcatgccatgattacaaataccgtaggcaaacaaaactataactagcagaagaaaagggactgtttctttcctatgtacctctttccaaaagccaggaaactttttccagaaggtcttcccaccccatcccccgccaaaaaaagaaaaaaaggaacaaaaaaaaaaagtaaaaagggggaaaaaatacttcacatgtctgactagtcagaactgagtcacatgtacacccttaaccaatggttcgcaaagactgactgagaatactcctggattacccctggagttgtgtgatttgggatggtcagctgaacaaaatctgttctgtcttcaagaaagaaggggagagtaaatggctgcgggttggcaataacagtgcctgattaaatcaagaaattgaggtttaaatatattgtttaaagttatatagttaaattcacagttgggataaaatagtgaactgaggtagtattaatatatctcccctttctcctgccttaaatcctattaaataacaggttgtattttttgtgtctgtgactaagttcatgtcagtgtagacaaaaaaaagaacaccattagcgcactaaaaattaagtcattttgaaatacaaaaaaagcaaacatgagaaagaaacaaaattatatgcaaataatacaactatttatatagaaaatccaaaagaatctggccgggcacagtggctcacgcctgtaatcctagcactttgggaggccgaggcgggtgggttgcctgagctccggagttcaagaccaccctgcgcaacatggtgaaacctcatctctactaaaaatacaaaagttagctgggcatggtggtgcatgcctgtaatcccagttactggggaggctgaggcaggagaattgcttgaaactgggaggtggaggttgccatgagccaagattgtgccactgcactccaccctgagtgacagaacaagactccatctcaaaaacaaaacaaaacaaaacaaaaaacagaaaatccaaaagaatctatagggaacttagaacaaatagagtagttcagcaaggattttagataaaagaacaagaaacaaaaattaatggcaattctttttactagaaaattaattaaaaatacattcaggccaggcacggtggctcacgcctgtaaccccagcactttgggaggccgaggtgggcagatcacctgaggtcaagagttcgagaccagcctggccaacatggtgaagccccgtctctactaaaaatacaaaaattagctgggtgtggtggcgtgttcccagctactcaggaggctgagacaggagaatcgcttgaatccaggaggtggaggttgcagtgagccaagattgtgccattgcactccagccttggtgacaagagcgaaactccatctcaaaaaaaaaaaaaaagaagaaaaaagaaattcacactgttcaaaacttagaagatgtggaagtcataattgaaaggcaaaaagaacatccaaaaaaaaatactcatgaaagaaattatgtctcctaattggttgtcgcttgtaaaaagatgacagttgttccaaattcaatcagtaaattcagtggaattccaataaaatctcaacatggaatttgacaaatagatgctaaatttgttttagaagcatcaatacaatcttgaagtattaataaaatgagggtatacttgctctaccgatatcaagatttaaaacaaagctttaaaaattaaaccaggctggatgtgatggcttacacctataacccccccattttgagaggcgtaggcaggaagattgcttgaggttaggagtttgagactagcctgggcaacatagcaagactctgtctctaccaaaaataaaaaaaaccaaaaaacaaaaagccaggtgtggtgatgtgcacctgtagtcccaactacttaggagcctaagttgggaggatctcttgagccagagttcaaggctgcagtgagctatgattgtgctactcactccagcctgggtggcagagcaagaccttgtctctaaaaaaaaaaattaaaacagtgtggaactagcatgaggataaatagttctaccataatagagttctacataatagacggttctgcataatagctctacataatagaaagcccagaaacacacccagacatattgagagacttaataagagacagaggtgacaatggggaaagaatggcgtgcatcataaatgctggtacatttggctgttcatgaggaggaaaaaattaaatttgatcctcatcttatacaagacacaaaaataaactctaagtgttttagtgacctaaatgtgaatatgaaaatatctctgtagcctctttaaaatgacataaaggaaaaagtaaatgtttacattaaaatttacgacctagaagacaaaagacaccataagcaaggttaaaaggcaagacaaagactcaaagaagatgtttccaaccccatatgactggcaaaggactagtgtccagaatacacccagtttgtaatctgctattcataatatatttacctcattggattgatacccacccatctgttcgcttattggtcatatcctctccttccctcttcccaaatacaggagactgtaagcatctcatagcaagaatttagcaccatgcctagtgatttgagaaaagaaaacgggtgtactcagatatacattatagtttccttctttttggtgaattttaaggtcagtttaaaaacagatgttgaaaaaatatatatatataaatagatatcatttattggccatgagtatatctcactggctggtatatactttttactccttgtgtaaaggagtaaaaagattgtaacattttaaattcaattacacagtaatgaataaatccccagttgggaggagagagatgaaaaacatcctaggaaactagtgtatctgtattggttgagatttttaaaaagagcaacaagaaggaaggagctgatgattaaaaagcaatacgaagttacaagcctttaggtgtaatacccgcttactcctcaaataagcaaagacccaagaaatatatccgtaatatcagtaaaggacttctaaaattctattttgggaaaaagaacaacagcaaaaatgggtagacctgctgcttttagaaaatggtatcataggctgggcacagtggctcatgcctgtaatcccagcactttgggaggccaaggcaggtggatcacctgaggtcgggagtttgagaccagcctgaccaacatggagaaaccctgtctctactaaaaatataaaattagccaggcatggtggcacatgcctgtaatcccagccacttgggaggctgagacaagagaatcgcttgaacccaggaggtggaggttgcagtgagctgagatgtcactgttgcactccagcctgggcagcaagagtgaaactccgtctcaaaaaaaaaaaaaaaagaaaaagaaaaagaaaatggtatcattagctgacaaaagatatgatttttccactccagttttgttttcttccccagcaaggatcatgatcttcataactatcaagaggagaataatataaagagaaagtgacagtgagacacataaacaaatatggtatacttagcaatcttaaaacaagtcaagtccagatacgtatgtgttagggtactgaacaaatgtacgtatctgacattataagaaccactattgatcatcttttatatattatagagaatagaagtgatcagaaaacagaattaggattaaaggacagaaaaaaagagagaaacattttaccttcaggtttctggcaatgaaaaatgcccaataggacaataagtttctttaaagaatacttttgtctttgcaagaatttgtgcagtagctagctcagggtttctcaaccttggcattttaacatttggggctgggtaattcttgttatgggggagatgttgtgtgcattaaggatgtttagcagcattcctggcctctgcccacgagacgtcagcagtacctcctctcttagttgtgtcagcgaaaatgtcttcagatattgccagatgtcccttgtttggcagaatcacccctagttgagaacctctaggctagataatcatcttttaggtttcctataggaggacttcttggtaaagcactgggaagaaaatccattccggcagacaaagtgacagccagcctgaactgtgtgtgtttattttatacttaggaatgggtttgccctcttccgctggccacaagccccacatttccttttcttctacaacaagccttttaacctgtgtttgtgtctaaggactaacaactaatctcctcccactccccacctctctgaaagttaagatttccaaggagctgaggaatgtagcgatccttttgggaaggctatgttggaagaagtggaacttgacctacttgttgaaaaacaaagcattttaataattggagagaagaggcaggtcaaaataagacaggtgtacacagcactagtcaggttgcacacacagatagtcaaggggaggaaaaaatgaacaagggttaattcaagggcagaaatagaccaggtttcctataacagaaagtacttgtagatttatgctatttagaataattccttctacttctaaaaaagagcctattactacttgtcaggcatctttcctccatccctacccatttcatttgtacattatctcacaattcaaagaatatataaagctatatgtttggaatgtatttttacctggcctcattgcctcctctcctgtttttttacttgctgttccctctgcctcaagttaactctgccctcctccttgccaccttgcattctcatccttcaagatgaatgcaagctgagctcactcatgcttcttggtccctgtcttcatccctagactgaatgagttgctccctctgtgctgccgtagatgtgtccgtctatgcagacaaagcacctgtgcattttactgttgtgcgttggcttctgccactcaatagggaacggaactcctagaaggacaggaatttgctcacctttgtaacctccaaactttatacagtatcttgaatgtactgagtttttaagtaaatctttataaaattaacttggtttatctaaatttatgttcctggtctttcaagtttaagaagtatatcagttttggtatttaagagtctttttgacttttaaaactataaagttggtatctttctttttgaagtgactcagaacttcaaaaagttttaacttattccacaatgccttagagttgtcattttaacatttatattataatgagcttttccccaaaattggtttgttttctgatctaatgggagtgagaaaatgactgaagttagaattaagagttgagctatttgatgacaagagatttaatcactgttcatagctctttggattcttataaaactttcgtaggctttctagtttatgtataatatattgaaatatatttatgatatataagtatatataatttgtgttttacaaagtatataaacataaaatagtattaatattattgttactgttatcttccggaatagtttattcatatgaaattattgaagaagaaatgttttaagctatacattgttttcaagaaaatctcatttccaagaatacttcttttgttaccagatactgttaaggcatgcctggcatgcctatgacctggaaccctaatcctggtctagactgatcttccaaaccagtattcacagaaaattgttctgagagatagatattaatggttagatgttagaaaaaaaggttcatgataaataaattgcatagtatatcccttcttggcgatccacaatgtgcttttggccaattaaaggcttataaaatttctgcagtaaataaatctgttttaccttgtgtaacccatcatttccagtacttaatacagcacagcatgctgttttcccagcacatctattaatatcctgcagaacaatgttctttagcattgttctttagcataccaatttgggaaatgctggtctaaagtaattactttttctagttaaataaataatccattttttcagaccatttgtttcttacataatactgtctagctaatgaaatcatactggattttccccaaatatgtatccaccagacatagtacctccaagtgagaataccatccagcttgctcaactttcccttcatcttccagacctttgtaaaatgtgcccttactgtatacctgcttttacatttataatattttaagacctagggctggtacttcttcttccccattgcagcacttatctaaaataactattaacatgtttttttgttgttttgtttgtttgtttgtttttgagacagtctcgctctgtcacccaggctggagtgcagtgtgtttgtatcctacttttaaatactttgccatagtgttttggaggcaataagtgttttataaatgttgggaactactagccttttggaaaataaacataggaaataatctaaccaaacctgcaacactaaaactttttagtaatcaatagaaagtttgtgttactttataaggcccgtgttatgcttgtgtgtagaaatatatcttattgtttccatttttctctagttgatacaccaaaatcggcaagctatcttaaaccagtttgcagcaactgctcctgttggcatcaatatgagatcaggcatgcaacagcaaattacacctcaggtaatgtgagaaaaccagacgtcattagtacttctttaacccacatagtgtttcttaaagtgttgacttgagtgtctttgaaatggtctgtgagctgatcttttaatgatgtttgtagtgtagttttctttgagaatgaattaataatctacttttgatacctcttactgatatttgatctaaagcaaatggtgctttgttttgttttattgttattattgtcattgttattggataccagatgactaagtagaaaaaactcttatttctgtagcgaatagcaccagtaacaggaagcctctgatacgaaactgtgtgaacggtacccgaaacctgatcaaaacccagtcacattgctaagctgtcttaactatcttgtgtactatgttcaatttgaacatcagcattttctagcttgtatttattttttaaatccctttttttttttaataaacccagagccattagaactttaaacataaaaagaactaggtggacttctaaatgttacctagtactcactctctactttaccccatacatacctaaaaattttttgtttcaactacttacttttatttcataacaaagttgatgtaaaaatcttggagataaggaattttagagaggatttaaacaatactcttttcctctccacaatatggaactagatggattaggagcaaataaagccagcacctgtattattaaagagataaatacagccatgcatgacttaaagacagggatatgttctgaaaaatgtgttattaggcaacttcataattgtgcaaaggtcatagagtgtatttacacaaacctacatggtatagcctacttagcatcctggctatgtgtatagcctattgctcctaggctataaacctgtactgcatgttactctactgaatactgtagacaattgttatggtatttgtatatcaaaacatacctaaacgtggaagaggtacagtaaaatactgtagtattataatcttatgggaccaccgaatttggtccattgtgtgcaactgaaatgtcttattactaaaatgtcttattgctgaaatgtctttatgcatcacatgactgtattgactgaagttgttggtaagcagcagatattgacatcttcatggatccagatttcagtttctctgtcttacaaattataaatcttagtgctagctaattcaggagtaattaggttgtaaggaaacaagaccccacttttggattcacataaagataattcctatcagaaagtcttatttcatagtttcttctagattagactatatgtagttggcaagagctgtatgctttaaccagattctcaatctgaattgacattttctgaagaaggctttattgatatgccatgttacattgaaaaaatgattttaagctaatttgaccacttctttcctcatccataatattataactgaaaccacttacactaatgcctggaataatctgaaactccaataataatacaaaatagctgtttccatttatttctttttactattttatttctacttattttctttttaagtgataatttcttaggcattggatcctagatttcagaatcttccttttttaatggtatttgtaggttttttctaattgtaaaggtagtacatgttcatcgtaataatttggtaaatatagaaaagtataatgaaaattaaaatcacctataatcacatgttattcatttaaataaactgggataatgttctcagtgagaaaagtggaaaaactaagtttctctttaccagaaacacagtaaattttttggaattgaaaaagtcttctaatgatctaatgaaggataggacagaagtcatcaagcacattttctttcacttccttatggtcttcatgtttctcttaacaatgttcatggccaatattataatactaatcaatacatactttctttgaatttttcagttctgtgtgacttttcattgagaatttgcgttctcatttataatggtcagatattgtttagcatttcttgactacttttaatctgtaaaatatacttaattcattttttctcctgtgattgttacttaagaggtttttgttccttttctgttttagtttcccttgtacagtgataattgctatgtactttattgccccaagcaagtaggccttaatccaatgaactttccaggatagatagtgattataataattttagtaagtgagttttttcctgcttttcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggtaggaaggtcacaactttatgttgttctaagtaatccatacaggcttaggtctctctccatctttatgtctgtgcttggacattaaaatagtgtgtggaagaggaaagacactgacgtgggagtctggagacccaggattcagactcagcttttgacactaaatggttgactggtttgaggcttatctcccttttttagctgagatgattgaattagaggatctgtaaggaccttttgagcattttgtatgcaaagtacgttcccccttttttttttcttttttgttagatgcagtctcgctctgttgtccaggctgggagtgcaatggtgcaatctcagctcactgcatcctccacctcctgggcttaagcgattctcctgcctcagcctcccgagtagctaggattacaggcatgtgccaccgtgcccagctaatttttgtttttttttttttgtagagacagggtttcaccatgttgctcacactggtcttgaactcctgacctcaggtgagccaccatacccggcccattctcttattttttaatttttctcattgatctctatgagaattcaatgaaagtcttccccacacaatggattttagtacattaattcaaaattcgcatgtagttttttcattgtgtgggagattttgtttttgccagtttgcataagaataatttatctccacagagtatctcagactactcattggtgtcatcactctcagctgctgctgttgcagcttcctctccaatgtcagtcaactttctggcttccaaaagcttttttcttttttagtctttctttggcactgtcttccattctctttgtcctgggtgataatatcttttcttatttcttttctgtcactttcaggttctgataggtagtggcagtgatgaacatctgattagtctactctgtttaatcaaacttttatgcaaaattaattgtcaattcctgaaaaataattgaaataaatcccttgattatataaatgaaagaaaagaggtaaattttaaggctgcttaaaaatgaatttcaatgagaaagctgctgtttgacttgaataaaatgtcaaagttatacagagatttttgacatggcagtatgcttatcagttttgacagccaaatcaatttagagtttccattctgatggtagcaaatactaaaatcctttgactatcaaattaagtatctaaagacttgtgccagagagcaccagaactctaaagagattttaatcaaaattatgccacatcagtttctttgtcctcaagacaatgaagtcatctttggctggtttatatcagtgacactatctgtgtgggcgagaaaaggattataaatccatattttaattatatggttgcctgaacaagagtatggccttcaaaagagttttatttccatgtgtcttacaatttctgtatgcagagaatttgacaaagctttttcactttagcctgtggaagtacttcctccaacattagaagacttgtgtagtcatctgcatccccattcctcctccaaaatgacaacctgactaaaacagcaaatgggtttttagcagcattcataatattaattgcagagccctaaatcaaaagatttatctcatgcattaggggaaaaagctaactagaagtaagccaaacattaataaattcctcatgaaattattctaaggattttttctattaaaaaatagaaatagtatttctgtccattttcaggcatgtacttttaagtttcctctggaaagtcaagaaaggagaactttatattctgctttcattccttgacaaagccacctggaaaggcggtccttcagtgccccggttctcatgaaattgacaagtttctttcacagttctgggtctagccttttgatctgagttgtgtcagcatagaacaaagtgagctgaaataatggagtgggtggagcttcctctttccccgtaccataatgggaaagatgtgttgccacctatcatgagtatctggtgcctgggtttttcttccagaccaacttctgattgacaaaaatattttcacaaaataagaatttgctttttataaagtcagcattcatactacaaacaaaacccaaatgctgagtgcattgaagagaacagtggtttcatccagttgcaaactgaaatgaaatggcagggctgtcagttcttccatggactgcttcaaaataatactggaaaaatgtttaacttttctggacagagtaagaatgtttaaagatgcaatgtttttaatttctgtcaccactcttaattataaacttgctccaaattgatcagcagtctggtagaggaccaggttttgtgttggcacaaaatgaagttctggaaaagttccagccttttcaaaacaaaaacagtttattgtggcttaaggaaatccagataaaaaggctctttggcctttgttggttttatgcttctattcctaagaaatcggccatacaaaagtaccaaaatatatgtgttccaacatgtttccaggtttgacaaattaaggtccataatccagcccagttgttttggtaaataaagttttaatggaacacagccatacttactgctttatgtattatctatggctggtttcatatagaagagttgagtagttaaagaaactttatggcctacaaaactgaaaacatgtattatctggccctttgcagaagaagcttgctgatttctgtgttaagtgatgacagtaaaaccaacggataactgcattagctttgctttatatcctttgccttagcctctttccacttaatgtaggcccaaagtaaatgaaggaacatgaaagtcatagtaatggcagagtaagttttctggtatttctgaaaacaagaaacttttctagactaccatgctatgataatgagtgtaaaagaacagaatcagactttagaaattgttttcttttttcttttttttttttttttttctttgagacagagtctcgctctgtcgcccaggctggagtgcagtggcgtgatctcggctcactgcaacctccacctcccgggttcacgccattctcctgcctcagcctcccgagtagctgggactacaggcgcccactaccacgcccggctaatttttttgtatttttagtagagatggagtttcaccatgttagccaggatggtctcaatctcctgacctcgtgatccacccacctcggcctcccaaagtgctgggattacaggcgtgagccaccgtgcctggccagaaattgttttctattaaggcagtattcaaagtaaatatgagaaattggtttctttagtgtatctgcccacttcatgggttccttcaagcccatttagagacttcttttctgtgaactacaataaaatcctcttccacctattcctcctcagtgatctcttctccttttggggtttcagggacctttacatgctagtgactttattctctatctctaaacagtatctctcagctcatatgtacagctgcctactggaaacatatacttgcattttccaccaacaccccaaacttaacttgtacaaacctagactcatcaactccatgttcccttttatagttctgtgttccagctacagtaaactctgagttccgagaaacagcacagaccttgttctcttttacttccaggggctttgaacattgtctatactctatctaaagtattcttcctttacttctcattcctattcttccctcctctcagatatatctcctctgcagagtcttcctggacactcccaatcataaagtagtcaacaccctgtcttaaaaccacttgttaacctagctgcctttctttttaaatagcaagttccttacgtgagcagagtgtgacctttttaaccattgtttctccagtgcttagcacagtggtctcacagtgaatagatgcttaatgaatctttgaagaaataaatgaatgaaagtatgaattctaattctagttgccactgtcacatgtctgcaatgctagttatggttggtctagcagggaaacttaacatagtctagcccagctgggcacggtggctcacgcctgtaatgccagcactttgggaggcctaggcaggtggattacctgaggtcaggagtttgagaccagcctggccgacatggcgaaactccatctctactaaaaatacaaaaatcagctgggtgtggtggtgggcgcctgtagtccagctactcgggaggctgaggcaggagaattgcttgaacccaggaggcggaggttgcagcgagccaagatcacgctactgcactctagtctgggcaatagagcaagcctctgtctaaaaaaacaaaaacaaacatagtctaggcaaagatagaactgtaaaatttttcatctagaagaactagattatctgattgatgcaagttatccaaggtccagtgtgtagcagaactgggaccagaactctaagtattcctctaattcattacccacaggctagttctttctgctaaaactgggtcatttcacagacgatttttagagaaatgaaaccactctctatgatactataatggtgggtacatatcattatacatttgtccaaatccatagattgtacaataccaagagtgaaccgtaatgtaacctatagactctggggtagttgataatgaggacagttatacatgtgagtgaatggaggaggggtatgtagcttcatttacataattttaccaaaaataaaccctatctagtgaaagaaaaaactgtaaagtctaaagttaggaaatctcagtaccatccacttagttttgctttgaacctaaagcttctctaaaaaattgtcttttttaaaataataaatttaaaagaccaacactaaaaacaacagcaacaacaacaacaacaacaaaacaaaccacaaaaaagtcatcttctaagggaaactgttcattccaatatgaacagttagaatgtgagatgaagccagaaagaaatatcagaaagcttgctcttgtacttggagtctcttatttattgtttactgttgaccccacaaagtaatatccagaatatgataagcatcttttcccgctcacatatttttatttttatttttctctttttttttttttttttttttaatcttttgagatagggtcttgctctgttgcccaggagtggcgtgatcatggctcactgcagtgtccaactcctggtctcaagtgatcctcccacctcagcctcctgagtagctagaactacaggcatgtaccactgtgcccggctaactattctattttttatagaaacgggtctcactacattgtccaggctggtctcaaactcctggccttaagccatcctcccaccttagcctcccaaagcactggggttacaggcatgagccaccacaccaaggctatatttcttctaaaagaaattaatttcatcataaatgaggttaaaaacacattaatacaagagtttttcttttaaggatcacaaccaaaatagtttaaaatggagagttaatgcaaagacattagaagtgaagatggtggcaaaacaaaaacaaaaaacccaccctctagagtcataaatgaaaaaaaaaatggatgctgggcacagtggttcatgcctgtaatcccagcactttgggaggccaaggcaagtggatcacctgaggtcggaagttcgagaccagcctgaccaacatggagaaaccctgtctctactaaaaatacaaaagtagctgggcgtggtggcgcatgcctgtaatcccagctactcaggaggctgaggcaagagaattgcttgaacccaggaggcggaggttgtggtgagctgagatcacaccattgcactccagcctgggcaacaagaacaaaactccgcctcaaaaaaaagaaaaaagaaaaaaaaatggagacccatatattctaaatcaaaattacttaccttacatatagaggaagcgacaaggagaaaatatgtagcttcatttatataatctttaccaaaaataaataaaccctatctagtgaaagaaaaaactgtgaagtctaaagttaggtcaacttccacagaaaatttaaaacggttttaaaattctagcctataaggccgggcgtggtggctcacgcctgtaatcccagcactttgggaggccgaggcaggcggatcacaaggtcaggagatcaagaccagcctcaccaatatgatgaaatcccatttctactaaaaatacaaaaattagttgggtgtggtggtatgagcctataatgccagctactcgggaggctgagacaggagaattgcttgaacccagatgcttgaagcagaggttgcagtgagcagagatcacgccattgtactccagcctgggcaacaagagtgaaactcggtctcaaaaaaaaaaaaaaaaaatgtaacctataataaaaaaacgagtaaattaactacatctctggcaaatataatgattttctctttttatttaaccaaataaaccaagtaaaaagagaaaaaaatcattatattaaaaataaccaaaaaaattacattaatagtgacagaacacagtagatattacacaggcatatatgcatgtgttcacaaagtgacatcaaggacatagaaacatgtttgtgatgtaatgttgagggaaacaagcaggtcacagaatgttacaggattttataaagatgtaaaggaattttactaaattatgggcaatcatactatggcatccttttttctgcacctttataactttctctgccttaaaagtatttaactgtgagatgtattttgtcaggaaaaaaagaaagaaagaacacagtgctagcattaaacattaaacattttttaaaaaacatttttacacttttaaattctaatggatatctactttgggccagtagagtaagagggaccagagttactttcccatctgaaacaaataaacaaaaaacagacaaagtacattcaacagtagttcttgagattgtccagactgtgctgcggggagggagaatccaacaggagccaggccatttccctgagctgaggaggtggagctggcagtctgggaaagccaagacacctagaggtagcagggcacaataccagagaggatagcactacacagagaattgtaggatatgcagagggtcccattcaagtcttcagctgagagctgatgcgcgcacgcgggcatgcgtgtttgtgtgtacaaatcaaggccagagaaaaccacctgaaaagataagagggaaccatcttcaaagttcatacagggccagttcctcttcctaccagccagagtagaaaacctcataattcagggggtatcaagtagaacactcagagatggtttgcctcggtagtggggcaaaataagccctaaactctgctcttgtctcattaggcacaagacctaaaagaattaacctgtttccatgtagcctaaccacagcccagacaaaggtcaaaaatatttaaaagaagagaaaaaaaatccaacacctaataaggtaaaattcacaaggtctggaatctgatttttaaaactaccaggtatgcaaagaagtaggaaaatactacctgtaatgaggagaaaaatcagccaatcaaaaattcagaaattacacaggtgatagaattagtagacagagacattaaagcaattataaattataaattctgtttgttcaagaagcaagaggaagcttgaatatgttaagtagagcctagagccatggaagatataaataaaacccaagtcaaacttctggagatgaaaactacagtgtctgagatttaaaaaacaaaacaaaacaaaaaaaaccctagatgagataaacagcagattagaaattacagaagaaaaaaatagtgaacttaaagatataacaatggaaactatccaaaatgaaatcagagaaaaaagactgaaaaaaacctggtaatttactcaaaattgatcttataattcaatgcagaatttcagcatgctttttggagaaattaacaaacttatcctaaaatgtatatgaaaatgcaaaggacctagagtagccaaaataatttttaaaaggaagaacaaagttggatatctacctaatttcaaaaattaccataaagtcgcaacaatcaagacaatgtggtgctggtacaacatagagatcactggaacagaataaaaagttcagaagtaaacccttacttttatggtcagttgagttttgacaggtcagatggctgctaataagcatcatcctaaataaaaaggaatagcctactgataagtgctccaaagtggctgaacctcaaaaacattatgctaagtgaatgcaagccagacacagaagaccatgtatggctacatttacatgaaatttccccccaaaaagcaaatcttttagagacagaaagtagatcagaggttacctgggactagggatgggagcaaggattgactacaaacaggtacaaggaagggaatttggggaatgattaggtgtctaaactggatcgtggtaatggcggcacaactctataagggaatttggggaatgattagatgtccaaactggattgtggtaatggcggcacaactctataaatttactaaaaatcattgcattatgcagttacagtgtgtcaatttcatgttgtatagattaagtctgaataaagcttaaaagggggaaggagggggggaagagtggctaacaaaactttctcattattttttattttcatacatggctttttctttttcttttttttttttgacagagccttgctctgtcacccagggtggtgtgcagtggtgcgatctcgtctcactgcaacctctgcctcccaggttcaagccattttcgtgcctcagccttccaagcagctgagctaacaggcgtttttgtattttctctacaggggagaacgcccatcttgcgccaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccatctcgggggaaaaaaaaaaaaagtttaatttactacacaagtaattcatcatgtatgttcatacatatttttacacttaaaaattcacataagcaaaaaagaacagaaatagatcatatacaatcctgctgcacaaataacgtcttagtgaatggaaagcattattccgagcttacatttatttcattggtttatgctgagatttcttgccctagtttaagatactaaattttttccatgctctgttgaatgcgatatttgtaaatatattgcctgacacaagacaaggcaaataagaaagttatttgtaaatatattgtgacagatccttttgggttttttcatttatggggttaataaatttatagtgtatcaacataaattaatttgtgtcaatttacaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaagtaagggggcagtttttatatatgagcatccttgatactgtgataaatccttgatactgataaatgctacagtggttgaacctcaggaacattatgtaaagtgaaagaaggccggacacaaaaggccacatatggctacatttatatgacgtttccccgttcccccgtttatgtgtggagacagaaagcagcacataagaacagccatgctttcatgggctgattgtattcacaggctaagtagaagattattggctacttccatttgcataatggaaagaactaaattttatattatcagcaaagaaaaatgatttttaaatcttataagtatcaagtcacttctaaggcaaatttgtgtgctgacagtacagaaaagtgatctaggtccccaacctttccatcctaacctgagcacacctgcagaatatgatgagctcacatcagtaacagagcttccctgggacagacatagaaatgggtacttttttaaaagtttttctttataagaacactttaaaatcttataaatctaaaaccaagaatggcaaatgtcagaattcaatagagctgagtagtgggcacacaagtttcacttttctcgatgtatttaaagactttataacaataacaaaagtttttaaggcttaccccttttagaatctctagatttttagtgaccttgactcacccatcttgcttagaattatctcactaaagcctttttttttttttctccaaatcctggctgctgaacttttcacacatcactttgagttttataaggattttaatttggttgtgtcttagttataatgacagggaagctgtctgatctgacaacataataagtaaggcagttaaagttgaaaacacaagactatattcttctaaagttcattgaaaggtgagagaaaatcttcatgttagagaactgtgtaggtctcagtgaggaccatgtataaattaggtagaaatggaaccatatctgtaatacaagaggaatttagtctcctaatgtattctaatcccaacttcctaaactcactctggattttgtggcccatcattataatcactaccttacaggtactctgactcccttgcctatctctccctctgttgcacttatgcctggcaaaattctccctaatgaaatccaactaaactcttactttatacctccacctaagtattgaaatatggcttggggaaaaaaaaaaacagtcatgctgacatgtctcaataacctatttctctgctcccctttacagttaaattccttaaaagattatactctatccacttcccctactcctactccttgttgaactaatcaggctttcattcccatcattccacagaaagtgtccctgtcaagatagttaaatgtccttttcagtgccaaaagcaatgctcatcagtagcatttgacatatttgagcatttattctttcttgaagctcttcatttggtttctagaacaactctctgtcttgagaaaagtgactctcctcctatcacttagtctccttgaggatctttctcatctccatgacctccatttgagggccccagaggtgattctaggacctcttcgccatacccactccctcctttggttgcatcacccatcttactattgtcaatgcctactgctatgcttgactcccaaatttaaacctccagtgcagatggctttcctgaacaccatactctatattcagctgcctaaccaatatctccacttataagtctaataggcatctcaaacttaacatgatgaaaactaaagtgatattttcaccagacctgctcctctgggttactttttcccatttcagtaaatgacaattccattttccacttgtccagaagaaaagtctttctctttctcacatcccacatccaacacatcagcaaatcatgtcagcttcttagcacctctctcttcttacctattccacatgtgcaccttaatgcaagccacaatcatcttttccctgggccattccagtagcttcctctcctgcttccacccttgctgcaccatcatttaatctccacatgggtagccagagccatgcttttaacacatgaggcagagtatgtccgtcctttacgcacaactcatccagtagctccccatcttactcaaaatacagaatagggcccgtaaaaccccacatcatcttgttcctggatacctctctgatcccatctgttattctcaccgctcactctgccacaatggcttccttttatccttctgctcctcagatgtgcgaagtacactgcaaactcaggatgtttgcattttttaatctctctgctggaatgttcttccctcagtggccacatggcttgtctctcacagttcaagtctttccttaaatgtcactttattagacacagacattaaatgtgaccttattacacttccctgaccaccatttctgaaataatagcattttctacccctggcgcctcctttccattctttacttttttcatagtgattaacacttgacatactgtgtgatagtctatttatttgtgatttttcttctccatctagaatatgagcatcataagagcaaggactttattttgtattacttctgtttctccatactctggaacagggaggcccttcatatacatctatcaaacaaatgagtacaaatactccctaagtcaacatcttggattcagattcaaatatgggtataggttttcgttgtattttagtagtttttgcaaactttgactttccaaatcatttgggaaagaaaacagttaccaccaactctttaaacactcacacttgctcatttggttcatgtgcaaaagcttattagtcatcataagccttgtgtattagcgtatatcacctggagacagtgaccactcactgtctctgtcacacaacacaagataccatgaggaacactgaaaaacaacccctgctgccaaataacgaagagtctagttggtgagggggcaggtcagagagaattaaaacatgaaacagtcagagaaccattaagtagaatgatgtaatagagttcagaggtagtgtaacatgattctttttcattatctctctggtggcaagagaaagaaatggttaaacaaacctgtgggtcctggaactgggtagtgcttctgtgtaaggctggttgatgggagaatcccattgcttattagcattttaaaggataagaagtcctgttgtttaaccttttgtttctcagacttatttgaccagggactcccctgcttgttaatacctgtaatatctgtggaacccactctgggccagagtattcatccttctctttttcccatcatttagtgactaccaaatacctagtgctaccctgagaaaactgtgatagctgctacaaagcaggcaggaaagcagagtgaggaagagggcctgtgaatgttggactttaggtgtcagtggacccagacgtctttctaggacctaggacagtgattgcagctgcagaagagcttggtctccttcccttaatgggagatgctaaaatggaactattggcaggagcagtttgaaagaacttaaactaatatacagtcccaaatattaatttgaaaggaaattaagctctaaatttttttcaataagtatgacatcattgcagtccttgaagtttccacatgcattaacttacatagccttgctcctccgcagtggtgacttatgtatcaattgacaaatgagtactgtcttaggcagaaatgttctcattagaaaataggcatagaggctgggtgcaatggctgatgcctgtaatcccagcactttgggaggccgaggcaggttgatcatctgaggtcaggaggttgagaccagcctgaccaacatggcaaaaccccatctctactaaaaaaaaaaaaaaaaaaaaaaagaatacaaaattagctgggcgtgatggcacacgcctgtaatcctagctactcgggaggctgaggcaggagaatcacttgaacccaggaggcagaggttacggtgagctgagtttgcgccattgcactccagcctgggcaacaagagtaaaactcccatctccaaaaacaaaagaaaatagacatagattagtaggcttttttctcacctttagttgtaggatcactgccccataagcatacacactgtgcagacattaatggtccacaggtgtattactgactatttcctaggcatataattttctgtgggcatttttgttttataattacttgggggaaaattctgtacttttcttcagacatgataaataggctgtttattggcctgtcaattcagtatgattaccttagtctactggaaactgtaaatgtcagtatatccttcttaacactaagagctagcgaggaatagataaactattgatggggaaaattatttttaaaatcaaattctatagaattaatattaaaataggtggaattttaccagcagtttattgttaacaattaatatatagtcataaaatatttgatgtttatagaacttaggaaagacagaattaatatcattatcctttagatgtgcatatctgtatcaatgaaaattttcagggttcaaatacaaagtgtcaagttgaattcccatggagtttattgcttactattctacttcctaatagagactgattttacatttgagatctttggtgtaacaacagtccagaacttggccatgaagaaggaagtcagtaaaacaggctctctgaaaaacataactgcttatgtattttgcttcctagaaaagacatgaagctatgttgaggcctgataagaccttggaagtctttaaaaggattaaatttgccacctaaaaacatttggttgtatacatctggcttcctcttaatttgtagcatattgaaagcgaccagaagataaaaccttgagaagtgacaacaagctataggatattgaataaagggtctcaaattttagtatgcatgaatagttaaagatggacctttctatacccacccctggaaaatgtgattcaccagggcttgagtaaaacctgggagtctcaattgccagtgagtcccagggtattctcttgtagatggtctctgcactacacttcaaaaaatgtatgccacttcactggcacagatacagtaaaccatttaatagaaaacaatctgaactgcaccatttgacagcaccgaataataatccatgccataattcatttattcatcaggtatttactgagtgcctgctatatgtcacatattaatagagatgagaaataagtggaacaagataccatcactcccctgaagtattaagtctaagaggctctacaagcaaacacaatataaggatgctgtctttgaatcattcattcgtgtgttaattcattcagtgaacatttattgaagatatatatatatatgtatatatatgccagacactttgctcaaataggacattctctgtttagataggtaaatgtcagttacctagaagatttacttacatggaaaacttcctttcttaattatttagatgattgtagcctagcatctctgatattgtgccagataattgttatttaaaatgagctcttttcagttatttaatcccttatgtagacttcagaatgtatctgaattatattaatttttatatattttaagaagttacagtcatacatgcaatttaaggatgtaacatattttatttggaaacagaatctagtcatatatccccttgttcatgatcagtggatgtaatctggattgtttttgagtttacagtgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcaggtaagtggcacactcgccacacacatgccacaccacatcacagttaattctgaggaaaatcaggtatgttgacagttactcatcagaaatagccacacttctttattctttcccactaacttttaataattactggctcttaagatatacaatgaaaaattttgacagacttttttttttttttttttttttgagatggagtctcactttgtcacccaagctggagtacagtggtgcaattacagctcactgcagccttgactgcccaggctcaagggatcctcccacctcagactcctaagtagctgggactgcaagcacatgtcaccctgcccagctaatttttttactatttgcagaaacaaggtctcactatgttgcccaggctgggcttgaactcctgggctcaagcaatcctcctatcccagcctcccaaagtgctgggattacaggtgtgagccactactcctggccttgacagactttataaataagatttcagtttcatgagattttagtgttttagatttataaaacagtacatggctgggtgtggtggcttatgcctataatccgagcactttgggaggccaaggcagatggatcacaaggtcaggagttcgagaccagcctggccaacatggtgaaaccctgtctctactaaaaaaaaaaaaaacaaaaattagctgtgcgtggtggcatgcacctgtaatcccagctccttgggaggctgaggcatgagaattgcttgaacccaggagttggaggttgcagtgagctggtaattgcgccactgcactccagcctgggcaacagagcaagactccatctcaaaaaaacaaacaaacaaaaaaacagtacatgtaatatattgtcttggaatattccattatattttgaaacattttcttcatctctaccttttaattcaataagcatttattcagtacttactgtgtacaaagatagccttgtgggacatgcatatgtacaagttgggaaagacacaacatgaacaaaggatcattttaatcataggacaaaactggtatgtaagagataggccatatgtgtttctgtcagatgaggagtgtatgcacagttgactactgagggcttaaaagaaaaaaggcctggtcaaaaaaaggcattatgaaaaagttgcctaaacagaatagaaaaagaacattcaagattggttatcacagcatgacctaggcaggataggagttgaaagcctaattaatgttaaggggatatttatattttatttagagaagaagtaatgtggtaagcttttttgatatgttgcatgccatctaagtgtgtggaatttatcctggagcctcttacatatttttagaagagaatgaataaattcaaaacaatatttaagattattgcaataactctctatagttgctattctcattattcgtatcagcaaccacaaagtatgctatagtaactaggctattaccatgcagccatcatttataggcaatcataaaaatatataaacaccaattaccttttttatcttcaaatgatactatatcacctcatgtatagaggtgtatattatatcacctctatatcacatgaggtgatatatgtatgtatagaggtataatataatgtatagaggtatatataatgtatagaacctcattacaatttatttctattttgtccctcctgtgctactgttgtcatacatgttatatttatatatgttctgttccctgcaatttattattttttctttagtcaattataaattataaatttataaattctacttacaaatttataaattaattataaactataattgactatttaaagaaaatttaaataaaagcttttttatatttacccacatagtcaccactttaaattttctgcattctttttgtagttctaaatttccatttggtattattttccttctgcctgagggtcttgctttaactttttttttttcttttttttttttttgagatggagtctcgccctttagcccaggctggagtgtggtggcacaacctcagctcactgcaacctccacctcccaggttcaaccgattctcctgcttcagactcccaagtagctgggactacaggcacccgccaccatgcccggctaattttttttttttttttttttttttgtatttttggtagagatggggtttcactgtgttagccaggatggtctcaatctcctgacatcatgttctgcccgcctcggcctcccaaagtgctgggattacaggcgtgagccaccgcgcccggccttggctttaacatttttatagtgcaggcctgcggctaatgagcttttctatgtctgaaaaagtctttcaccttcatctttgaatgttctttcccctaaactctagcttggcagttttagctttcagtactttaaagatgttgctccactacagtgttgctgatgagacatctgctgtcattttatctttgttcttccatgtatgattgatgtttttcccctctggctgattttgatttttctctccaccactggttctaagtaatttgattatgatatgcttcagtgtattttcttcatatttcttattcttggggttcattgagcttcttgattcattaccatataattttcattaaattttggaaaaaattttttgttgtcgttttttgtttttttgtggtttttttgagacagagtctcactctgtcacccaggctggagtgtaatggcgcagtctccactcactgtaacctccacctcctgggttcaagcaattctcctgcctcagccttctgagtagctgggagtacaggggtgcgccaccacacccagctaatttttatgtttttagtagagacgggattttgccatgttggccagactggtctcaaacccctgacctcaggtgatctgcccacctcggcctcccaaagtgctgggattataggcgtgagccaccacacccggccaaattttggaaaatattgatcattatttcttcaaataatttttgtcaccatccttattcctctccttcagagacttcagttgcatgtatagtgcacttgaaattgtctcacattcaccgattctctaggtttgggggctttcgagcactgggatgaggttcagttatttttttctttgattttagaacatttatattactgtagcctcaggttcactaattctttattttgcaatatctaatctgtttatacagtgtatttttcatctcagacatagcagttttcatatctagcagtcatatttggatcctttttatatcttccatatctccaacatttttttcatatctgttcagcctttcctcttatttcttaaacaaatggaatatggttattataattgtcctgatatttctcacctatcagttctattatcagcatcatttttgaattgatttcagttgacttcccttttcattatgcatcatatttttctgcctctttgcatgcctggtaattttttattggatgccagacatgaattttaccttgtttatattcctacaaatattcttgagctttgttctaggaaatggttacttggaagtttgatccttgcttttttgtttactgcgaccaaagcagtattttttctagggctaattctaaccttaccaccaaggtaaaacctttaatatgctacatgatactacatgaattacgatgttttccactctggggggtgaaatcagggcttattcccagccctgtggggactttgggaattgttccatgtcatctattcaggtgattgtttcccctgcatctataagctgattagtactgagcttcagacttgagggccactgcagatctattccagagctctctctgatattctgctctgaggattctagctgcatccccttaactcagggagcctgccaggcgctgcctggattccctttgtccatgatacagccggaaatacactccaggcagtaggctgggcggttgccacagtagggactgctgaactgttagggatcactgtccttcgttgcctttgtctaatgtcttcagtgcctttttttcacatattttgtcaatttttttagctgattgaggcaggaggataagtctgatccctgttactaaatcttgaccaaagtgtgagtctaccactaattaacatatgtatgtgtgaattaactttttattaaagtatcatatataagaatatagagaaaagtgtacaactcaatagattttcacaaagtgaacacacctgagtaccactcagatcaagaaacagaatgtcatcagtaccccagaggttctccttgtgtcccttacacactcactaccccacaaggggaatgactatcctgacttgtaacaacacagttaattgctaagcttttcatttttgctgtgctcctattacttttctgtcagtgagattgtttttcattggagaatttggttttcagtttaaacaactagcttgtaatttgatcttgtatttatctttaatagataaatgatcccgcactgagacacacaggcctctactgcaaccagctctcatccactgaccttctcaaaacagaagcagatggaacccaggtcagtaaggaaattctaagcccagagctgtcaaatgtactctagatgcacagaggtcattgtgtagcatcattaagagcctgaccttgggagtcagacctgggtgtgagtcctggctctgctcttcttagctgtgtcgtcctgggcatgttatggagctttcctgagctgctgtataaccacagaactaacatgacacctgcttataggattgttgagaggattcaatgagatcagttcagatggcttaactcagtgcttagataggataaagtgatcacaaatggtggccactaattgttattttgtaaataagcacagtgctaaaaactcatctgtaatcaaaatacctcagaagatctcagtaattcagacaaaacagagtacctgctgtatacttcacctcctaagaagtatgtttcaaaacagcacaaacagcaaggtggccactttcctatattaacctaatttagaaattgtgggccgggcgcggtggctcatgcctgtaatcccagcactttgggaggccgaggcgggcggatcacaaggtcaggagattaagaccatcctggctaacatggtgaaaccctgtctctactaaaaatccaaaaaattagccgggtgaggtggcgggtgcctgtagtcccagctacttgggaggctgaggcaggagaatggcatgaaccccggggggcggagcctgcagtgagccgagatcacgccactgcattccagcctgggcgacagcgagactccatctcaaaaaaaaaaaaaaaaaaaattttggaggaagggcttaattcactttcgtaactttgggtgaactttggtctccctctcctctttttttttttttttttttgagttgnnnnnnnnnnnnnnnnnnnnacttatgtgggaaaacctaccgtttgcgcgagcggccgacctgtgatggattgaactttggtctctctctcttttttttttttttttttttttgagttggaatttcgctcttttgcccaggctggagtgaagtggcgtgatcttggctcgctgcaacctgcgccccctgggttcaagcgattctcctgcctcagcctcccaagtagctgggattataggcgcccgccaccatgcccggctaatttttcgtcttttcagtagagacaggttttcgccattttgaccaggccggtctcgaactcctgacctaaggtgatccacccgcctcggcctcccaaagtgctaggattacaagcatgagccaccacgccaggccagactttagtctcttaatgaacatttttaacccagggattatgccacagatggcagtaggaagacacataagatatgttccatcagcatctggtgaactgtggggagaagtgaggaaaggaaacttcatttgtgaaatgcttgtggtttgccaggcactgtgctatgcactgtatgcattatctcatttaagcctcactataaccctatgaacgaggtagtattccttttcttcacagatgaagaaactgaacatgaggaggtttaactacatgtaccattcacagtgctagaaagaggaagagctgaggttcaaacccaggtctttctaccgccagagtccacactgttcctgccataccagttagggactgctgaaagataaaacacatcaatatatgcacctaaactgtcacaaaaccaaagaaggcaaattattaaatttatgttacaattaatgaaccataagcattcaaagaaaggagaatttgctgagatggtcacaagagcatttttgcaagagatagagctgagctgagccttgaaggacagttaccaaggcaaagggaaggaaaagggtatggtagttgttggaggctggtgcagaggtagatttagaagtagaaggaactggaaggccacagaaacagggaaatagtaatatctcaacatagtcctgggaaaccaaatcaactgaaggtaaagggtttataataagtattcataggaattaaaattggtaaagtggcttggggcaaatttccagaggccttgaatgctaaactgagggatttggattcaaccctatggacagaagagtcatccctgaaagggaacatcgatagaagtgctagtttagacttcatcttgggaagaaggtgaaggaagatatattggccagttgagaaggacaaagattagaagactgggttcacagtctaagcattaggaaataggacctgagtcctctcaaggtaaagagaaggcattttggcttacacctgtaatcccagcactttggaagcctgaggcaggcaaatcatttgaggtcaggagtttgagaccagcctggccaacatggagaaaccctgcctaaaaatacaaaaattagccaggcatggtggcgggcacctgcagtcccagctattcaggaagttgagacaggagaatcgcttgaacccaggaggtggaggttgcagcgagccgagatcacaccactgcactctatcttgggcgacagagggatacttcgactcaaaaaaaaaaaagagagagagagagaaggcattttaagactggggagccgggtgcggtggctcacgcctgtaatcccaatacttcaggaggctgaggcgggcagatcactaggtcaggagatcaagaccatcctggctaacacggtgaaaccgtgttaaaatacaaaaaaaaattagccaggcatggtggcgggcgcctgtagtctcagctactcgggaggctgaggcaggagaatggcgtgaacctgggaggcggagctggcagtgagccgagatcgtgccactgcactccagcctgggcgacagagcaagactctgtctcaaaaaaaaaaaaaagatcgaggaaatgaagagtcttcattcaccagatgtttttgaaagtctcaaacccacagagacattactgggcagcttgacaaattagttacacccaaacaaccatgttttaaagttccagagccctgccctgaaacagtatttgaactgaagcaaaaattatgccagaaaatcttcagaggttgggactcagctctcacaccagtcttctcacctggaagatctgaagcttcttttgtgtcacactttgcctatctgagaagttgtgacaatataagaagtcctttgtggactggtctgagacacccccttttaagtaatagtttgaaatgggttttagagtttgttcagtcttttcagttttctgtaatttcaataatacactttttttttttttttttttgagacggagtctcgctttgtcgttgcccacgctggaatgcagtggtgcaatctcagctcactgcaacctcctcctcctgggttcaagtgattctccagcctcagcctcccaaatagctagaatgacaggcgtgtgccaccacacccagctaatttttttattttttgtagagatgggtctcactatgttgcccaggctggtctcaaacttctagcatcaagtgatcctcctgcctcagcctcccaaagtgctagaattagaggcatgagcctccatgcctatcctagactatcttttaaaaagttttatttttaaagaagcagaactttctagtttgttttatcatgcctttatcaagaactttttaagaatttagggacaaaaacatcttatgctctgccccaatatttcatatgtagaaacataaacatcaaattttatatgttgacctttttttaaatcactgcctaaaaaagaactatattttgtggtcatgtgaagtttcagtggtagaattttctttctgttgtggccaatcatgaatcttgctccagtgtttttgtatttaccagacggcagctggggagtgagttagacagaaatataaagacagatatacagaaagggagaagaaaaagatgaggagaagaggactaggggagtagtagggaactgggatgggatggggaggaggtaagacaggagagaacaggaagagaacagaggagtgggaagagggatggcaggaggaggtaagacaggagagaacaagaagagaagagaggagcgggaagagggctggcaggaggatcgttgacctaggaagagaggaaggcctggtgaagctctagaaggaaagagtcagaatgagacgttacagaccacaaaggcggggcaagggcacagaggcagctggagagcagactgggcgcgttggtgtgttatagacacaagagaaagagcccagaggaggcagtaacaaatgggagcatataggagctagaagccacatttgggaaactagggaaaggggaagagaaggagagaaaagcagtgcaaatctaactagagatttgattccttaggcactaggaaagctcagcttgggggctgtctgcctcatctgagaggaaggaaagtggagatataaacggattaagaggataggagaccaggggacagactggtgtccaaatttgatgcataccacatttgacatttggctaatgaaggttgatggaaaacaacttttactcgattaggatagaaaagttttttaaaaagctgagtgtaattgacatgaattagtgataaatgaccaaaaaaaatacaccactaatctaaaatactttatgacctatcaaacaggagacacaagtttgtcaaaaagtttgagacacttagatgcacttagatgccttagaaggcatctccattcctggtctggaacattcacaagtgtggtattggccctaatcagttctacgaacaactttttaataaggctggttggtaaagactaacttctggctttgttttcccaatagaatatgctagaactgtgcaactttagacatttttaaggaataagtgtattattactcatagtagtgaagggaaaattcacactgttctcaaggctaatagacgtactgttaattttagctcatgtgtttaaatggattgtctatcaggggaaaaaagtcaaatatgaaattgttctaatgataatttgctgtaattctaaagccaatatgtgaaagagctgtgtaataatatatttaaatactaaaaaatcttttggacattaaccttagatgctgatgtcctcttattgagttgtggttttgttttgctaatactggttgaaagccctttaatttttcagtgacatcataaagattttttatcctactgaaatcatccatagaatggttttaaaccagttttctaaatatcatgtattttttaaaacctaccactggatacccagactctgaaactgggcttctcccaatcttggcaacattagcaatgatactcactttcagtattgatggcaaccctataggaggcgtgaccattccaattttgattttatttttaaagtgtgaactttccagaaccctgagcaaaatgagtgcagcgattttctttttgtaggacaagaagacagaagagttcttctctgtggtgactacagactagaggaatgctctagtgagtttccacttcaagtagtacccactcataagccgggggggcagacccttctgtctaaacacatcttttatttgtgttccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtc

SEQ ID NO: 13293 - DNA, 57402 bp, Human
  misc_feature (1)...(57402): n = A,T,C or G
atgttttgtggaaagactcttctggtgcctctgtgaagaagggtctccaggtttcagataacagcacctctcaatctggttctcatatggagagtaaggacagacagcttgggctcagtccacagactcaactgccctctgcagagtggaccatggataggactctggcttggtccttggccttgtggaattacactttatttgtatcctacaggaaaaaaaaaaagattaagactcccatagaggaacaccaagcacagacatggtctatccaggatactcaaggaagcaggagctgtcaggcaatccaagccagggcaggacttctcatggtacagtacttcatgattcattatttcatttgagcctcccaaccattccatgaagtagttgttaattatttctttcccgcctcgaatttttaaaaaaataaatgaggaaactaaggctggagcaaggggagtgactgctcaaagccactccattggatggccatcagaactggaacttcaatccaggttttgtcttaggtaaattctgtgcctctttcactatagaaaaaaaaaaattgctaagggaaggcttcgtggaggaggaggtgcttgaactgcccaagtggcagggcactaagtgccgaagggtgaccaggcctctgggcaaaagcacaaagatgctgcacagcaaagccagttaaagaaacaaaacacggttccgggaatgtgcactgcttgaggacaggaaggacccagatcctagaatggggcctggggctcagcaggcgctggataactgaagaaatggctgtctggaacacagatttttctatagaggagtagtggcggtgaggctgcgaaggcggaagatggagaggctttcacacaaggaaggcggtggaggaggagcgagggggctcccgggtgcttgtgcggacataaggtgcgagagaatcagctggaaggtgggctccagcagagagaagaggaaggccagaagtagaccgggacagggggaggaaaggacagagtcaaggaacatttaggagttcggttcccggaggcctggcgacaccctgacggggaggggtgacgcgcacccatttgcaggcagaaaggcaggagcaggggggtgtccgaggatggtggctcggagggaccaggcataggtggtgcaagctcagcagtcactcaaggggtggcatgcggatgagggaggcgcctcccggactgggggaccgggaaaggcattagcaacctgccagaacccggttaacaaaggcaggactacaattcccggcatgctcgggctcggtggggtgacggcgggcggtggctgcgctgcacccgactggtgggcgcaggacctgggtcggcaccggagcctgtcatcccggagcggtcggcgggggtgcagagacggcgatgcgcccctgtcccccgcacccgggccgctccgggctcgcgcctcccgccccgcggccccgccccctgccccaccccagtcgggaggcttagctggggccgcagcgcggcggcaacatcactctcgctgccgctgctccgccccatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctccagcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcaggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcaagaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggtaagggccccagaggagctgggcactcgagatgtccgcaggggatcccggcaaggaggctcttctttgagagtctgtgacctggcctgaagtggaggttctccctcagcaccgcacactgccctcctgccaaatgtgcccccagagcagccaggcaaattgctgtgataccgggctgccaggtacatgcacaggcacacacacacgaagcaacgtggacaggcggtctctcaagccagtgagcttggggtggtctgacctgctgtgggcatttcctgctggtggcctcaggatcagtcaggtctgtgggatggccaggcagcctcttgtgaatgtgggttcttgttccttcacagcctcctcccctgaggcttcctccctctgcagcatcttcaaacctcacgtcgttttaataatatcatttggttagtgcttcagttcaaaaaatgccccatatatatgatccatacatgatctcattggatcctttggccatccagggtcacagttctgaaatccccatttcagaggtgaggaattaaagcttggagaagtgacgtgaccaaggttccatcctatgaagtggcagagctgagctggaacccatggacctcatgctgtttcagttcttagctgggcaaagtgggaccatgaacagattctgctccctgggaaaatggtcccctgggccttacagtgcaggagccattgcttgctatcattaggaaagagatttgggggttatgcaggaggtagggtggaaaaagcaccaaactctataccagagaccaagagactggcctagccattctacagctcattgagtggccttgtgtaagttgcttctctcttttctcaggcctcagtttacctttctgtaaaatagagggttggcctgggtgatctctgaggctctacctatctgataattctatggcctatattaatctgagcagcaaaccaaccgacccctgccccgaggcctcatcacagttaatatccaattccccataaccctgagagatgtcaggacctcagcatccttcctgagctgtttcctcacccccgggaccttccaggctctaatggggctaactacagaggcccctccctgtccagtcatagacctattaagttgcattgctgaggatgccacaactcaatgttccaggcatttccaggcccctggagccttcaacactaggggtggaaggaaggacacaggaagccatgagcttgctgggaagagcaaaatattgccatttcttattccttctcaggaatgtgggctggggagcaggggggcccagcctacagccactgggagagtgacagatgagctgtatgccattgtctgttttgggaatgtgctgctgcagcaggggctctggccttacatatttaatatttaattcacttctttgagcccaggaagagttatgctgagctgtttcctcaaggaaaggatcaggggcctggaacctttagggacatcctgagagaagcaagatattagaggcagggccgttagattgaagccctccctaggagggagggaatccagtgtttgcttacctggtcaatctgccattgattttgctaagaagaccccccacctccctgaaagctggaaggcaacaaaggctaagaagggaggaaaatgcaataacacacttcggctgcctgagggatggggtgaaggtttccgttgttgggaactgaccagtttccctcagtgagatccttggatctaaggcagtatggggcacagatgatagaacggccaagagatcagggcggccagcaccagaattcttgcaccagaggcatagcccacaaaatatcacagtcttagagttggcaggagctttggaaaactgagacctggacttgcccagggccacacaggtgagttgaggagagcctagcccctttatatatggaagagcccagcctctttccactgcttgagtcctaatgttacctgtgctacttgataatcagagtaattcatttttatataaggcgttgacatcttaatctcattcgatcctcccaacaaccccaaggggtgggtactattatttccattcaacagttatgaaaactaaggctggggaggtggagtgagtgtcttatcagctcgtgaccctgggtgataggcagcagagccaggactggaacccaggtcttctgatgcccccagccctgtgctctttccaaggcatctcagattcctccatgtttgctcactgtgtgactcagggaaaccgcctttccctctccagccctcaggcttccattcacctaatgaggaggagaagcctgaccttgctccctggggagtgggtgaaacagtcactatgtaccaggtgttcagatggaagcaaagggggaggagtgcctgggaaattccacaacaggaatgattccataccctgtgacttctcatcacactcagcctaggacaatcagcagccagcaacccaaaatggaacctagacagaggacccaagttccccatagccccaaggcaccgcctggttcagtgtcggatgtttctaggctggtggaaacaatttgagggctcttgaggaatctacagggtaaagaggggaggagcatgttagagataccaaccccagtcctgcctatttcccagggttgaggattaaatgagatcattagcacgagggcatttaaaataagttgaaagcaccaaatacatggaaggcattagcagctatggggtggcttctgtccaccaagctggggtccagtgatctccaggacagacatctttgttgttagcttgacttcttctttaccctgccatcccagctgccttgccataaccctgcagcttgctgggagtagagccaggcaggagaggtctaggagatttcagaaggcaggctccccatctgcagctcactcctgtcccccctttctgagttatggcatcaactccgcttcttccctgaccagctcccattcccttcttccagttcatgccaccctctgggggcagctaagtggtagttgatgcgacccagtgccctcattcactctctctgactcatctcatagtctgtctcgccagctctccctgcctgccacctcccaggctccctgttctctttgttctcccctcactgtgcacaaacaccatgcctgtctccttggaatctcatttcatccctcctttcatgtttactgtgggcctcaggggatgttcgggtgtgcaaatgtgtgagagtttgtgattgtgatcagtgtcctgtttatcagtaatcattagcaatttatacttatgtagtgtctgggggagggagggtgtgggcgggaaatgctggtgggagcttgataacatactaggcctgtgaggtaggaggaataggtaacatcacagacccacaatgcacagtgaaaacttcaaatatttggtactgcgcagtgaaaacccaaatatttgtgcgcagtatacatactgcagtgaggacaggtgaacacacgtagattggttgggagaaggcctactttattcaaatgtaatcatgcaagacaatttttaaatgactgctttaattttgaaattaactttttttttgagatggagtttcgttcttgttgctgaggctggagtgcaatggcacgatctcagctcattgcaaccctgcctcccgggttcaagggattctcctgcctcatcctccctagtagctgggattacaggtgcccaccaccatgcccagctaattttttgtatttttagtagagacggggtttcatgaggttggcaaggctggtctcgatctcctgaccttgtgatttgcccacctcagccttccaaagtgctgggattacaggcatgagccactgcatctggcttagttaattttttcaaggagttggactagatgattcctaaaactttgattttagctacttaaaggaaaaaaagagtgtttgtgtacagatgatacagaatgcaggcacgaattgaagacagaaacaacagcatcggatgtgatccccaataagaaggtctggagggagaagagctggggttcttggctggagcccactctctctgtggtgaatgtagaaaagagaacctgcagaagcagccccggaagccagagggatgcggtcataaggaggaatgcgaactgtgttgaaattgtattgtcccttttgtgggtcctgctttctcccacccctcagcagggggattaaccataaatgcaagagagaatgtttcaagcctgagcgacaacagtaacagtaataataatgacatttactgagcacttgctttgtgccaagtgctatcctatatacagattatctcgtttattccacatgagcaccctccaagaaaggtgctgttattgttcttgttttttttttgaggcggagtctcactctgtcgcccaggctggagtgcagtggcgtgatctcggctcactgcaagctccaccttctgagttcacgccattctactgcctcagcctcccgagtagctgggactacaggcgcccaccaccacgcccggcttactttttgtatttttagtagagatggggtttcaccacgttagccaagatggtctggatctcctgacctcatgatccacccgcctcagcctcccaaagtgctgggattacaggcctgagccactgcacctggccttattgttcttgttttatagatgagaaaacagagctccattgaggtgaaataactctcccaaggccacatggttggtatagtaaaactatgtaaacccagctggatttgacacaaaatctgatgctcttttaggcttaaaaaattaggaatatcaggttgggaactggttcctgaggaggtgctgaaaaattataggagtaggctgggcaaattataggagtaggagtggctcacacctgtaatcccagcaatttgggaagccaaggtgggtggattccttgagcccaggagttccagaccagcctggacaacatggagaaaccctgtcttgacaaaaaatacaaaaaattagccaggcatggtggtgtgtacctgtagtcccagctacgcaggagactgaggtgggaggatcgcttgagcccaggaggttgaggctgcagtgagccttgattgcaccattgcactccagcctgtgtgacagagaggaaccctgtcttaaaaaggaaagaaaagaaaactgataggagctgctgtagatgtgtcacatttgaggtgacagagtccagtgggcagctggagttgggccagtggagtttagaaagaagcccgagactggaaatggagattgggtctcattttttttttttttgagatggagtttcacttttgttgcccaggctggagtggaatggtgtgatcttggctcaccgcaacctctgcctcccaggttcaagcgattctccttcctcagcctcccgagtagctgggattacaggcatgcaccaccacacccagctaattttatatttttagtacagatggggtttctccatgttggtcaggctggtctcaaactcctgacctcaggtgatccacctgcctcagcctctcaaagtgctgggattataggcatgagtcaccatgcccagccctgcccctctatttttgacactctatccctctgtgtaaatgactcccagatcgaggtctcctctctggtctctctgctggccttattatatgaagtgctatgttcagggcatgggcatcagagtcagccaggtctggatttagtgacttaccagttctgaggcctctgagtaccagtttccttagctataaaatgggatagtaatagtatctttgttacagtgctattgaaataattaaacaagggccaggcgcagtggctcatgcctgtaatcccagcactttgggagacagaagcaggaggatcacttgagcccaggaattcaagaccagtctgggcaatatagcaagaccttgtctctaggaaaaaaagaaaaaggccgggcgcggtggctcatgcctgtaatcccagcactttgggaggccgaggtgggtggatcacgaggtcaggagactgagaccagcctggacaacatggtgaaaccccgtctctactaaaaatacaaaaattaggtgggcttggtggcgcgcgtctgtagtcccagctgctcaggaggctgacgcaggagaatcacttgaacccgggaggcagaggttgcagtgagccgagatcacaccactgcactccagcctggtgacagagtgagactccgtctcaaaaaagaaaaaaagagaattaaacaagagaatgaacataaagcactttgcacagtttctggcacacaagtgttaagtaaataattattattgctatgtcaaaccacctaatagatgttttcacttggccaccttcctgatatattaaacacatcacattttagtttggcattcaaggcgcttcagagtctgactgcaatgcatctcttctatcttgcctgcccaagccggttactccaataggaaaaccctgcaccagctgttctaccccttcctttgaaatcaacatgggcctccctatcctactgctgattgcactgtttttgtgtcctggattgttgctggtaaccagggagtacgaattatggaagcaggttaagcttaatttaaagatctctttaacagttaaaattgggctgtttcaagaagaaataggtggccttgatggtggtgatgatttcacggttgtatacctgtccccaaattcattgagttgtatacattaaatatgtacagctttttttttttttttttgagacagagtctcactctgttgcccaggctggagtacagtgggacgatcttagctcactgcaacctccgcttcccgggttcaagcaattctcctgcctcagcctcttaagtagctgggattacaggtgcacgccaccacacctggctaagttttgtatttttagtagagatggggtttcaccatgttgtccgggctggtcttgagctcctgacctcaggtgatgcacccacctcagcctcccaaagtgctgggattacaggcatgagccaccgtgcctgacctaaatatgtacagctttttacacatcaatcatgccccagtaaagtcatgggctcccatccctggaagtgttcaaggagagaccgaatgtcagtggtgcactaagggcttgatatatcagaaaagccgttgaaccagatgatcttcagaatccctttctcttaaaggcccttaattgtttaaaatgttattttttaaacagtaaaagagaaaatatttagctttctgaaaattaagaccagaagatttaaattttaatgtagtatgaattcaaacaataatataatagaggatgtttttcagctctctgtcataaccagttagagaagagtcaaagacaatgggaagaagagaagagagaaagagagagataataggagaaaagcaagagagaaatagagggggacaataaagaggggaaagagaaagaggtggggaggtagagtgggtaaagctgtggacgacagggtttttgggaagaagaaacctcgattgggagaggaagtgctgtagtggagagagtgaaatactgtgtatcattccactgtcctgatcttaatgttagtcttcaaatagggctatctccagtctccagagacttccacaaagctgatctggttccatccacatgtccccaaggacaccagccccatgctagacactctgagatttgtggggctgtgtgatcagctgagtcctgtatgatcagacccttgaaagaagccttgagataacaagtgacccatactccaggctgggtttggatccaggtcacagtccatgacctcttggtgttggtgagagcagtgtcttgtattccttctcatccctggtgggtgtggtcagttaacagaatcgttgcgtcctgggggcattttgtaacacaaagatttgactagtgggaagtatatgacactaatggatttccatatgagattctgggcttcaagtgacattgaggctcagcaggccttttggtccagtgttaggtttctcgtgctatgtgttggctggaggagggtattatcatactgccctgagtcatttccagcctccgcagagcacaagattggatgaagtggctttgacaatattctcattgtgctctgaagactaggaagaaaggcctggaattcagatagagaggggcacttttctctgccagcccactgcgcctggccagtctggggcacctcttctggagctgctgaaccaggtggcatgtttgaatgaataaggaaatgcttccccaggtgcagtggctcatgcctgaaatcccagtatattgggagggtgaggtaggaggatcacttgaggccaggagtttgagaccagactggacaacaaagccagaccccatctctacaaaaaagtaaaaaaaaaaaaaaaaaaaaaaaaaaaagctaggcatggtactgcatgcctgtagtcctagctgctcaggaggctgacatggaaggatggcttgagcctaggagttcgaggtttcagtgagccttgatcttgccaccgcactccagcctggacaacagagcgagaccccaactcacaaaaaaagaaaatgaaacaaaatggtctctctttccacagatccagctctgcagctatagaggctgtacaaggcacaccctcatgctcagaccttataggacacccacacttgtggtttggtatatctagaatttttaatatcctgagaagttcctgggcattaactccacctcatactaaaaaattactttctagttgtctcactttcttcccagatatactcaacagaagagtcccaggccctgggctgagctatttcttttttctttttcttttttttttttgagatgtagtctgtctctgtcaccaggctggagtacagtggcgtgatctcagctaactgcaagctctgcctcccgggttcaagcgattcccctgcctcagcctcctgagtagctgggactacaggtgcgcgccaccacgtcctgctattttttttttttttttttttgagacagagtcttgctctgtcacccaagctggagtgcagtggcgtgatctcagctcactgcaagctccgcttcccagcttcacaccattctcctgcctcagactcccgagtagctgggactacaggcacccgccaccacgccaggccaattttttgtatttttagtaaagacggggtttcaccatgttagccaggatggtctccatctcctgaccttgtgatccgcccgcctcggcctcccaaagtgctgggattacaggcatgagccactgtgcccggcccttttttttttttttttttttttttccttcatagagacagggtttcaccatgttggccagggtggtctcgatctcctgacctcatgatccacccgcctcggactcccaaagagctgggattacaggcatgagccaccatgccctgccgggctgagctatttctatagcactagctaatgtacatgcagggtttctcctttcttcaggtgggccagcagaaaaataacaacagtggtggtaataatgatagctaccatttcttccatgcgtgcttaatgccaaccactctgaggtgttctttttttttttttttttttttttttgagacaaagtttcactcttgtttcccaggctggagtgtgatggcgtgacctcggctcactgcaacctccacctcccgggttcaaccaattcttctgtctcagcctccagagtagctgggattatagtggccaccaccacacctggctaatttttgtatttttagtagagacagggttttgccacgttgaccagactggcgccgaactcctgatctcagctgatccgcctgcctcggcctcccaaagtgctgggattataggcgtgagccaccgcgcccggcctgatgtgttctgatgtgttctttatgtgtatcattttgcttcatcctcacggtagcgtgaatcttcatctgactagtgaggatactgaggcacattaaggaatgaacattccaagttcgcacacctagaaagtggtagggccagagttacgagcccatgtctgcctgactccataacccatgatcttcacctccacactgtaatgccagctcagacaggaaggatttatgccagatccctgactaataagccccagtgggaactcttgtctcctgagatatttaactcatctttgtccttctgtatgatgcaaacccccagcttctaacctcagcccagcaccattcgttcgtataatcaacaaatctttggccgggtgcagtggctcacgcctgtaatcccagcacttcgggaggccgaggtgggcagatcacttgaggccaggcattcacgactatcttggccaacatagcgaaaccctgtctctaccaaaaatacaaaaattagctgggcatggtggcgtgtgcctgtagtcccagctactccagaggctgaggtgggaggatcacttgaatccaggaggcagaggttgcagtgagccaagatcacgccactctcttgcctgggcaatagagtgagactctgtcttaaaaaaaaaaaacaaaaacccaacaaatctttttaagtaaccatggccaaggacataaatcagtaggtatagttaacttcatctttaaattctttaaatttctggaaggaatcataagaactcgcaataatggttattgctagggattttaatatggaggggaatttttatttttcactttatacctttttattttatttttcacaataagcatgtaatactttaaaaagtcatctgggacttttttttattttttcaaaagttttgggggaacaggtggtgtttggttacatggataagttctttagtggtgatttctgagattttggtgcacccatcacccacttttaaaaaattaaacaaaaattaatctgaattttttaaaggaaaaagccctttgtcagggttctatggtttaaaaaagacgggggggacatataaaagatatatgttaatgcctagttggaagatttgcttaaaggtaatgaataattgaggaaaatccagggttgataataatgctcaattatactcagttattggtaatcctgtgaccttggacaagtcactttccctcccaggagctgtaaggaatgaccaatagatgattcctgaccggacgcggtggctcacgcctgtaatcccagcactttgggaggccaaagcaggcagatcacctgaggtcaggagttcgagaccagcctgaccaacgtggcgaaaccctgtctctactaaaaatgcaaaaattagctgggtgtggtggcacacgcctgtaattctagctactcaggaggctgaggcaggagaatcacttgaacccggaaggcggatgttgcggtgagccgagatcacgccactgcactccagcctgggtgacagagcaagactctgtctcaaaaaagaaaaaaaaaaaaaagatgattccttgctttctgtaccatttgctgattcaccttggaagcaggccagggttagaaaccagcctgagtgaaggacagtgaaggacagagaggaatgacccagccttgactgggagcctagaggctgtgtgacccaggaccacgaacctaacccctctgggccccgcacctgatctgtaaactgctcagactacactatatatatccttaggttcatccagttctgacactggaacattctgttgtctggatttgctgaagagaaaccctctagaaagtcacaaataagcaagggaaatagggcggaaaggtgaagataagcattgatctgaggggctcatggttttttcactaaagtagaagggctgattagtttccttcctgctttttttcaaggtgagctgaggcacttctgggcatccttgccttgttcagtttaaggctggtactggagtccagctcgcctcatcccttggccaatagtttcctgatctcaaattgttctttcttcttgataaggaaattcctagcacttgaaccattcgtcatttttgttgtgttttgagccatccaaggcggagactcagactcagtctcctgatttttgtctcccagggaaggatatcattgaaaatagcattattcatctgaaaatggtactcttcatcccctccccattgtctctttcatttcttcttcccttactgctgactcctcaagatgtacaatcagggcgctggaaaaggagaaataggtctgtgagggaaggggtggctatattttctaagagatggaagcggggtctgttgagattgttgttttggttttgctttttgtggcaagtggtgggtaaaataccaatgagataccgaaacagcgagtaacgactaccatttgggtgtaatttatcacttaccaacactttcacatctattctcaaactcgctggttgttttgttttgtttctgttttttgttttgttttgttttttgagacagggtctcactctgtcacctaggcaggaatgcagtagtgcaatctcagctcactacagcctccacctcccgggctcaaggaatcctttcatctcagcttcccaagtagatgagattacagagatggaactacaggcacacaatactacgcctggctaatttttaaaataaatgttttgtagagatggggtctcactatgttgcccaggctggtcttgaactcctggggtcaagtgatctgcctgcttcagcctcccaaagtgctgggattacaggcgtgagcctctgcacccagcccaacttgctgttcttacccaaggcctgaaaggtagcaggtattctccccattttacagatgagaaagtggaagtccaaagggctgaagagctaggttttgtagcaaagagagtggcagagtgtgtagcccgactggagcaccctgactcccacacccagccacctttatatcattccaccacagaacttgtgcaggggcccttcccacaaatattttcccagagtttttagcctctctctgggactctagggatcctgacaacctccctgccagcacacagttaagagctctaacccacttatctcagagacccccataagactctcacacaggcagaagcagcagcagcagagccctgcctatttcagccaaaagagaaagcaaggaggctctgagctttcctgatggttcctgagttggcaaaggtacaaataccaaatgctgcttctctccaaggtgctttcctgtctgaacctggaagaaagccatggaacagagaaaaggacattgggcttggagttagggcggtggtggtcaaatatcactctgccatttactggctccaaaccttgagcaaatcacttcgcctgtctgggccttagttttcttttatgtcaaatggggatcataaccattatctcataaggttcttgtgagcatcagataggacgattaaggtaaaaaggagttaacccagttgaggcacatggccagttgcatctgagactcctgtctcctgcggaatgtcacagataggtggcagtggcagggcagagcctgtttggcttctctgtccttgtaaaatcatacttgatgctatctttccagaagagtggctggctgggcctggctgtctccattctagctttccacgtcagtgctttatgagtactggggcctcctttctccccgctctggttttgcactccatttgctcctggaatagttaaaggtgagtctctgagtatccccggctgtgtctacaagctggcattgtccctgtagtgacctggctgttgtcacagcagctgacctgcctctgatacctggaatcagagccttagtcaaattgggaagttatttggaaagcacatagtcaatataagagcagctagacaggtggggcgtggtggctcacgcctgtaatcccagcactttggaaggtcaaggtgggtggatcacttaaggtcaggagttcgagaccagcctggccaacatggtgaaaccccatctctactaaaaatgcaaaagctagctgggcgtggtggcaggcacctgtagttccagttacttaggaggctgaggcaggagaattgcttgaatccaggaggcagaggttgcagtgagccgagattgtgcctctgcactccagcctgggtgacaaaatgagactgtcttaaaaaaaaaaaaagagcatctagacagattccttaattaggagactcaggcttcaaggactccacttctaggcctttgtttcccatctataaagcatgggggttggggttgatgattcccaaagtccccttggttaccctgcccttcatatccatctctcaagtgagagactatggtgccctggagctcccagccctgtcttttccacccccacagcctgtgctggccttttagttacactggacttgtttagaatcagcagaaccaaacccaatcctgtccccaggcccacccacctatagtcttttgctctgaaatattacaaaagaagcattgactggaatggctgagagcttcagggaagttctcttgaagactaggaactccacattctcatgtcctctgcttggtatattctagactgaattaggctcagggatttcaggcatccctgtccctccctatcctcataggtgatggttaaggatagagatctctaaaaaaattagtcgggtgtggtggctcatgcggctatttgggaggcttaggtgggaggatctcttgagtctggaacatccaggctgcagtgaaccactgcactccagcctggacaacagagcgagatcccgtgtctcaaaagaaaagaaaaggctcaagatctctgagagaaaggaggagatggccactggtatcctcagacaaatgtggaaataaaaaagtaaaggaaaaaaatctatttctaagccaagaaaggaatctcatgcatgacatatttccgagcatgggagtgaagcagacagcttggggtgagactggggagaaggagggagcagagaccctgcacctggactgaggcccacccacagatttcatgccagagccaaccccatcttcccagcacaagactggtctgtcagccaggcttggctgagagtgtgggtttgagcaagtgggcaagacttggccagtgactgataaggcaaattcagttgacattcagaccacgtctgtgctgggtcccggcagggctggcagagaaacacaggggcattggacagacgggtggagtgatagtggccagttagtcatcgtccaggattctctttatggagcccagggcccagcccgcaggagagattgtgaagcagagttctaggtccacagaggagatccaacgcggaagcagatgagcagaaaccagcccaggagctggtcttgagactcctgtaatggggaagagggaggaaggagggctgggacttggggactcagcagtcatgcttggctaatgcatcagaccccaggcctgactggcagctcaaattatgcctgatagtgtccaggtggcttcaagaactgggtgagttggtagcctttgagtgagaaggacttgggcctaggtgtggatagctggggaaggtggaggctgaataaacaaaaaatttcattttgaatctgaggtccatctcttcacttgaaaatcaccaaaaaaattagccggcatgctggcacatgcctgtagttccagctactcagaaggctgaggtgggaagatcttttgagcccaggagctggaggctgcagtgagctctgatcatgccactacattccagcctgggcaacagagcaagaccccgtctctaatggaaaaagaaaaatcaccaaaaagtttttaaaaacacaatatagagtatgttgggaaaggaaagcctcaggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgcatatatgtgtgtgtatgtgtgtatatatatttatatatttatatattatatattatatattatatatattatatattatatattatatattatatatattatatattatatattatatatattatatattatatattatatattatatgtattatatattatatatattatatattatatatattttatatattatatatattatatattatattatatattatatattttatatattttatatattatatatattatatattatataatatatattatatatataacatatattttatatatatattatattatatatatattaggtaaagtggaaatagcaagacataagcttgtgtttatactatgtccatagaggtgaaaaaagggccaggcacagtggctcatgcctgtaatcccagcactttgggaggctgaggtgggtggatcaccataggtcgggagttcaagaccagcctgaccaacatggagaaaccctgtctctacaaaactacaaaattagccgggtgtggtggtgcgcgcctgtaatcccagctacttggaaggctgagacaggagactcatttgaacccaggaggtggaggttgcgtgagccgagatcgtgccattgcactccagcctgggcaacaagagcgaaactccgtctcaaaaaaacaaaaacaaacaaaaaaaaaccagggaaaatgaaagaaaccaagtagccatggtagggaatatgtggcatttgtcattttatttctttggtgattttgatgtttgtgcaattctttttttctgaaaggagagaaagacaataaagggttaaaaacgtgtccccagaattctttaatagactggtatttcctccagggttaactcttgaagtaacaaatttcgtaaatgtattaccttctataaacagtaaaactccttttcgtttgtcctaaaaactgctgctgtcaaacctcaagacgtgagctcttactctatgtgccaggatggattggaaaagcctggatctttccttttcatccccagttttgattgtttcatttccagacttatcctcttaacttttctttgtcttttcagaacagagtcttttttttttttttttttgagatggagtctcattctgttacccaggcaggagtgcagtggcacgatttcagctcactgcaacctccgcctcgggttcaagcgattctcctgcctcggcctcccaaagtgctgggattacaggcttgagccactgcgcccggcctaagcctcccttctcttgatcttctctctgctttatgtctctggagatgcagtaagagaactacacacagtactcccaattcagccacatcatggttttatatgagggtacaatgttttgtttctaaaaagccttcatgatggtgcctgggcagatgctactgacttttttagctgtggcagcatattcagccagtgtcttctgggaacagtggagtgttactcctcctcctcctcccctttttagggcttataattgattgcccatggctatcatttaattagtagagttaggattccttttccccaaaatgtaaaattgtaattgatgctcatctgccattttttgtcagctcacataggctagaaattctgttgtactttaccacctaggaggatttgggggtgtctgtgaagttgggtatttcacccatgcactccttcttgcacagcttcagagattagtcctgttgtttcacacttgagtgctttccatccagagaaatacctgtttatttctgtttcctttccctagttcacttcccctttctccatctcttcactccccatgtaactttgaataacctctgatgtgcagccttgccaggagtgctttaacctccagagttctggtcattggcttccccatgtgctgtaataacctattccgtcccattctgaaagaactctcagagattagtcagacaccatttcctcttgccggaaacatgttgatttcctttagcaggttctgcttcctaaaggagtcaccacagcccctgcaataggaagagcttgggctttggagccaggcaggcctaggccaggtctccatttaagttttttgtttttaattctctttctttttttgagacagggtctcactgttgcccaagctaaagtgcattggcgcaatctcagctcactgcagcctcaatctcccaggctcaagtgatccgcctgccacagccttgcgagtagctgggaccacaggcccacaccaccatgcctgacccatttttatattttttatagagacgggttttgccatgttacttgggctggtcttgaactcctggactcaagggatctgcccacttcagcctcccaaagtgctgcaattacaggcataagccatcctgctcagctggatctccatttaaatttaatgagaggcatataactatcatttttccagtgaaagctcacagatggttatctgccaagcagtgtgctaagtccagggaccctgagatacgagtaagatatgattgctgtcctaagggagcttacaggcgagagagcatgtaaacgaataatgattctatcatgagaaatagtaggaatatggcctggttactgagggggccatcatgtgaccttggatgggttatataacctctgtgagctttcactggaaaaatgatagtgctaataatatgcatgccccttacaccagtccttttcagacatttatgtgcatccaaattacctgggaatctcagtacaatatggatctcaattcactaggtctgaatttcttatttgatttgcttatttatttttgagatagggcgttgctatgttgcccaagctgatcttgaacccctgggctcaagcgatcctcctgcctcagcctcccaaacaatggggaccacaggcataagccaccacacctggctctggagtgttacaaaatctccccaggtgtttctaacatgcagtgatatttgagagcaagtgtcttttgattataaagaataaagaatgctagagccacataaaatgctggggaaaatgaagggtctcagggttgaaatggacaagcgtgtcccagattcagaggccaggccagacagcaggctcctgaagacctgtgacccagtagttaggggatcaggtatccatggtccacaacagtaggggcctcctccatgtggttcttctcttttctctcacacccaccccacccctcctgccaggttccccagatgatcgggccccatgacagtgagtgtggattgatgaatgggaggagaaactgggataaagagagcccaaggtggccgggtgcagtggctcacacctgtaatcccagcactttgggaggctgaggcaggcggatcacttgaggtcaggagttcgagaccagcctggccaacacggcaaaaccccatctctactaaaaatagaaaaattagctgggtgtggtggcatgtgcctgtagtctcagctacgtgggaggctgaggcaggagaatcgcttgaacgtggcaggtgaaggttgcagtgagccaagatcgcgccactgcagaaaaaaaagagagcccaaggaagggacctggaacccactctgggacaacccccaaggattctgtttggttcatcaaatacgtattgagcacttgttatctgccaagcactgagctaagtccagggacccagagatatgagtaagatatgactgctgccatgagggagctcacaggggggacagcatgtaaatgaataattattctattatgagaaatagtaggaatatggcctggttactgagggggcccgaaagagcaatttcaaggggatcagggaaaatttcccaatggtcaaggtgtgtcttgcagaaaaagtggcagttttccagttagatgtggagtgggaggaggaacccaggtgcttgtgaaatgccatggcccattgagggagctggaattcttttttttcttttttgagatggagttttgctcttgttgcccaggctggagtacaatggcgtgatctcggctcaccacaacctccgcctcccgtgttcaagcgattctcctgcctcagcctcctgagtagctgggattacaggcatgtgccattatgcccagctaattttgtatttttagtagagatggggtttctccatgttggtcagactggtctcaaactcccaacctcaggtgatccgcctgccttggcctcccaaagtgccgggattacaggcgctagccaccgcaccgggcccccagggagctggaattctcttggtgaggctggagtacagagcatacgcagagcatgaatagtaagaggaaccgggaggccaggccagctcccggggcctgtcactgcagctgaccttggatttcatcctgtaaggaatggaggtccattcagtagtttgaagccaaggagcaagcattcagagttgtgctgttttttgttttttgttttttgtgatgaagtctcactctggcacccaggctggagtgcagtggcgtgatctcggctcactgcagcctctgcctccctagttcaaccgattctcctgcctcagcctcctgagtatctaggactacaggtgcacgccaccacacccagctaatttttgtctttttagtagagctggggtttctccattttggccaggctggtatcgaactcctgacctcagatgatccgcccacctcaacttcccaaagtgctgggattacgggcatgagccaccgtccccagcccagggttgtgtttttagtggatctgcctgggtgtcatgtggcagaggggtggaaggggacactgaggcagtggggagaccacagcagtggtccaggagagttgtgggggctgcaatgaagccagcaggtagcagtgagaatgaaaaatggggggtggtgggagccgcactgaggagcagatttgatggccttgactcactggccagatgcaacggatgagaggcagggcagggatgaggcgaggcaggtgagtcgctgaggatgcagtgtaagggattcttccctctcatggtcctgcaaatgctgacctggagtgtgaaggaggagcctaggatgggtttaggtctgtggcaaggcaatgcggtaagaggggagatcattaaccaggagcgcaggcggctgcagtgtggcagcatggacagcctccagggctcaaggcctcttcctcctgccttggcctctgaggctgtgtggggctggaatgaagctcgtgcctctctggcgggcccaacttgctcagcgtctttgggtgacaaagcctcacacagcccattccttgacctcccaaaagccactgttaacccctgtctggctgtgttcccaatgatgtggctcttacaggtggtctcctgctccccaagtctgacagcaccccctgctttgagatccctcaggtaggtcagctgtttccactgggaaaaattccagtggagaagcagccagctttttccactggttcaaggtgatttcaaccttccaggaggcccgtgatgaagccagaggacaactgggtaccctgggacagcaccttcttcttattttattttcattttctaaaatttcaaatcgggcacccccccaaaccagaataggttttgaaaggctgccgacagcaccctcttgaaaatacattttatgtagtcacagtttacacaaatctgacattatttcagcttcagattccaaagcactgactaggggctttcacagagtgagactgggggtacgaggttcaaatctctcctctttgctactcaatagctgcatggccttaggctggtcattctcaatgtcttcatttattaaatgcggaggagaatagtccctcttagggggggatggaaaccatggtgttaaaggcttagctcagcatctaatagatacttagcgctccacaaatgtttgccagccatcctggaacataggcggtgttccaatattgtagatgacagacctgaagggattaatttgcccaaagcctcgaggtaagtgggtagaaccaagtcttcccggccctctccaaagctcctgctgtgctgggcccgtgctgttccttcttgctgtgcagtctgctccctttggcttttcttctgctttccacatcagctgaagatttagaccctttcctgctgcctgtgttgagagctgtcttcctgagttggaagccagttagctaaaggctgggctacctggtgactgtatcttatctttcccaatcctcaacaccagctgggtcctggttgccaggattaggttgccacccccatcctcctcctagccctggtggaccaacctttcctgtgtacccaaagcaaacagaccagttgccctagattccccgaggggcaccctctgtgcctccctagtgttcctgctgacaataagagccttgtgctgggacctgagacactagaggggaaaactccattctccctgaaagccacaaggccccatctgggacacatctggtgtccactcccagaaggaccacagagcagggaagcaaaatctctccagctagcaatgttgtggaccctttgcaaagcccacctcccaacccctctgtgtccccaggccatggagagcaagctcctcatcgggggcaggaacatcatggatcacaccaacgaacagcagaagatgttggaactgaagaggcaggagattgccgagcaggtagggcctccaggtgccaggtccccttggagagtgtggcctgcagctcatgtctgggaggtgcagggccgtaaaccatggtggactctggatctctggaattacagtgctgagaatctcagacatgccaccctgggtcccacaggtctactagcccagggtcttccctttggcaggggcactgctagctggtgggcgagaggacgtgatagctctccataacatcagcctccacaagccacctggtactaattcctgggccttccacaaggtggtgtgagttctttgccaactgtatgactgtttccctaaatcatcaagagccacagtttgttggtcttaccaatcaaccattatactacttggggagagggtgaggcagcttggaaggcagtgtgatgtgcctccatctgtgtgactaacgcctctggagtaggccagctcttaggggctggggtctccatccacatggggcagagcctggcaaaggcatggccctgggaactgagaggagggttcccaggggctctgcaggattgggtgggagcagtggatgtgggccatgggccatggtgaagccaggtcccgagacaggcagagtgagccagtcccctgagctttcctggccctcccgagtatgcactgctcctttgagccacactgcccgtccttggcctagaaacgtcgtgagcgggagatgcagcaggagatgatgctccgggacgaggagactatggagctccggggcacctacacatccctgcagcaggaggtggaggtcaaaaccaagaaactcaagaaggtgagacgctgcagcaggaccggttaaggtgtgctggaggcccagcagtctctgcccaagggatgtgtgcttcagggactcctccccatttggctggaactgctgaacccctgagtgacatggcttggcctcgggggtgagcaacagggggaggcaggaggcgggggctgggggtggagtagagccttttctcctgggccagggtgggctatgacaggctgcaaactctgtcacttgcagtatccagcgttaccatcttcatggtcctgggtgattaccccgttcagtgtcaccagtgagtcacagttgggatagctgggcctggagcagggccaggggaatacagagaggctgaggaggagactggaaccccgggaagctcaggtggggagtgtaaggccctcaaggacatgtcaagggatgagaatagccgctcaccagaaccctgcaaagcccgtggcaagggaaagacatgtacatgtgaggggggtctagggcaggaagcagcaaagctctagcttggattctgggaaaaacctggaggcccttcggggtgggtgatgtggctgcccaggggcaggcctggcagaggcactgccactgtggcagttaccacggacccagccctcagtggctttggagaggagcaggatggccatgctacctccacaccccacttttgagagcccctgaagagactggagtgggaggggtcaccttccaaactcgttcaggcttcctgcttcctgagctgggtctccaaataagccccgggtcctagttccggctcttctattggctggttgtgtgaccttgagcaagtctgtgcctggcttcctcatctatgaaaggagggtattggaccaaaaggtccctggggtcccctcccgtttgaacattccacgatgctgatagcagctgagaaagagcagacaatggtcacaggcctcagtgaaggagggcggggcaccactttaaatagcccagcccaattcgtggtgggttgggcacagcggggagttcagaaaaggacccgcagcctcatcctgggctgagtcggtagactctgagcctgcagccctgcggcccaggctgggtgactggggcctcgttgccacaccaagcagcctctgagtggcacctgtccccacccagctctacgccaagctgcaggcggtgaaggcggagatccaggaccagcatgatgagtatatccgcgtgcggcaggacctggaggaggcgcagaacgagcagacccgcgaactcaagctcaagtagggcccgcagctcttttcatcccgggtccccacagccagccatcattactcaggcctctcctcccctaaggcctcatcctgactgtctcctctcccatgagtcctttaggaataaaatgcgtctgagggctgagggatgggcccacgtgctggagtttcttctacctcctctgcctgtatttgatgaacccctcaaaatggacgctaggtgctggccaaaagtaactccgaaggccctgaggctaccatctttgcataagaatcagtgattttaaattttttaaaaattatttttagggccgggcgcagtggctcatgcctgtaatcccagcactttgggagccgaggcaggtggatcacctgaggtcaggagtttgagaccagcctgatcaacatggtgaaaccccatctctactaaaaatacaaaaattagccgggcatggtggcgcgcacttgtaatcccagctactcaggaggctgaggcagaattgcttgaacctgggaggtggaggtggcagtgagccgagatcatgccactgcaatccagcctgggcgacagagcgagacaacgtctcaaaaaaaaaaaaaaaacaaaaacaaaaaaggccgggcgcagtggctcatgcctgtaatcccagcactttgggaggctgaggcaggtggatcacgaggtcaggagatcgagactatcctggctaacacggagaaactccgcctctactaaaaatataaaaaattagccgagagtggtggcgggcgcctgtagtcccagctacttgggaggctgaggcaggagaatggtgtgaacctgggaggcagagcttgcagtgagctgagatggagccactgcactccagcctgggcgacagagcaagactctgtctcaaaaaaaaaaattatttttaaatttgttttaaaaattattttaaaaaatgtgtgtatatagtagttgcatatattaatattgatgggatacattagattttttttttttggagatggaatattgctctatcatccaccctggagtgcagtggtgcagtcttggctcactgcagcctccacctcccaagttcaagcggtcctcctgcctcagcctcctgagtagctgggactacaggcgcccaccaccacacctgactaatgtttgcatttttagtagagatggagtttcgccatgttggccagggtggtctaaaactcctgacctcaggtgatccgtcctcctcggcctcccaaagggctgggattacaggcatgagccacctcgcctggccacatgagatgttttgatacaggtgtgcaatgtgaactaagcacatcatggagaatggggtatccatcccctcaaacatttatccttcaagttacaataatccagttacactctttaagttattttaaaatatacaatttgctggcttatacctgtaatcccagccttgtaggaggctgaggcaggtggatcacctgaggtcgggagtttgagaccagcctggccaacgtggtgaaaccccatctctactaaaaatacaaaaattagccaggcatggtggcatgtgcctgtaatcccagctactcaggaggctgaggcaggagaatcacttgaacccaggaggtggaggttgcagtgagctgagatcgtgccattgcactccagcctgagcaacaagtgcaaaactgtctcaaaaaaaaaaaaatatatatatatatacacacacacacacacacacacatatatatacaattaagttattgactatagtcaccctattgtgctatcaaataaaagtatttattcatttttctaattttgtgtacctgttagaagcagtgatttttcaagctgcagtatttctgtagggatcctttccccttaacttcttgattttccccacctccacattgcctctgcctctttttttaaaataaataaataattaattaacttatttttttttgagacggagtctcactctgtcgcccaggctggagtgcagtggtgtgatctaagcttactgcaagctctgcctcccaggttcatgccattctcctgcctcagcctcctgagtagcttgggactacaggcacccaccaccacgcccagctaatttttttttgtatttttagtagagacggaaatggtgtttcactgtgttagccaggatggtcttgatctcctgacctcgtgatccgcccgccttggtctcccaaagtgctgggattacaggcgtgagccaccgtgcccagccccctctgcctcttggcttgttgcttctaatccttcaaccctcacatgcaccacgtggtctctcgctcacccattttcccatcactccttcattcctgctcccaggtacctaatcatcgagaacttcatcccgccggaggagaagaacaagatcatgaaccggcttttcctggactgtgaggaggagcagtggaagttccagccactggtgccagccggcgtgtgagtctctaacccagctgtctgggctgggggacttgtgggtccactccaggtcggggctggtgaggggcctgaggccttgcctgcagggagacagatgttttgtggattggggaaaagatggggaggatgccgatgggggatgaatttctcaggatctaattgtaggggtctctatgatggaagggtgttctgggaaaaaaagtgtctcattggcctgggatgcagaaaataccttgtgagggatctcgggagggaggaagagcatctcagcctcttgacaatcctagcgaatgctaacatctggccaggtctggtgaatattcatttgtcagatgcccgaaatagcaaccacagttaatatttgccaagcgctactgtgtgccggatgctgtgcaagactcaggagacagaagataaattagacatggtccgagctcacagtccagtgggaaataagtaatcagatcatgatgtgatagagctgtgatccaatctcagtgcgctcgctcatccgggtgatttcagcatttccacctgtttccatgtcctagtccttgggtgcagctgcggccattggctgggtgtgtggctccctctgctggtggccatgaagaacatcccaacagagtgaggccttgcccggctgaaccatgggcccttaattgcaaatatatagagagaggtgcttaggaggctggacaccaatgcaccttcctggagattatttgctctctctagaatattaatgttaaaatagggcaagagtctccctaaatctgggatgggaagctagcaagaggtctacagcttctcactgaagcatcagatgcctacttggttattttttttttcctttcttccttttcttttcttcttcttttttttttttttaacaactatagcttagatgcctatttgatctttcttaaaggctgattttacttaaggtgataccacataagtttgtaagtggcaagcacgtgaatagaggacttttcaatggtattactttgcacctacaatccacctttccaatctaggtagagattctcaatagtacatcagctgtcatagaggttttccaccctggctggagctagaatacctgcagagagtctgatttaaagggtcccaggtcttaggttttgtgattctgcatttgaagccaggctagaaaaccactgctccaatgacatttgctggagttggatgctggcgaggcttcactctgaagggttatcttatgcttagaaaagttctttctagctgggcgtggtggctcaagtctgtaatctcagcactttgggaggctgaggcaggtggatggcctgaggtcaggaatttgagaccagcctgaccaacatagtgaaaccccatctctactaaaaatacaaaaaaaaattagctgggcgtggtggcaggcgcctgtaatcctagctactagggaggctgaggcaggagaatctcttgaactcgggaggtggaggttgcagtgagccaagatcactccattgcgctccagcctgggcaacaagagcaagactccgtctcaaaaaaaaaaaagaaaagaaaagaaaaggtctttctgctgggcatggtggctcatgcctgtaatcctgtaatcccagcattttgggaggccgaggcgggtggatcacttggcgtcaggagtttgagaccagcctggccaacgtggtgaaaccccgtctctactaaaaatacaaaaaattagccgggtgtggtggcatgcacctgcagtctcagctcctggggaagctgaggcaagagaatcacttgaacccaggaggcagaggttgcagtgaaacttgctctttcgcccaggctggagtgcagtggtgtgatcttggctcactgcaacctccgcttcctgggttcaaacgattctcgagcctcagcctccccagtagctgggattgcaggtgcatgctaccacgcctggctaattttttgtatttttagtagagacggggtttcaccatgttggccaggctggtcttgaactcctgagctcaagtgatccacctgcctcagcctcccaaaatgctggaattataggcatgagccactgcaccagtccttagaaaagttcttgagtttaaagtttgcaggtgaaggaatttctttacattggatgtagtagtgccaccaatgtgctcaactagttgtgggatgggagaggctttgagaaggtgtgcattaacttttgttgttgttgttgtttgagacagggtctcactctgtcaccctggctggagtgcagtggtgtaatcacagctcactgcaacctcagcctccccaggctcatgtggtcctcctcccagctaatttttttttctttttttttggtattttttgtagagacagggttttgccatgttacccaggctgatctcgagctcctgggctgaagcgatctgcctgccttgtcctctcaaagttctaggattacaggcgtgagccactgcgcctggccacgtcagctttttattttgaaaacaagaattgcaagaatagtataaagaattctcgtatacccttcaccagattattaacattttgccatatcttgctttaactttcccccaaccacttgagattaagttgcagacattttgaccttttacctgtacttccgaaaaatgagaacattcgtgttccacagtgcaatgatcaaactcaggaaattttgtattgtcacaatattattatataggcaatattaaaatttgccaatgtcctttatgatgatttccctccctccccacctgcagtcatgcatttcatttaattgtcatgactctttggtctcctttaatgtggaactgagaagggattttgacttgagtttagcagtttcttgcttcagaggaatttattcatttctcaaaacactctgcaattttgacttgactgcctcaagcacatgatccagactcaaagtgtggcaggtgctttacctgaagttcgaatgagctttctgcataatgattatgaatttccttccctccctccctccctcccttcattccttccctttcttctttctttcccttccttccttccttctttccttcctttctttctttctctctctctttctctctttctctttctctctttctctttctctctctctttctctctttctctttctctttctttctttctctttctccctttctttattttcttccttacttccttgcttgctttcttgctttcttttttcttgagtctcactctgtcacccaggctggagtatataactcactgcagcttcgggctcctgggctcaagtgatcctcctgcctcagccttctgagtagctggggccacaggcatgcaccaccacaccagctaaattttttatcttttgtagagacagggtctcactttgttgcctaggctggtcgtgaggtccggggcttaagcgatccccctcctactgcctcccagggttgggatcacaggcatgagccaccccacccagcctggacttcccctccttatttatgttatttatttatttgtattatttttgagacagagtctatctctgtctgcactcaggctagagtgcagtggtgtgatcacagctcactgcagccttgacctcctgggctcaagtgatcctcccactcagcctcccaagtagcttgaaccagcaggcagtcgccaccatggccagctcattttttcttaaatgttttttaaaagtttgctttcttccaccaggtgttcatgcctgtaatcccagctactctggtggctgaggcagaaagattgcttgagcccaggctattgtaagctaggatcatgccactgtactctagcctgggcgacagaatgagacttcatctctaaaatttttttttaatttactttcttccttttaagtaacccttacttcaattgcaaacaatgttttcattatggaaaatttaaataaacatagaaagaatgaaaattccacctagctagtagtagtgtttactaacaattggatttgaactttccaccatcttttctttttttatacataaacttttctccttttgagggttaaaatggtttgtatatgctgaaaaaaaccattcacagattttaaaaattaaaatagctaccttaaaacagcatactttaattaatttttacagtaatacctataataactttttttttttttgaggcagtctcgctctgtcacccaggctggagtgcagtggcgctatctcagctcactgcaagctccacctcccgggttcacgccattctcctgcctcagcctcccgagtagctgggactacaggtgcctgccaccacacccggctaattttttgtagttttagtaaagacagggtttcaccatgttagccaggatggtcttgatctcctgacctcgtgatctgcccgccccggcctcccaaagtgctgggattacaggcacaagccactgcgtcgggcccctgtagtaactttttaaaaagaaagaagcttgctagaatacagatctttctttattgtgtaaatgttgccaatttctagcccattgtcttttttaccctgatcttctgctttaaaggcaagtttgtgctctttattaaaggattctaatgctctctgctcttgttgcccaggctggagtgcaatggcacaatctcggctcatttcaacctccacctcccggattcaagcaattctcctgcctcagcctccccagtagctgggattacaggcgcccactaccacacttggttaaatttttttgtatttttagtagagacagggtttcaccatgttggccaggctggtcttgaactcctgatctcaggtgatccgcctacctcggcctcccgaagtgctgggatacaggcgtgagccactgcgcccagccttctttctttttttttttgagatggagtctcgctctgtccccaggctagagtgcagtggcgcgatctcggctcactgcaacctccacctcccagactcatgtaattctctagcttcagcctcccgagtagctaggattacaggtgcacaccacgacacccagccaagtttttgtttttgtttttgagatggagtctagctctgtcgtcaggctggagtgcagtggcgcgatcttggctcactgcaacctccgcctcccgggttcaagtgattctactgcctcagcctcctgagtaaccgggattacaggcatgtgcctccacgcccagctaatttttgtatttttagtagggactgggtttcaccatgttggccaggatggtctcgaactcctgacctcgtgatctgcccacctcgcccaccaaaatgctgggattacaggcgtgagccaccatgcccggcctaatttttatatttttagtagagatggggttttaccatgttggccaggctggtctcgaactcctgatctcaagtgatccgcccaccttggcctcccaaagtgctgggattataggcacaagccacctcacctggcccccacctttcctctctgtgattcttcccactgtccttgagcagggaaagttgtgaaaagagagtcagttctttgccagtggaaacctggaaaactctgatttttcctcagaagctatttgctttatttttatttattttattttattttatttattttttgatacggaatctcgctatgtcacccagactgtagtgcagtggcatgatctcagctcactgcaacctctgcctcccaggctgaagcaattctcctgcctcagcctcctgagtagctgggattacaggcacccaccaccatgcccggctaatttgtttgtatttttggtagagacggagtttcgccatgttggctaggctggttttgaactcctgacctcaagtgatcttcctacctcggccttccaaagtgctaggatttacaggcgtgagccaccgtgcacatccaaaaactatttgctttaaatttacctccatagtgttaagttgtattattttgctgttgttgttgagatggagtctcgtctgtcacccaggctgcggtgcactggcaccatgatagctcgctgtgttgcctgggctggtcttgaactcctggcttcacgctaatcctcccacctcagcttcccaaagtgctgggattacaggcaggagccactgcatgcaactggccttaaattttattctttttttttttttttttttttttgagatattctcactctgtcacccaggctggagtgcggtgacactatcttggctcactgcaccctccgcctcctgggttcaagcaattctcatgcctcagcctcctaagtagctgggattacaggcttgagccaccgaacctggccttagttttatcctttgtaaagggactacccagaccaagaattattgaacccaggctgcagctgtgaaaggacaggatttttaactaccagactataaagtagagcagcttttatagtgttttcttttccaagattctttgcaaagaattagtcctaacacacactcattatgcccattaatttaaatctgcatatagttgcttccactttgcatttgtaagtttgtgttggcaactcttctaaatgaataccaattggacagtgttcccttaaattttttttttttttgagatagagttttgctcttgttgcccaagctggagtgcaatggtgtgatctcggttcactgcaacctccacctcccgggttcaagtgattctcctgcctcagcctcctgagtagctgggattacaggtgcccgccaccacgcctggctaatttttgcatttttagaagaggcggggtttcgccatgttggccaggctgatcttgaactcctgacctcaggtgatccactcacctcagcctcccaaagtgctgggattacaggcgtgagccacagtgcccggcctccctgaaattcttatattgaaaatttaaagctataaatagatttacaaggttttccgaaattatggttaagtatattcataacttaaccatgctattttatgcagaatatgtttgtacctgttcagaataaagaccaagtacaacatatgtgaagaaaatatgcaaatacatctgggtagggtaaaaggcaattataggctgggtacagtggctcatgcctgtaatcccagcactttaggagactgaagcaggtagatggcttgagcctaggcatttgaaaccagcctgggcaacatagcgaggccccatctctacaaaaaaatacaaaaagttagccaggcattagcacatgcctgtactcccagctacttgggaggctgaggtgggaggattgcttgaacctaggaggttgaggcttcactgagctgtgattataccacttcactccacctggcctggtcaacagagtgagaccctgtctcaaaaaaaaaaaaaaaaaggcaattatgatttaccaatgttctctactacacttaaatacaaattatatgaacagtaattacagaatgctctaatataataaagaattccaagaaataaattactttaaaacagttattaagaaatatcaggtagctgtgcacggtggatcacacctgtaatcccagctacttgggaggctgaggcaggggaattgcttgaacctgggagacagaagttgcagtgagccgagatcatgccattgcactccagcctgggccacagagcaagattacatatctatgaaaaaaaaaagaaagaaagaaatatcaggtaatcatgaatatattcttttctttttctttttcatttttttgtcactgtccactttgctatgtctgatgactgcaatttgcagtatttaatatttatttcagaactttaaaaaatacaaaaatagaaaaggcaagtaaaaaatggttctaggattttttttttttttagatagaattttgctgttgttgcccatgctaaagtgcaattgcgcaatcttggctcacccctacctctgcctcccaggttcaagtgattctcttgcctccgcctcccgagtagctgggattacaggcatgtgccaccacgcctggcaaattttgtaattttagtagagacggggtttctccatctctactctccatctccagcctgttggtcaggctggtctcgaactcccgacctcaggtgatccgcccacctcggcctcccaaaatgctagtattacaggcgtgagccaccgtgcccggccagttctaggattttttatatgaaacaagtttttaaaattactctttttaaagccaagataagatggttagaataaagtaaaaacaattccacggtaattgaaatcccagttgtgattctgacttagcagagagagtctggtggggcacagtagggggcagggagctgctggcctggatctctgaggtcatctgccccatgtccctcatttcaccacagaaggttgagggcagggaggtccttgaacaaggcagctttcctcatttcaggaaccatggggtctgaggctgcagctgtgaagcaaacttctccactccccagagaaaaggtcctttcttcagcattggatcccaccacttgccgcatcacttaattagggctaaaaaacaaacagaaaagttatttctctccaaagcatatttaactaattagggcgttgttccatttgctcaactcaagtgtggaatattttgctttatttcggcctgtggtattctggggatgagaacactaagagctgctcgaagtgagaggaaaaaacattgtttgtaagaaattacctgaagtcatgctgtcccattagaaagcttctgttcaaaaaacattcttcctccacctactccagctctaagcatccatcccaccctctgaccagtgcctctctctcaaacaaggagttgtcaggcagctcttgagaaatattcctaatcaacttattttggaagtttagccctttcttttttttctctaccatctccatgtagccattatttgatataaaataatataaggtgaggtgccttccacagtcataatcttgtataatattaaagttactttaaaaaacatttttgcactggcgcggtggctcacgcctgtaatcccagcactttgggaggccaaggcgggcagatcacctgaggtcgggagttcgagaccagcctgaccaacatggagaaaccccgtctctactaaaaatacaaaattagccaggtgtggtggcatatgcctgtaattccagctacttgggaggctgaggcaggagaatcgcttgaacccaggaggcagaggttgcagtgaggcaagatcgtgctattgcactccagcctgggcaacaagagtgaaactccatctcaaaaaaaaaaaattttttttttgcaactaggtctagcaataaatattttacaagtacaaccttttatttttagtttctcataatagaccgtcgcctaagctggagtgcaatggcgtgatctcagctcactgcaacctccgcctcccaggctcaagcgattctcctgcctcagcctcccgagtagctgggattataggcatgtgccaccacgcccagctaatttttgtatttttagtagagacagggtttctccatgttggccaggctggtctcgaactcctgacctcaggtgatccgcctgtctcggcatcccaaagtcctgggattataggcatgagccactgtgcccaacctagatttttaaattttatttaatttttatctatttttttgagacagggtctcactctgtcacccaggctagggtgcaatggcatcatcttggctcactgaaacctctgcctcccaggctcaagcaatcctcccacctcagccccctgagtagctgggaccacaggtacatgccacgaggcccagttaatttaattttttgagacaaggtctcactctgttgcccaggctagagtgcagtggcacaatcttggctcaccttcttggctcaagtgatcctcccacctcagcctcctgggtagctgggacctcaggcttgtgccaccatgcctgactaattttttatttattttagagatgaggtctcactacattgcccaggctggtcttgaactcctggattcaagtgatacccccatctcagcctcccaaagtattgagattacaggcgtgagccaccacacctggcctagactttaattgtgtttaggtaaaattgtcttcttcttctttttttttttttcaaatagagacagggtttcactatgttgcccaggctggtctccaactcctgatgtcaagcagttcacccacctcagcctgggattacaggtgtgagccagccccacaaaattgtcttctaaagggtgatatatgtgacagcatccataccctgtggtttatggtacacaaaattccattgcaactttagccctttgacctttgtaaccccagccaccctagattcttttctttgtttcttttctttctttttttgagacagggtctcactgtgttgcccaggctggaatgcagtggcacaatcatggctcactacagccttgaccttctgggctcaagtgatcctcctgcttcaacttcccgagtagcttagaccacagtacagacatggaccaccatacccagctaatttgctttcatttttagtagagacgggggtctcactatgttgcctaggctggtctcgaactcctgagctcaagtgaactcctcccaaagtgctgggttacaagcgtaagccactgtgcccagcccctagattctttttaaaggcatcatggtgcagtagagagagactagactttggatttagaacattctgaatttggccgggtgtggtggcccacgcctgtaatcccagcactttgggaggctgagacgggcagataacctgaggtcaggagtttgaggccagcctggccaacatggtgaaaccccgtctctactaaaaatacaaaaactagccgcgtgtggtagtgggcgcctataatcccagctacccagaggctgaggtaggaggagaatcgcttgaacctgggaggcgggggttgcagtgagctgagatcgcaccactgcactccagcctgagcaacagagcgagactcaaaaaaaaaaaaaaaaaaaaaaaagaacattctgaattctagcccctgctctgccacttactagtggccttgagtaagtttttttctgttgtttttttgttttttgagatggagtctcactctgtcgcccaggctggagtacagtggcgtgatctcagctcactgcaacccccactcctgggttcaagcgattcttccgcctcagcctccagagtagctgggattacaggcatacgccaccacacctggctaatttttgtatttttagtagagatggggtttcaacatgttggccaggctggtctcaaacccctgacctcaggttatccacccgcctcagcctcccaaactgctaggattacaggcgtgagccaccatgcgcctggccttgagtaagtttttttaacctctctgaacccaaattttttcatctgtaaagtggggataacaatatgtaccttgcaggactgtcaaggttgaaatgaaataatgtaaggttccaggcctgtgcctggtgcggaggagatgatcaatgaagagttgcactcacactgataaaccaatattctaattatggggactctggagaaaccggcctgctctatcccttagaagtgccctacaagggcagtttgactttatgtttttgttttagatgttgattttttgttaaactgcctctgggtttattttatttatttatttattttcatttttatttttttgagacagagttttactctgtcacccgggctggagtacagtggcacgatcttggctcactgcaacctccacctcacaggttcaagcgattcttgtgcctcagcctcctgagtagctgggattataggggtgcaccaccatgcccagctaatttttgtattttagtagaggcagggtttcaatgttggccaggctggtcttgaactcctgacctcaggtaatccatctgcctcggcctcccaaaagtgctgggcttacaggtgtaagccacctcacccaggctctgcctctgggtttaaagagagagtgtttcttgctataaatagaatcaggaaagaaagttaaactggttttgtcacagaggcaaagttcaccccagtaagaacattcctagctctgcgttgagtccctggatttcttcacagacctgtgagaattgaagacagtgtgaagcagggagcagttgcagcttcccaggcgggtcggggacagcatggaggggaaatgggaaggctgagagttcagacaagcagggcagtggaacaaggtggacagatggcctaccaggagaaagcagccagatcgaagaggaaagcctgactgtcagtgttgaatgcacaggaaggaactagaaggaaacacacccgatgatgtcggatgcctgctttcagaacaagagggggaggccagccgcggtggctcacacctgtaatcccagcactttgggaggccaaggcaggtggatcacttcaggccaggagttcgagaccagcctggccaacatggcaaaaccccgtctctactaaaaatacaaaaattagctagatgtgatggctgtcacctgtaatcccagctacttgaatctgggaggcagaggttgcagtgtgccaagatcttgccacggcactccagcctgggtgacagagtgaggaagggagggagagagggagagcaggaaggaaggagaggaaggagaggggaaaggaagtgatcaaacagccaggaaagagaatgatgtcaacccctgagatggagctgagagatgactttttaatattaaaggggaaaaaatgatagtagccaattacggagggagggtcctaggagaacgcgtcagatgtactgcacgcaggataactgtggttgtggggccctgctgggaggggtgcttaaagggaggggtgcataaacgcagacccaggcctcagctccgggctgccaaaacctgcttcctacagaggatcaatcatggaaagtaggcctggggcagaagagggagccgatgggaaggtcggtgccccaattacagactcccttcccccaacccttctctcccacatgccacccagaatagccctggcatctttattgggtcaggctgccaatttgcgctgatcctctgctcacccagccctgtccctctgtcctgttcccagcgcctgagctttcaaaggcactcactggcccatctgttctggcccagtgtcctcctgagagatgatactagagtccttggggggaacccccaccctgtggcatagaatgaggtgttgcccgattcaaaaatttcacaaaataatttttttttttttttgagactcagactcactctgtcgcccaggctgaaatgcagtggcacgatctcagctcactgaaacctccatctcccaggttcaagcaattctctgagtaacctcctcagtagctggggttacaggtatgtgccatgctcagctaatttttgtatttttggtagagagggggttttaccaaattggccaggctggtcttgaactcctgacctcaggtgatccacctgtcttgtcctcctaaagtgttgggattacaggtgtgagccactgtgcccagccacaaaataataataattttttttttttgagacagagtctcgctctgtcacccaggctggaatgcagtggcatgatctcggttcactcaacctccgcctcccaggttgaagtgattctctcacctcagcatcctgaatagctgggactacaggtgcatgctaccacacccagctaatttttatatttttagtagagtccgggtttcaccatgttggccaggctggtcttgaactcctgacctcaggtaatccacctgcctcagcctcccaaagtgtgggattacaggcgtgccgtgagccaccacacctggccaataataattttaaaaggagtatatgggaagattcagattcctagtctctccctaattgcatgaccttggacacaaaaggcgctgcacctccctgagcctcagtcttctttgctctatccacacctccggaggttgttaagttcagatgaactgtgtagaagcacgttgtaaataagttgccattttcctaattttcccactcccctcttagaggggatggctctgcatttccagcagcgtctgcagcaggactgtctccttgctgccactgccactgaggctgcctctcctcacgggcacgcctcccggcatcctgtaagctcagctgcagacccagctggggcttctggagccttatctttccttgttttcatctatagagagggtcagcagggaccactaatggggtacggcacctttttatatgcatcataaactaaaccacaagaatgttatttcccatcactgccagctgcagaaggcagccattgttctgtgggcccctgcacagcttgttctgctgttcaaggacagaatgtcctaagctttgagttactcggcctgtttcttctcctcttccaactgtcgccttttgacttttatccttgctcatttcatttgtatccccacttgaaattagcaagtggaattgaaaataaatcataatcacagctgccatgtgttaagccctgtggcaggtgtactgtgctaagtgcttgtcttgtttaatctcagaaattctgtatgatagggatgatatatctgaggctcagagatagtaagccacttccccaagtaaaagagcttgaaggggcagagccagcattcaaacccaggtctgccttactccaaaacctgtgttcttttatttttttaaatggaagtagctttcttgttttctttcctttcttttttctgtttgtttttgttcagggtagtaaaagtattttaataatccatcacactcaccaaattgctgaaagtgaatagcactcaatgagctctctaggatgtagaccaatggaaacttccataagtgtaatcactttgaaaagcaattgacaatatcaagtaaagctgaaaatccacataccctgcaatgcaacacttccattcctggatccataccccagggaaaatgttaaatataagcatgaaaatacctttagaaatgttcacagcagcattctttacaaaactggatggcaggcatacagatacatatttcctgtagatgtttgaactaattaattagtataaagttatacatattcattgtaaaaaaatttttgagatattgcagaaaggcagagagaaaataaaaatcacccataatcacacaattcaaagattataactgtcaacattttgttgaatatctagactttttcctaagcagacacacacacacgcatttccttaaaactggccaggtatgctggcttatgcctgtaatcccaacacttggggacactgaggctgggggatcacttgaggccaggagtttgagaccagcctggacaacatagcgagaccccatctctacaaaaaatttaaaaatacaaacaaaaacttcatctttttatttgctcttttattaatatattgtggcagtctttctgcatgtatgtagagccacacacaaatttttttgttttgttttgttttgttttttttttttgagactgagtctcactctgttgtccaggctggagtgtagtggcgtgatgttggctcactacaacctccgcctcccgggttcaagcgattctccagtctcagcctcccgagtagctgggactacaggtgtgtgccagcgtgcctggctaatttttttttttttgtattttttttagtagagatggggtttcaccgtgttagccaggatggtctcaatctcctgacctcgtgatccacccaccttggcctcccaaagtgctgggattacaggcgtgagccgctgcacccggccgagccacataaaaattttattgactacataaagttccttcataggactgaatagtaatgtaactgggtcctaataatttaaccaaccccattttggttgtttctaattttttgcagttgtaaataatgcttcagggccaggcacagtggctcatacttaaagtcccagcactttgggaggctgaggtggaaggatagcttgaggcaaggagttcaaaaccagcctgggcaacagagtgagaccctgtcaaaaaataacaaaattagccaggtgtggtggcacctgcctgtagacctatctactcaggaggctgaggcaggaagactatttgagcccaggaatttgaggctgcagtgagctatgatgttgccatcacactccagcttgggtgacagagcaagactctgtctatagaaaaaaaaaaggcttcagcaaatacccctgcatgtaaatttttctctttacctctgattatttgcttagtgaagttcctaggaggagaaatttgggtcaaagaatatgcatttaaaattttattatttatttttttttaagactgagtctcactctgttgtccaggctggagtacagcagtgtgatctcagctcactgcaacttctgcctcccaggttcaagtgattcttatgcctcagcttcccaagtagctgggactacaggtgtgagccaccatgcccggctaatttttgtattttctgtagagacggggtttcaccatgttggctaggctggtctcgaactcctgacctcaggtgatccacccacctcggcctcccaaagtgctgggattataggcatgagccactgcgcctggccataaactttttttttttttaaattagagctgggatcttcgctctgtagcccaggttggagtgcagtgactattcattggcacaatcatagcacgctacagcctcagactcctggcctcagatgatcctcccacctcggcctcccaaagcgtggggattacaagcatgagtctctgaggctggcctgtttgttcattgtttaaataacagctctgttgagatgtagttgacctatcataagttcaccattttaaagtgtacaattcagtggatttttttttagctctactgcttaataatgtagtggattttagtatattcagagttatacaaccgtcaccactatctaattccagaacattttctttctttttcttttttttgagatggagtctcgctctgtctcccaggctggagtgcagtggggtgcgagtcggctcactgcaacctctgcctcccgggttcaagcgattctcctgcctcagcctccttaatagctggaattacaggcatgcatcaccacccctggctaatttttgtatttttgtcagggaaagggtctcaccatgttggtcacgctggtctcgaactcctgacctcaagtgatctgcccactttggcctcccaaagtgctgggtttataggcatgagccaccacgcccagcctaattccagaacattttcatcactccaaaaagaaaccctgaaccaattagcagttactcctcattctcctcaaaacccctttccccagacctagacaactgccaatctactttctgtttctatggctttacctattccagatattttatgtaaatggaatcacacaatatgtagtccgttgcgactgagttcttccacttagcaaaatgttttcaaggttcgtccatgttggaacactcatcagtacttcattcctttgtattggtgagtaatattccactctatgaatataccacatttggtttatcaacacatcagttggtggacatttcggtaatttccactttttggctattataaataatgctgctatgatcatttgtgtacaagttttcatatgaatacatgttttcaattctcttgagtatatgcctagtagtggaagtgctgggttatatggtaagtctatgtttaacttttttttttacattctcactaatagtgtatgagggtttcattttctctacatcctcaccaacatgtgttactgtctgtctttaaattatagtcatcctagtggatctgaactggtatccattgtgggttttttttttttcttttgagacaaggtcttaaccctgtcacccaggctggagtgcagtgacatgatcacggctcactgcagccttgacctcccaggctcaggtgatcctcccacctcagcctctcgagtagctgggattacaggtgtgtgctaccataccctgctaatttttttttgtattttttgtagagacagggtcttgctatgttgcccaggctggactcaaatttctgggctcaagggatccacatgcctcagcctcccaaagtggtgggattacaggtgtgagccaccacacccagccaccattgtggttttgatttagatttccctatatgactaataatgttgaacatcttttcatgtgcttatcaaccatttgtatatcttctgagaaatatctattgagatcctttgcccttttttttttttgaaacggagtcttgcagagtctcactctgtcacccaggctagagtgcaatggcgtgatcttggcctactgcaacctctgcctcccaggttcaagcaattctcctgtctcagcctcccaagtagctggaattacagatacatgctgccacgcctggctaattttttgtattttactagagacggggtttcaccatgttgcccaggctggtctcaaactcctaagctcaggcagtccacctgccttgggctcccaaagtgctgggattacaggcatgagccatggtgcctggccctggagtttcagttctatttcattaatctatatgttcgtcttatgcaagttctatagtatcttggttactatagctttgtaataagttttgttttgttttgttttgttttgttttgttttgttttgtttttgagatggagtctcactctgtcacccaggctggagtgcagtagccagatctcagctcactgcaacctctgcctcccgggttcaagcaattctcctgcctcagcctcctgagtagctgggactacaggtgtgtgccaccacacccagctagtttttgtatttttagtaaagacagggtttcaccatgttggccaggctggtctcaaactcctgacctcaggtgatccgcctgcctcggcctcccaaagcgctgggattacaggcatgagccaccacacctggcgctttgtaataagttttgaaactgagaaatgtgaggcttctaactttgttccttttcatttcaagcctgagtttttaaccattttattatgctaactcctatgaagaaaaataggctgggtggagtggctcatgcctataatcccagcactttgggaggccgaggcaggaggattacctgaggtcaggagtttgagaccagcctggccaagatggtgaaaccccctgtctctactaaaagttaaaaattaccggccaggcgcagtggcctatgtctgtaatcccagaactttgggaggctgaggtgggcggatcatgaggtcaggagatcaagaccatcctggccaacatggtgaaaccccgtctctactaaaaatacaaaaattagctggatgtggtggcatgcgcctgtaataccagctattcgggaggctgaggcaggagaatcgcttgaaccagggggtcggaagttgcagtgagccgaggttgtgccacagcactccagcctggtgacagcgagactccgtttccaaaaaaaaaaaaaaaaaacaaaacagaagaaacaacacacaatgaaggctgggtgacagtgagactctgactcaaaaaaaaaaaaaacagccaggtgcagtgattcacgtctgtaatcccagtactttgggaggccaaggcagggagatcacttgaggtcaggagttcgagaccagccaacatggtgaaaccctgtcctctactgaaaatacaaaaattagccgggtgtggtggtgtttgcctgtaatctcagctgctcaggaggctgaggcacaagaatcacttgaactcaggaggcggaggttgcagtgaactgagatcgcaccactgcactccagcctgggtgacagagcaagactttgaaaaaaaaaaagtatataaagctacaagctaaagtgagactggatttcatttcagccttcaatcagtcctttctactgcagaaacaatttaaagcaacaggagtgaagaaatattaatatgtacctctttgtgttacacagtagtctccacttatccatgggggatactttttttgttttgttttttgtttgtttgtttttgagatggagttttgctcttgttgcccaggctggagtgcaatggcgtgatcttggctcaccacaacctccgcctcccaggttcaagcaattctcctgcctcactctcctgagtagatgggattacaggcatgcaccaccatgcccagctaattttttgtatttttagtagagatagggtgtcttcatgttggtcaggctggtctcgaactactgacctcaggtgatctacccgtctcggcctcccaaagtgctgggattacaggtgtgagccactgcacctggcaggggatacgttttaagacctctagtggatgcctgaaactgcagctagtaccaaaccctatatatgctatgaggtttattttaaattttattaatttttttaaattgttgtgggtacatagcaggtgtatatgtttgtggggtacatgagatgtataagacaaaacaattataacaatatactctaataaggctgggtgcagtggctgatgcctataatctcagatctttgggaggccaaggcaggcagatcacttgaggtcaggagttcgagaccagcttggccaacgtggtaaaaccccatctctactaaaaatacaaaaattagccgggtgttaggccaggcacggtggctcacgcctgtaattccagtacatcgggaggttgaggtgggtggatcacctgaggtcgggagttcgagaccagcctgaccaacatggagaaaccctgtctctactaaaaatacaaaaaattagccaggcgtggtgccacatgcctataatccaagctactcgggaggctgagacagaagaatcacttgaacccgggaggcagaggttgtggtgagccaagatcatgccattgcactccagcatgggcaataagagcaaaacttcgtctcaaaaaaagaaaaaataaaataaagtaaaattagccaggtgtggtggtgcatgcctgtaatcccagctactcgggaggctgacgcaggagaattgcttgaacctgggaggtggaggctgcagcgagctgagattgtgccactgcactgcagcgtgggtgacagagtgagactccatctcaaaacaacaacaaaaacacaatatactctaatagaagtgatgcaggtgtgtctgtctctcgaaacatctgattgtactgtacttgcctattttcagaccacagtaactgagactgtggaaagcgaaaccacggatgagggggacaactgcactagcttcagttgtcaagctgtattagagcaaggagaagaaaattccagaacttgcagtctgcagggcctcctagctacctgaatgatatttaggtcctcatgatgtcatttgctgtttgtgttccacagaaatcctttctaatatagcctctttcctacagcagtagcagccagatgaagaagcggccaacatctgcagtgggctacaagaggcctatcagccagtatgctcgggttgccatggcaatggggtcccaccccaggtacagggtaagaagcggagaggggagaaagagcctacgggagggaggccgggcgaggtgtctcacacctgtaatcccagcactgtgggaggccgaggcaggtggatcacctgaggtcaggagttcgagaccagcctggttaacatggtgaacccctgtctctactaaaaatacaaaaattagccaggcgtggtgatgggtgcctatagtcccagctacttgggaggctgaggcaggagaattgcttgaacctgggaggtggaggttgcagtgagccgagattgcaccactgcactccagcctgggcaacagagtgagactccatctcagaagaaaaaaaaaaaagagcctatgggaggggatgctcacagcctctgcttcccctaaccacctcatcagccctgctacacccaagactggctgagtccctagaaggcacagtgactgggcactgttcaagcctggcatgatattcccaccacaggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtcagtacctccatggtcccaggcagcactggacccaggaggcaggggaactgcaggcgctgggtgatgctaaagagggttttgctggtacccgaagggcaggaagggcaaggggtgactggggatgtcagaaggattcctgcagcaacaggatggggcaaaggagaggacccactttcctgtttcctgtatttccctaacctcccctttcgcctgcgtcatctcccctgcaggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctcagttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacggcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtaataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccgcagtccgagggctgggcccaaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaacgcagttgacaataaaggaatgagtatcgtcacggagttgactgccttacttctcttccctttgtttcttcctactttaactccctccctttttcattttctcctttctctctcttccatgtttttccagtaggggctcaagagtatatcagccagacgtggtggctcacacctgtaatcccagcactttgggaggcccaggcaggcagatcacctgaggtcaggagtttgagaccaccctggccaacatggtgaaaccccatctctactaaatatacaaaaattagcctggtgtggtggcacacacctgtaatctcagctactctggaggctgaggcaggagaatcatttgaaccctggaggcagagcttgtagtgagctgagattgtgccactgcactctagcctgggcgacagagcaagactccatcccaaaaaataaaaataaaaagagcatatggattccagctgcagttatcagcactttggaaaagaactggttgcttaataaatggagatctgtttgcccaatagggctggggagcaggtcccaggcactagtcggaagtctgtgccgggactatggcagcagctgtttgtgttctaggctggtcgtccccaaccagttaattctgagcaactggcagatttcagaactgcctcagtggtgtccagattagctgtcactgtcatactccctatgccctcattgatccaccaaaggggttaaaggaggaaagaatgcatgtaaaccacacagatgtgcctgggcctgatgggtgctgaattacaataacttgaaagtctaggccgagtgcggtggctcacgcctgtaatcccagcactttgggaggtt

SEQ ID NO: 13294 - DNA, 250715 bp, Human
  misc_feature (1)...(250715): n = A,T,C or G
cgggcgcctgtaatcccagctactcgggcggctgaggcaggagaatggcgtcaacccggcaggcggagcttgcaatgagctgagatcgcgtcactgcactccagcctgggcgacagagcgagactccgtctcaaaaaacaaaacaaaacaaacaaacaaaaacctatgcttcttttttatcattagttacttctcttagttaattttaacagaagggagcattgaaacataaaattgtaatatcatttaataatcagaggctattgataattagaagaaaatatggcacaaataagttttaacataaataataatgacaccaaatgtaatagtttatttgttaattaacaaagttttgtggacaaaaatgatacatactgatcccttctgtgtctcaagaactccttgtatgtgaatggaaacttccatgaattatatattattcaaatttttttaataaaaatgctaatgaaaatgttaacatgtgcataaattaaaatgatcataaattaggattaatatcacattaatgaattataatcccacattcattaagataaagtggcatttcaatatttgttcatgttaatacattttatacaataaatgaaagggatacattttgagaatcaataaatatttgatgtaatcttatgctttaactttaaaaaatattcaaaagtaaagtaggagatctagatgcatttggaatctttgttgctattttatgtcttttttataagcctttcttttcacttattgaagggcttaatacaatttaaattgttgaagaacgtgaaagaggctgttctgaataaaagggatcccaagagaacacagcatcttttgaatttctaggagtttctttccacaaggcggttttttttttttttttttggaacaaatatttgaaatctcaactggaactatattggcagttaagtaactgagttaaactgaaaatatgtacattgaagtagtacatcgcaatgggcttttcttttaaaaattcaaacccccaaatacatatattattgttttattttattttagttttttaaaacaggagagacaccgtgtataatattagaatactcctgtctccagcctgagagaaaattgtcagaaccttaaaaccagggattctgttttccctggtacctaccaaaatgttttaggcagactatttgcctgacacacaaattcagtaaatattcattgctatgaccaaaaatggatttgggttcatggtgaaaagttgtcattttctgaaggggttccatttctggaaaatgtactcctaaattctggcctcagtgttcttctctataaaatgggaatgattttcctggactagacgaattgtcagaactaaaggaaaaaagactttcaaaaacataatatcttaatatcagtcaatatattagaattacttttgtttgtataaacatcacaggcagatctgagttgaattctggatctaccatacttgagtctgtcaaatataaaccttggagaggtaaatatgtgcctcgttcagcatcagttttcttatgtgtcatatgaaatattcttaacccagttttttaaataaaaaggatatgattatatgagaagtgattcacctagtcctgggcatacagatagtgacccataaaaggtgactaatcataataatttaagcaaatgtaataaatggaaaataacacatatatttttgtatttttctccttgacctttttatcattctaaaagcatgttgttttatactaaacaggccagagtactttttaaggactgttctaacttatttagatgaatttcattatattttattcttaattgatatccgcacagctgcatacactttgtacagctactattagcagaaattgatgatgttatgtaaaaagaaccaacttaatattcaaaaaggaggtagttaaaaaaataacttttcagattgctccatcactaactaatgccatttttcatttcagctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtatgtatgcttccaatttcacagatctattaaaagtcatctttagaatagctcctggcatcaaggatggtgtattgctgaatgaaagacatttattaccaccttatctctaatttgcatttccaaatccccctttttggcctaagttccacagctcagtagctttagtcccttagtaacaggaactgatggaagagcaattttattaaaatatctttccttacatgacaatacttcaataagctgaatttgtattcctctcatagacttgtagtttgagtattgttactgaggcagatttatcaagatttgttctaacatgccaagctaatcctgttgatatttgcttgatgtttaattatttgtttgtgtatattcacatgcagatgcagcacacagagaaacagaaagtcatctaggtctgtagtcagccagatattaggttgctctagtggttcatgtctagggtggattaggcaatcgacattaccaagggcctctgtatttgtgtccatcttaacaacattttttaggagtgactgctagtaccattgacccactctcaatttttctgagtcattgaagactccatcacatattacagagcagtctgtatttcaaacatgattttattcttgtttctccctctttggaatctgcttatctatccctaaacccctgccatgatgataagaaacccctcaacccagacattctataataaaaggaaggattttagagctcttccttgtatgataaaagtagtaggcagaatctaaagttcaaagtataagattacaaaagccattttttaaaatgtgtagtacatatccaagtttgtttcaagttgcatttaagacagcctataagggtgcatgctatgtagtaaagtcacatagctttgaagcaggtgaacaaggtgagacaaataaacacaggtagagataaattggaagccagaatttggtaaatacagacatgtatattcattatttaaagcccccaaacttaacattaaaggaactgcgagaaaaaataaaaaaaagaaatatgatcaagaaccctgttctcaagttttataaaattaagttgctcaagaaaattgcaaataaataaagatatgaacaccagaggaagtatacagacatatagtgtcttcaataacatcttcactttagacacaaataaaggccaagtattgattatggttttcaaggctaaattgggtgaccattgtcaggtatagtacagaatgccttacctcccaaatgtggtcctgatattttaatttagcaatccagtgagatactcgtgtgtgtgtgtgtgtgtgtgtgtgtgtgtgtgtgtctttataacattcctgatggaaattagttggaatttaaatttcaaataaagaaaaatcttttgtagaataaatgacttaatttgcaagtaagttattctcaggcatttctgagaaagagaatatcctagttgttctccttgacttgatctgttttatgtttgaatgactttctcttattttgtcgcgtactccttaaggtgattttgttcctcagagttcttttttcttccccataataccttttcctatccctcttcctctttctcacccttctccattagttctcctccttcattttctcctcctgtttcttcttctctttatccccttgccgtttccttttctctctccttccctccattgtctttcatggtcacccctgtatcttcagccacttgtttaatgtggctggccgtaaaatcatatgccttgccccattggtctgcttaagctgttaatccacattgtcagttgctttatgaacattatcatctggatatttcaaagacagctcaaatttcacattaaaaatcaaactatgtacatggctgaagctggaaaccatcattctcagtgaactaacacaggaacagaaaacaaaacactgtatgttctcactcataagtgggagttgaacaataagaacacatggacacagggaaggaaacatcacacaccggggcctgtcagggtgtggggagccagaggagggatagcgttaggataaatacctaatgtagatgattggttgatgggtgcagcaaatcaccatggcacgtgcatacctatgtaacaaacctgcacattctgcacatgtatcccagaacttaaagtataattttaaaaaatgcatagaaaaaatgactagacagaatatcccaaaatggcatagcagtcacttttgggtagaaaaaaaaaatcaaactaattactttcatgaatttttttttcctgctttctgacttccatgactttatcaatgactctgatgcactctcaaatcccacgtacaacatggaagcgatattgttgaatctgtttttactcattaagcctcaccagtagtctgctcatttaatccctaattccagtcactactgactgctgtgtaatcttaatgcatcatctcatttctttctttcgaccactctccaaaatcatatcttaatgaccctcactggattattgatgatctcagtaattttccaaatagtgtgcttgattctaaccatgttatttcttagctgatatatgtgtttatcccagaggaaaaaatatcccttacattttataggtgttcagctacttacccagggggacttttcatggtctgcttcatttgattcttttcttacctacctacaatatgactttggtagatacacccattcggcagcaaatcacaagtgatttcaggtcttgatttgttatccatatatttcttctgccaagactccactttatctacctcttgtgaaaggagctctatttttttttccttcttatcaaaattactacttcttttttttttgagacagagtcttattttgtttcccaggctggagtgcaatggcaccatctctgctcactgcaaactccgcctccctgtttcatgccattctcctgcctcagcctcctaagtagctgggattacaggcacatgtcaccatgcccggctaatttttgtattttaagtagagacgtggttttaccacgttggtcaggctgcttttgaactcctgacctcgtgatctgcccccttcagccttccaaagtgctgggattacagttgtgaaccaccgcgcctggcccaaaattgtttctttatggctggctggaatgacacttttcctaggaaaatgtctgtgtttttctctcagaaagttatctttctgccatcaccacccccacacacacataaaaaacacacaagcaagcaaaaacacctccatcttttcacttcgtttggcttctgacttacaaacaggaactgagaaacactatatatatatttcactttttttcatattgtttggtcatttcatttaggccagagaactctctaattcatcctttcatctagattagagtaagatggttttgatgaatgattgctgcccacaaaacatacagcacactttatcttaattgttaataaacattgaacagagaagctgttatttttgcctcattatgatttctacatcttcatgccaagcctatatctattgattgtgtgtcagaggctctcatttctgtgtatgtaagtcatgtgtcttataaatatgttaagaaagaaaactgcagaaatatctgcaaacatcaagtccattttcagataagaaaaggacttaaaatatattactagcagccaacatggtgaaatcctgtccctactaaaaatacaaaaattagctgggtgtggtggcatatgcctgtaatcccagctactcgggaggctgaggcagggggttcacttgaacctgggaggtggaggttgcagtgagcggagattgtgccactgcactccagcctgggagacagtgcgagactccgtctcaaaaaaaaaaattatcagctacgtaatgaagtgcctttatgcacttgtaaatacatacatacacatgtatatatttctccatctaaaatgtttttgctaatagagtagacatttcaataatccacactaacatatatatgttgtatatagaattcatagttatgtatgttatatatatttatatattatattatatatataataaagatatatatgtattatatatctttagcctgcgacatatcttccaaaaaccacagaggatgtgttgaagtttctggtgggagtttgaaccctggttctatcccttattatcaggttgactatgaagtttggggaggttaaatttttgccattttccttagctataaagcaaggataataacttttatgttgctttcattgtgtgggacttgcatgacaaagtacaatgtaaaggtatgccaaaaagtaaataagtgttccacaattggttgttgtttatggctttaaaattatttttattaatctgtttcccaccttacctttggacctttccttatatatcgattttatgcattggatgtctggtgtctgtgtgactacagcctctctggttaaaggaagcagaggcggctgcattatttcattgcgaagtgtgaattattcccttcatttctcatgaaggtgaatatctggaagaaggtcagctaccatcgcttttttcttcctcttaccactgttcttccttagcctgtctcttccctcccctccttccttctttcatttttcttccttcgctgtggcagaaatgccagcacgtgcacctgtatgccctgaggaatgccagcaaaggctgagggatttcattgtgcagaaagtgaagaatacaattctaattgagaaatttaccaatattaaattgaaatgaatgtgatgtttgagaactgtcttccagttgacaggctgtcaagacaaaacgcacatatatatttgcccaaatggcagccaaattattttagaaatatcttatttggaagctggagacacagttcttttttattctactgtgaatttcatgacttgatgagcttgtgagcttgtctgattttaactgtggatcccaaactagcgttgctgaagttggtttttcaatgcaaatgtccctacctttagtaagttctagacattttaaatatatatttggattgtttttgtgtattggggtcaagtgtattttaatcctgattgttcgctaaacctgggtttgagtaaaatgaacttttttttttttactttgacttagatttgcaggttatttggctccaaatctgacttcttgcgtaagtggcataaaccatctaagcttgactttctctatctctatagtgtatacaataatccctgcccaaaagtgtgtttggaggaattcaataattatatttaacgtgctacctacttggcctttagtttctttacaaccattcctttgtgacttacttctaccagtatgattcaataaattgcctgtgtaatacgaatacatgggttaatgaaaaattgcttgacaagacctaactttatatttcaaaatgcatatgttggaatgaatcctattttactcaaaagcatattagtgaaggctgaaataaagggatgagaaagagagtagtgtttaagttggtagaaattattgcattgttgtgtgcacagatacataaaacatgacacttggggtattcttagttttctctgaggttcagggctactgtaatgatgaccaatacgtattgagaatttactatatgccagaggctgtgttaaatgcttctaatatacacaacaatactattatgttagtaccgatattagtttttctattctttatttttaatcagaaaattagggaaaatgctacataatataaagtcagatattaagtggctgagctgaaatataaaaccagacacctggttctacctcccatgggcttaaccagtatgctctactgatctttgattatatctctagataattctgtttataagagcattatgattctgcagcatgtttataatagttaatgtttttccgaggtggaagaactcttgaggtcagcctactttgcaaattaaattgaagtactgagaggagaattggataggaagtttaagggaggtattatataattttcaatataggaatatgagcactttaaaaatgtcagaactatacatcacgtagaaattcaaataacaataaaattaatgaagagctatgtgataattactgctaaatatattaaagcctaacaagagtaacttgaatggactctgggtttcttggtagcaaatgcaaaagaggaatgcatgctccaccaaaaaatattaattgaaatatcagaagaaggtcaaaaattactaggtaaatatatagttgaaaaaggcaaatctcagtcttttccaaagtggtttcactgaggaggttatagaagtcagtatatgatgggcaagtctccttgaacaacgacttcttaatttaatgtgaaaattattaaataatttcagtctttctccttgtgtaaaatatggctatgttttcctcttttggaggaatgctcatagaaaacacatactatttctcttgtgctattttgttatctttgatttagaataaatttaatcttagagaaaaattgcaaatgttgtacaaatgtattgtttctgaactgtttgagagtaaattgttgacattttgacccatctcctaagtaagtcttcctgtatgaatgttattctaagccaacaaaatacaatcatcaaaattaggaaattaatcttgacacaccattgatatcaaatacacagacctcatcaaataatctgcagctgtcccaatatcgtgggttttagtaaaagtatcatatctagaaccacactaacgtaagacttattcaatctggaagggctctgcagtcttcttcacttatgactttcacacctgaccgtggaacaattgttttatagaatttcttaagatttgtctgatgtttccttaggattagatacagaatatgcatttttgacaagactatcacagataatgccttactaatttgtatcaggtggtacatgattttgatttattccataattggtgacaataattttgatcacttcatgaaggaagtgtttgccctgcatctccatcatagttttttttctttttgcacttaacactttatgaacagatacttagagactatgtaagtatcttattcctcatgaaactattaacccaaaattttaacatccattgaagtttcttggctgaattaatgattactatgagagctgccaagtggtgattttcttaattccatcattctatctacagtcattggttagcattcttctgcaaggaaaattttctcttcacattaatttgcttgtgtatttatttacattagctttgacttttcgatttctgttttatttaatgaattataacaggttgagttatttatcctgatgctcagattatctgacacttggtcacgatgtgtccttggggctgagttttgtgtcctactgacatgcctccatcattctttgagtgcattctcaccttttggcccaacgcgctgtttgaggctcattttgtactttttctagcccagccctagaattagccatttacacacacacaaaaatctggttccgtttaaaggagaattgtatttacatatgaaagtctgggcattagttgtgttcattgttattaggatgtcagtgttcccaagccttttcagtggacagggcagaactaaggaacatttgggagaatgtacacacacacacacacacacacacacactcacacacacacacatctacctgtactgggttggatagcgttccccaaaacttgatatccattcagaaccttagcgtatgaccttatttagaaacagcgttttagcagatgtcattagttaaattgaggtcacactggagttgactgggccctaagtccaatgatcggtgtcgatctaaaaaggctgtggaaagatacagactcacacagggaagaaggttgtttgaggacagaggcagagattggagttttgctgccacagccaagaagaaccaggagccacacatagctggaaggggcctagaaggatccttcggagggaactggtgttggatctgacatcttgattttggactccagacttctgagagaataaactcctgttgttgtaagcagcatttttggtaatttgtcatggcagcccagggaaactaacacactatgtatctctctattgaaaactacaagttcagctctataactgcattctaaaatgacaactcaggcttcattttggttttttcccctttctttaacagtgaggaatgtatctctttatttttaatatagttataaattagctcaccacttatccttgcagtagcttatctccatttgctacctcatccatcgccttactccccccacaagtatttatctactgtctcactcttcctctacctcctgttgttatgtggtgtcccaacttgcccagccacaccttatagcagaaggtgttcaggcagaaggcagaagttaagaatggagacaggaatctccataatactctgtatttttatttgtctgtatatttctactgtttcttatatcagaatagatcggtggcaacattttctgatctgtattcaaaactggtttagtgcaaaaaaaagtataaatgtatttgataaacaccaaattaaagaaagtgaaactgcttttcctatttcagtctctaaagtataactgtatatcataatttgataaattcatctaatatactctttgggagatttagacatattgtatgctcttttggaaattcatattcatttatatgaccccagtaactattttttcaaaaggatcctgcaggcattacagaaatttactccacaaaagctctagagacacatatctaatgagaatacatttttggttttatgaaaggccacatgttaatttagcaagcagctaaatagtaaaatttgcactttctaaaaagtgaattgtaaattatgatgactacaggttacatggattagcttgtgattcttgtcattgcccagtacatattttatcctccaaaataaagaatatttctgaactaataattaaagaggctcattttcatattttttattattaaaggaacaatttgtgtcacataggtttaaaagatcaaaggatgtacatactgacaaactgtcttcaacctaacacatttcttttttataatttataggttgtgtctttctttctccctctcggctagattttaaaagaatttggcagcacttctctatttttaaaggagagatgcaaagtgggaaacgggaaaagcatatcttgatggatttgattatattttttcttgtttcattcagcgtgatgaacaaaattgaaattctttaggaaaacatgggtgggaaatcatgaggattgaaataaacactttcaaaagaaatctagctgttctacctgatacgaatgactaaggcagctgtggttccaaaactctacaatggggtgaggagtctgtagtttctcttctgcttaaagaagctaaacttctattagagatatgtaggcagttgatgcaatcagtgaatctttttctttttaactttataatgaaagtgaagcaatggcttctaatatgtgaatttttgtgctattcaaaggtctccctaaatggtctatggtttagaaattaccagattatccaaacggggaaattggttacagttaattgttaggggtgcctaaaatgcattagtcttccaagaggcattgagttatttctacattatgtctgagaacaagctttgcaaacaatgatgacaatatgaacaaggtttatttgagtaacttttgtgatgggagagctccttcatcggattttgttttaacatttgctcatttgtactccctaaattataatattacattttattaaggaattaacttataacagaaaaatacaattaaccaattttattgccctgtatgggctgccaactgtttttgggatcttaggttgataattccacatccctgatctctttaatttaaaaatatgtggtccaaccctcaaccttatatattatatgtataaaatatatatataaagctatgctaacaaatgtagaatagcataggaaagtttattatagtcttatagaaacatcgctttcagtcattttgaaaacagttaaaattatagaactattcactatagggctgtctgagctgtctcagattcaccctgtctggggtcccattatcaacataagctgggtgtttccagtgcactcttcttttacaattggtctatggacttaggaatttcaagtaggaagcagaaaatctttgaattatttctagaagatgaattctcagtcactatccaataaaaattcctcagaatgacataaatcacaagaaaatgtgatgaaaaacatcacttgatttcacaagggataatattggtatcattttttgttatctataatagaatattacataaagtatatttgaaggaattacaaaaaggcctgaaatttgaacctactggaacaaaatttaacaatctcttcctcttaccccaccgccataggtaaacaatgtgtcattcctggcggactgtgatttgttgcctcaatttgatttagaaacctatatctcttagtcataggcatctgataatttgaattggtgtttcagatttattaagattaaagaattggctcagcactaacaatgtctaagtgaagaggcaacactgatgatgtatcttgatctgtgtcttgtaaactagtgtctttaagccaatttagctatatacccattaaccaatagctcccaggcctattcacagtagtagctaatgcttaagttttatttcccttttaattttttcctgttatatctctgtgcttgctaattggaattatcttaaactcgatttgattatcctaacattgtctctttatgttctttagaaatacattttctactcactcacatcttggctcttgctatttctaaatacattggttttcctctctaaaaactgcaccctactcttctgttctcagagatatattttatggtcagcatttcaaccgagccttctctgagcccttctgaagaaaataagacatcaaccactttctattcaagtaatgttctggtacttgaaatattgaaaagtgttttcaaatcagtcaatctgcacttatcataagaaaaatcaaaacacttaggaaaaactttgtattacaggtagaggattgaggaaagcaggtaggagtctacacagacaaccccatgatcctgttttctttcttgcctctttttgccctcagatgggaattaatatttcaggattcaacatatttgttgattccagaagataaaaaggcaaatcttcctgtttattcaagccacatgtgtgtctagagttctgtaaattagaatgaacacccatagtataaattgttattacataaccattccaggaaagcatatattaaaaggggctggggagtaaacctcacagagttcagcctttgtccgcatttgctggtcagagaaatgaattaactgcatgtcagggcagctccgaaacacatatttgtgaaattctgaagacttgcctgaaaatgaatgtgggacacctttgtcaatatatttctggtgtatgcctcgcttcctcagaactttgcctctcatgggtagtggggatttcctcgagtctccttgtatccatgtgttattatttctttaactttgacattcatgtgtcatgggcttaataattatactttctggattcactggactttgaagtttgccatttgatttttagacccaaatgcacttattctttggctaattagcaatcatagatttatgaatttaatggaattttttctattctccccaccagtaatttcacatgtatatatatatttgtatatatgcatttgatatgttattagacctcatgacaaaagacaacagatatttacaacatgaggctgcaggtgaaaatatatagctatgtatcacctgggatcacatggaacacataatctcatatacatccccatcctaagggaatcagttttcatcccttgtgtctgtgctcaaagagtttatagtaattctaatcatatttgtgctactgttgcagctgatttcattcattttccttttgtcagggagcatgactcaaggagtcttctctttataaccatgtcagactttacagatctcatcattgtctatcaattatgaatcttggcaagtaacaagagtggtttgagttcaggaaatacattggggatggagcagtagtgggaggacgttcacaaagtaaagttaacactttttgaagcaagtcttgaaatgtctgtacattattccttctgaaatccaaagtgatgttatcagcttaaggttaacataatgactaattaatttaatattacatagggattaatatttaataaatgtgcaaaatgctatcctaagcattctacagacacattcaatctaccaacaaccttaggaggtgaattttattattcttattttacaaatgagaaaagtaagtcatatgatcataaagtagtttactcatgatcttatcacagatgagaataggggctccccatcagaaagtcagaaccagtaacagtcttacatacataacaaaagagttattatagggattagaccttatacgtcatgaagcagagagagaaatctgtgcaaagctgttgcttctgcttctggggatgggaaaaaagctggacatgaggtgggaaagaccaggaatacactggaatcccagaggaccaactagaacccatggggacaaagtggagcctatctatatctgtctctcatacttcaaattcccatgccttgagtagtctgcaggagaactggtgccctttgtcacagagagtcacatttatctggcctaggactccgcgaacctgaaggtgcaaatcctaagaagccggaggagctgtgagcctggatgttgctgcatgccaacatggtgagcttgcagatctgctgaatcatgcaagagcccagtgcctgatgtcttgctctcacttcctgtctgccttcttcacttctgcttccaacgtctcatgccagaagtaactagggcaatatagagaagggagttctagaaacagaatttcagtttagcttaattgatagagaatgaagccacagcagatacagtttacttagtttctgctctaggctaggtacatgtaaaacactgtgtagatttttagaagggggcattatatatgtcaagcatgattgttgtacattatatattatataaagattataatatcagtcaagtattaacacattttttacagtaaaaaatgtaaatacagtgggtttgtgatgggatcagaattgtgttccccacaaattcatatgttgaatccataactcttagtatctcagactgtgattgcatttggagatgggacttttaaggaggtaatgaaggttaaatggggtcacatggtgggtcctaatgctgtctgaatggtgtccttacatgaagaggaaatccggacacacaaagagacatcaggggcacaagtgcgcagatgaacaagcacatgagaaggcagcaagagggaagccatctgcaagccagagagagaaggctcagaagaagttaagtctgccagcatcttgaccttggacttccagctttcagaactgtgagaaaataaatttctgctgtttaagccacccggtctgtgggaattttgttatggcagctgtattagtgtgttttcacactgctataaagaataacacctgagactgggtgttatctttcctttcttctgctcaaaattggtcctcctactcctatcctttaaaatgtgttcatggacaatctgtttactaaattatcattaccaatgttacctacttattcctaattcctttcttctgctcaaaattggtcctcctactcctatcctttaaaatttgttcatggacaatctgtttactaaattatcattaccaatgttacctacttattcctattgtttgaaagtttgtgtgaaaaagggaatgaacacaggaatgaatattgtgtagtcatcaaccctctaacctgtttcaagtctgcagtgaatgtccaacatccgctgagtggctacctaactcatgctgtgtgtattctctagttactatgcatcactctattgtcagtgtgaaataccagcagttagcttatataggttgcttctgttctgggacacaggcagacattccaccaaatctagttgaattagtctcaaccgcaggtatttgccaggaaaactaggaggatgtggaaacagtacctttccaagtagctcaacataaacatatgtgaacttgggaaccattaggcaagcatgatcctttattaaagtaaaagggtaaagccaggacccgcagaggtgggtggaaatggagcaggcaaccaagacaagaaaaagtgagagactgtgaaacttcttgttggtttgcttagtctctggttctacaaacatactgatctttaggcacttcccatctctggcttcgatgatacttccatctatctatagaagacaactcaataaaatggagagatgtattatgtttcttaaaaacaaacatttcctgagaaatataaagtagtctgctggatgccttgggtggcagtgatgacagtgaccagggggattcaaaagaactttggtctgtaagaggatataaaagcatctttcttcctggctatgtaaacagtgtgtaaagataacaaatatttatatccacacagattatatgcagtttttttttattattatatgggccttaaaaatagactatcactcttgtgtctgccttgtgaaagatcttggctccttagggtaaggcatggtgtgaatatcagaactaggtagtagatatcttcaaactataatatgaacaaactcgaaagttttttcttcgtctgccatcgactgctgcacagataaaagcaatgagctgaaacgttaaatccttgggaaagttagaaccagggtagagggtgggatatccccttctactgggcttatgaaaggatcatgcgtctccttgaactgggagatagaaccagagaaggaatattctcagttcagtaagaaaaaagactctgtgctgactgcaatgtcactcttccatccatttatattcacagatcctattaatggatgtaagataacctacagtcttccatgctttgttctttttgaaattactgttaaagaaaactagatgatcgagactgaaaacaaagggcaaaatcctttcccgagcatgtctttattgtcctttttctcaccttgacagaataatcggaataatgacaatcaccctaagattccttttttttttttttttggattgctattcctgtgtaattattagagctgctgttaccattaggtgataatgaaataatatcaaacaattcccacacgtttatgtatatgtaacacgttacaatgtcaaacttaaatgaaaggagaaataccagtatccgtcttaagagctgctctgacagcaactcacagttctgataaacactatttaagtgccttgtgaaagccttttttggggaggctgtcagcgaagcaagtgagaccatgtgatgtgaatctagcactaagaacattagtaacctagatttctcatgaacatagatagtaattcttgtgttcaggcttttctacattttctttttgttccgcgtacatatttttaaattctgcattcaagtttaatagccatacagtaaaatgcatatatctataacagcataagctgaacaggtttgtatacccagcacccaaataaaaattcacaatagcaccatccccacaaaactcattctgtgtccccttccagtcacatgattaactgatatcctgacttctaacagcatagatatgttttgtctgctttgtagtcattaattggctcatacacaatgcatgatttatttatttcaacaccccagacaggcttgaaattaagtctaccaaaattacaggacatttaaatgaatcaatgaatatattcattcttatattcgtttatcttgttgatcctctctaccatccctccttttttttccttctggttctggaaggtgactttaaaaatatatgtgttattttgggtggcctttccttacatacagttggcccttgaacaatgcaggggttagggttataaccccttgcagagttgaattccatgtatagtttttgacttcctaaaaacttaactaccaatagcctactgttgaccagaagtcttatcaataacataagcagttaattgacacatggttttttatgttgtgtgtattctgtactacattcttacaataaagtaagctaaatagaaggcaatgttgtcaagaaaatcataagggtccaagtgcagtggctcacgcctgtaatcccagcactttgggatgctgaggcgggcggatcacctgaggtcaggagttcaagaccagcctggccaacatggtgaaaccctgtctctactaaaaatacaaaaattagccgggtgtggtggcacagagctgtcgtcccagctacttgggaggctgaggcaggagaatcacttgaacccaggaggcagaggttgcaatgagccgagatcacgccactgctcttcagcctgggcaatagagcgagactccctctccaaaaaaaaaaaaaaaatcataagaaaggtaaaatatacttactattcatcacgtggaagttgaccattataaagtgcttcatcctcattatcttcatgttgagtaggctgagaaggaggaggaagagaaggagttggtcttgctgtctcagggatggcagaggctgaacagaatccacacgtaagtggaccctgcatataaatcaaatctgtgttgctcaaaggtcagttgtacctagctcaaggcagctaagtgggaactttcaagttaaggctgtttttcaagcgtatgaccaacattatctcttagttaaaccaacagaaaacccacaccagtgggatatttcagaggtgtctaacccattttaatcacactttccttttttttctaacagaaattcactttttaaaactacatttatttaaaaaaaaaccttctactgtttactgttctgcttcttatcttgtttcatgttttttcaactctcatttctatattttctctaattgttctcatcaaatacatttaataaaatttattgaatacctgcaataacagatagtgaagtctcatagataaaagctgtctttgcagatagaaagactttgtgcttaagagttcactctctcgaggtcttgttgtaaatccctgctactttccttggtcagagcattgaatccacctcttagttctttgagattcacctctagtattttggtctgctatcaagtatgccattaacctacatgggatatgtcatataaaagaaaaactgctatacttgtttttattcatatgaattttgatttaaaaaagaaactttatctcactattagtatcacttgccataagtagaaacaaaggccagattaaaaaatgaaataaaatgtaaaatatatgttaatatataagtatcattaacttttttatagacaatgttgcctgcttaagtcgtatccccaagcctgcttgttgtttgctatataaaggggtattagcatgtatcagaaaggtgttaaacacatacagtactataataaaattgatatattatcttcagtctaatcagaaaagttaaaaggggagtgaaatggataaaaatctcactacaaatttaaagctgattaatattgattgcttgcatacctagagtgccctgctggtatgtttctcttgttttggtgggcaacatgctatacaaaatgcatgtttacgttttggtatataccagtcaaggatacatactctaaatattctttcttaaccatacctgcctccaaggagcacaaagcctggcagggaggataacttgcaaccttgaggcttacccagaatgtgaaggaccatcataacagaaatgatgatgatctgaattccccagggatgtctggaggtatcacctaggacagtgcttgcttaagatttacatggcagaatatcaattaaagtttcttgttttcttatgactcagagcacctgcaactacttctttttttcagcttattttattttaagttcaggggtacatgtgcaagatgtgcaggtttgttacataggtaaatgtgtggcatgggggttggttgtacagattatttcatcacccaggtattaagcctagtatccatgacttcttattcccaagcctctccttcttcccacccttcaccctccaataggccccagtgtgtgttggtcccatctatgtgttcatgtgctctcattatctagctcccacttataagtgagaatatgcggtatttggtttactgttcttacatttgtttgccaaggataatggcctccagttccatccatgtttctacaaaggacaagatctcattcttttttgtggcacctgcagacatttctcaaaatttttggaactgttgagaagtaggcacaaagtgtctcctgctcgaaagtcaagccatgtgagtagaacagagatgtgtcaacacaactgcgggggctcttcttcatagctaaaagagggatatctgcaaaatggaaaacatttcaacatcatctctttattcctagatctaagcaattcagtactcataaacaattggcaagatattcaaacgagcaagcaggcaaatgcatggaaacgtgtatgattattttaaatattggatgggagcttttacattatatccatcgagtaaaacacatttgatcagaagctatttcaagatatcatgattaaagtagttattgctgtgcttttggcaatggttagaaaggcagttttcttctacagcctcagagacaagagctatattggggtttgaagagacattctgccatattagacacggcatttgctttgaatagaaaatatattcttgattaattctaagattttgcctgaattattagataactcgatagtgctttaagttctacagagcttctattactaaagaagccaatttaaagggggaaatgcttagatacctgggatccaagattaggcttaggacagcttagagaatatagaaatgtgctccccagtgtctgatttgatgcttccttgaagcgttcaaagttaaaagctccggctttgaagccagaaggggttacaattgtggatctttgcctaactactaggtaaccacgagaaggaatttacctctctgaaactgagtttctttttctttaaaatgagattttaaaagaaaaattatgtgaaaggataaaatgctgtgcttggcatgtgatatttcaataaatgtcagttttgcctggctctgaggcattcactatgtgtcatagtttatcctgatttaccttagtcagtatgctgcttctgaattccctgagcattaataaacatcagtgcgcatcttcttttctgatatgtttgcttaggatgaattttcagaattaagctagttagtctgtttaaaacaaaggattgattattctattacctttactgtaggcaatatctttatcctttatttccacaacccctaccctctctttcattattattttttaattcactctccaaaattaacatctcatttctgacttttcctctgagttccaggccgacacctcaaacagcttatgtgacatggacatatgagattgaggtaactgtacagcaatcagcacatttaaaactgaatatatcagttgtttattgctgtgtagcaatgtcaccacaaactttatggatgttaacaacacacacttattatctcatagttatgtaggttaggaatccattcagaaggtctgtagatcttctgcttcagcctctcatgggctgcaatcaaggtttcatccagggacgaggtctcatctgggactcgactgggcaagaatccagttttaaggtctcctggctgttggcagcattcagatcttggtagatggttggactgagggtctcggttcctttgtttactgtgttgagtggccgatctacacacgttgcttcatggcctttccatctggcagctcagaataagaaaacttccttcttcacagtcagcaagagagagagtctctggtgtgatggacacaatctcatgtaacgtgatcatgtccacacaattacattaaacctggcctcttgctgaatgttattgattcaaagcatgtcacaggtctggtctttcttgatccactcacctctggttccacagtagcaagaatggcattttcaaaacatggttttgaacatggcatctccatcaacaccttcctgttgctcttagaaataaatgtgtgtggatctgagtcattttataataaatacaagccatcttctacttctcaactgtgaagtcatttctcaccatcctagggctaaaaactattttatttcacttggacctctgtccactctccatactggtctttttgatcatgacaagttccagcttaatgagcttcagtgtttctccattgctttctggatatagttcaaaattcacaacatggccaataatgctcagcatgaataaatcatgccaacatcttcacatcttatcactgcctcatagatttgctttctgtctttcgagtgtgaaggcttcagaacctccacatatgcaactgacgttgcctagacaactctaacttttatttacccttccagcttcagattatcattgcttactccaggtcggttaaaacttcatattatatggccgggcacggtggcttacacctataataccagcactttgggatgccaaggcaggcagatcacaaggtcaggagttcaagaccagcctggccaatatggtgaaaccctgtctctactaaaaatacaaaaattagcagggcgtggtggtgggcgcctgtagtcccagctactcaggaggctgaggcaggataatcgcttgaacccagaaggcagaggttgcagtgagccgagatggcaccactgcactccagcctgggtgacagagcaagactctgtctcaaaaaaaaacaaaccaaaccagaacaaaaaaaacccaaaaaacctcatattcttctggattttccttcatacaattaattgattgattaattactgtattgctatttctactctcccataaggtctctgtaggtgaaacttgtgcttatattgttccttgttgtttttcggggcctatcacaggactggctggatgcatggcagacatctcagcaaatatgtagtagatgaaaggagggtagaactaagaaaatgagaaacgttctctctgaagatttcaattgcagttaggaaaaaggcaaaagaacttcctgccgaaaggtcaggtgggctgaaagaggttcagccaagaccagggcacagagcagtttgtgaggatgatgacagggaacaggtgcaaatcatagcattcatggaacccagtgttgaagccaatttcagggtcttacatgactattttggtgttggaatgtcaaccggatctgcattgccttccagagtggcaaggctgctgattcctgaaatgtgacaaatagggaatttattttacatgatatgtgtcttcagtctttctacatgaaccaaattgattcagaaatgaagaaagtgctagctgtttaattgagaaagtgttcatggcctttctcatttgtttttctttagctatccaaatttctccttgctatttaagaggaagtcactttaaacaagaacattcttttacttgatgattcaatataagtaaattttttttaaattgttgtcatcagaggtaagagcataatggaaagcatgagaataataacttagcagtcagcctaccttcgaggaaactaatttgtgtgggatttagacaatgaaatataagattcacatcttttattttttcctggcattataaatttaggcaggacatgggggcaaataagtgaatcttactcagatagaagggatcaaatcttcaagtaatagcttaaaatagcctgttgtaaaatagaatttattgcttaacatggtgcgttaaatggaaactcacgtggggcagcagacagcatgtggtctggagagtgaattgtggatcatggaggccactcattaaacatgcaaattcgactgtgtaaatttccttctctgcacatcctactgattatttgtaaaatgatttttaactgttatttagagaactaatgtgcctgcagcaaatgacacctagcagatattcaataaatgttagtccataaataataatatcatatgtaaaatacccaggctagtgtcttgcataaagtaggtgttcagtaaatctatattattattatcaacatcattatcatcatcattactcctactacggaccaacactacactgggcagtttcatctgatttgatttctacaaaaagtctatgaggaagtttttgttttgttttgcttttactaactgtcttgagagtcttatagcaaatatgcagtcaggctgagctttgactctatccattcttaccataacccttctcatagaacaaaatcatggtgctatagctccaggtggagcacaccattgcatactaaatacatgaattattttttcaagataacaaccacttttaaggtaggtatgacttcattcatttctcattcactcacatcagactaaagcctgtgaagctatgttaaaataccttaaggcaggcaaagaaatccaaagtacttcttctatttggtcataacttacacaaggtacctcttggccatcttattaaggatgcctttagcagggatagaaaatggaatttattactcaattttctatccttctctaacacttaacagccagacacaaaataagtattcaaagagatgttcaaactcttctaatatttgtctagatggtcagttctgtgaagacaggaccattactcatacatctttggtatggtatttgcaggagtgatttgcacacagcaaccgctaatacatgttttcccttatgtgcaatttttcagctatcacaaaggtaaacttgtgagagcttcattcaatttctttttctttttagtttttaatttactgtttatgattgtgggctactgaaggttccaaaaatatttctcttgaatccttgaaggaagcaaaattctctaatatttttcccccgtgcattcattttctctttttctctttcacatagacacacacatattctctctcttcattctctcttatttctatatgttgcaatatatgagtgtttgtgtgtgaatttgtgtgacatatactgtctaagttggaaagaaaatgttgctttctttccaaattaaagagataaatgtgtagagtctggaagtaccacaaaaatagctgccttgactcacaatgtctctactctgaaatataaattttgttctgaagggaattctcttttctgtctcaagtaggcttctctccatatatacacacataatgaaatatgtggaaattctaaagtcttcataggaacatgagagatcattaatcttgtattatcttggcaaaaatggagatgagaaattatttacattgtgggctgtggttcaaggtaattcaacttccaaaggattgaattccagcaaatgcctagaaaccttctttttttttttaaataattccatattaccccatttattttcttatgaatttgtcagttccaagtataatatacagcatttaatagtctcgttctaagatgatgaaacaatttctttatggtgatgtttaaagtaattgtgtttgatttcaatgggttttatgaatgtagtggtctctgtaaaaagaaaaacaaacatcatgctggtaacacagattgaggttaaaggaaatgacacctaatgtgttggtacatttagttcacaattatctttcaggtttcttaaagtttgcatgagattttcatatgttatatagtagtattgtatatctttgttcccaattggttctccatgatggtacagtgaagtgggtaaagcaagtaagtaaattagactcagatttagtgacttgctttaagtctgccatttctacctcttattgactataagacccacatatgctgatccgtataccaaatgtgctttccattaaatctaggataatgcttagattcgaaataagggagaaaggacagacacaaatggaaagttgacagtaatttgttcttggtggttgttcaataaatattcatttaatgaggagagcatcattactgtaagaatgcatgtataagaggattcttttgtatagtcagtatctcatagtgcttgtttcttcttttgcctcctgaacaagactgggaagagaaatgagccaaacccgtgcaagcagaggccttcttcctgataatggattaaagcatgcttagacctagtttccaaggatatttgaaaactgtcatgcaagcaaatgtccaggggtcttggcattagtcattcaaagctctgaagtatgagtgccttttataatgaatgggaaggaggaagttgacttcaagaaccagaaatcttttaatctaatatggaggactaggaaacagcaactctcagctgttaagggatttgtaaaattgtccgtctggaaatttacgcttatttgattcttgttcagtatttaacagagtacatatttataatgactatgcttatgatacattaattttggataaaaaagtacaattagcatgaagactatattgcattctacatttcttaatttaccatcctaaagaaagaaaacctggccgggcacagtggctcacacctgtaattccagtactttgggaggctgaggcgggtggatcacgaggtcaggagattgagaccatcctggccaacatggtgaaaccctgtctctactaaaaatacaaaaattagccaggtgtggtggcgggtgcctgtagtctccactgctcaggaggctgaggcaggagaattgcttgaacatgggaggcagaggttgcagtgagccgagatggcaccactgcactccagcctgggtgacagagcgagactccatcttgggggtggaggggcagggagaagaaaagaaaacctaactattttggtcacaatagcttcctatttggtggcaagataccataatgatggaaagccttggatgaaaacgggagatttatgagttatacgcttactgataatttcacaatgtaacacatattaaaagtttaaaatgcatacgtggatgtacacctgacatagtactttctgtgaaccttgaagcatatataggagaggaaaacttttcagtcaacttttctataaaattagaaactttgtaattatcttacctcactcagaaggttgtaaagttataaaaagaagtgaaagcgttatataacacattatattcgtggcttctttttaggttatagatgatacctctgttgattcaatataatagtcccgttcctgctcatgtaatgcactggttcttcaacttgagtgtatgtctgaattacacggaggatcagttaaagtgtagcttctgggtcttgccctcagagtttgtaattcaggtgatgttcatattgctggtctggagaccatacttggaaaaccacttgcttagtgggtcattgtaatgctctatttctctacatggagtccacggtagtattccagaggattctaaaaacagtaagagccatgatacaaccttctgaggtgttaccagaacatttgccaagctattttatgtgaaaaaaaaaagtaatgttgacatattaaggaattaaatgcagaagctgcatgatatattctgggaaaaatgcaagacctcacagttgttccaaatctataattgtctgcttctccctgtgaaatgtgtcatctaaaggacttcctaacttgctagagcttttcaaatgtttccaccaaagatttttaaaattagaagctctgtcatggtaagtttcatgcctatttgcctaatcttgaatccccagattctagcactctgtcttgcaaaaacagagcctcaacagtctatggggtcttaggaaagattccttttgttgaacctctctgtatctattaggttggtgcaaaagtgattgtagtttttgccattgaaagtaatggcaatgaccgcaattacttttgcaccaaactaatagttgcctcacaggtaaaaaagcaacaataatggaaccacttttttggattgagtgagataatattctcaattggggctgttgtattgatacattcagagataatatttgaaagtatttactgaatacagatgcttgtaccttaggattacatctcaataaacttatagtaagttgaaaatatcactttgggaggctgaggcaggcagatcacgaggtcaggagattgagaccatcctgactaacatggtgaaaccctgtctctactgaaaatacaaaaaattagctgggcgtggtggtgggcacctgtagtcccagctactcgggaggctgaggcaggagaatggcctgaacctgggaggcggagcttgcagtgagctgagatcacaccactgcactccaacctgggtgatagagcgagactccatctcaaaaaacaaaaaaacgaaaaaaagaaaatatcataagtagaaaatgcatttaatatacctaacctactgtacctaacatcatagctcagcctagcctaccttcaatatgctcaagactcttttttaaaaatgtttgaaattctatttttatttaaaaaaattttttgtgggtacatagtaggtatatatattttgggggtacatgagatgagaactctcatattagccagcagttgggcaaaaatcatctggcaccacaggacatcatagagttttgtctgtctgtttgttttgagatggagtcccactctgttgccccaggctggagagcaatggtgtgatcttggctcactacgacctccgcctcccaggttcaagcaatacttctgcctcagcctcctgagtagctgggattacaggtgtgcaccaccacccctggctaatttttgtattttaagtagagacagggtttcaccatgttgatcaggctggtctcgaactcctgaccacaggtgatccacctgccttggcttcgcaaagtgctgggattacaggcgtgagccacctcacctggagtaagccaccgcacctggttgtttagcttcacaatggcatgactggctgggagctgctgttcattccctcagcccagcattgaaaaacagagttatatcacatatcactagctcaggaaaaaatcaaaattcaaaaacaaaatagtttctactgactgcagatcgctttcccaccatcataaaggtcaaaaattcataagttgacccgtcataagtcagggactgtctgtatagtaaacgtatttgagagcttactctgttccacataactatttaattactagttaattagtaatgttaattattacaagttgatgtgtattattccatgttcagttcttcatgtggggggcctgggaatccttatgttgaaccagcttatggtgtgctgcttcataagtagcctgtgtcgtccacaatttagaaaacactgctatggaagtttttattcctttcagagacaaagccagtgtgggggatatgccaccaaataaaagtggttgaaaaaacttcaacctaatttaggcttatttatgtctacaggacacaggcgtttatcaaaataattaatctttttattattcgtataatattagcaactatattcttcattcatttctacgaatacgaacacacattcacacaagacataccctaactagagggaattagaaaagaatcatagaaacattacaaaacataggtttaaatacttacaaaaataaagtttaagctgttatctttcacaatttcccaggctcttctgaatgtttttcagtgcttgacccccatctgtcctaaattgtaactgactgctctttagaatgcaggtgctaattaacttcttaacacttctttgtatcatcctaaaagcccagccttcttgcttctgtgccttctgaagtgtctctttgagttgtgttgttaaagaggtgtatatcccatagcaagttcatattacttttgtaccaaaaataaaaaccaaaaataaaattctaagtcccccgaaccatctgagtacctgccctcctcttggccaagggcattccaaagttaacctgaaaacactagtttaggctgtgatgggaatggggagctggacaggactctttatgccctcctcccttttggaattactgttagaacagactctttgagtcttatgagaagcattcacaatgtattctctctgaagcctgctacctggaagcttcatctgcatgataaaactttggtccctacaaccacttaaagtaatccaggcattcctttgtattgataataactccttcaaccaattgtcaatcagaaaaattttaaatctacctatgacctagaagccgtcattttgagttgtcccacctttctggattgaaccagtgtaaattttacatgtattgatttatgtctcatgtctccgtaaaatgcatagaaacaatctgtatcccaaccaccttgggcacatgttatcaggacctcctgaggctgtgtcatggttgggaccttaaccttggcaaaataaactttctaaattgattgtgacctgtctcggatacttttgatttacagtaattaaaaacttgagataacataatgcttttagaaggatgtaaacatctttgcctctgtcctaactcacaattagctcttttccttgggttaatatgtgaagtaaattcctgtcctgaacctctgagattccaagttggtttccattgagtcaggcccagagatttgcattataagcacagctccttggaggattctagtcctggtagagaaaccattcatgcagagcagagttcttctcacaccggatggatatactgctctgttttctgacatactgtgctttgtttgatggtttcaaaatatgtacggtgagtgtctccacattctgattttcaggtagctactgatttctgggttttttttttttttttttttttttttttttgcatatagaacaatagagcatagcaattaagtacatgtaatttactgttagtcagaactagcttctggccacagaccccacatctgttgattattgggacccaggccagtggcctcaacattttagctttttgttgttgttgtttttaacaattaaggttttctcacatttcccattggttgttttcattttgtgtgtcctattttatgttcatctttaaaaaatattattattataaagatcatcaatgatgttctaaatgcttcttaaataaatatttatttgttacatcagaatctaccatgaaaacatttgcccatattttgaattttctctttaagatccttaggtaggctgggcacagtggctcacatctgtaatcctagcactttggaaggccaaggtgagaggattgcttgagtctaggagttcaagaccagatcctgtctctattaaaaaaaaaaaaaaatctgccatggtgggattacacacctgtaatcctagctacttgggaggctgaggtgggaggattgcttgagcctgggaggtcgaggctgcagtgagttgttatggtaccacggcactcagtttggataacagagtgagatcctgtctcaaaaaaaggaaaaatatacttattgtataagtgtgtgtgtatgtgtgtgtatgtgtgtgtgtgtgtgtgttttcctggctggactaattattggggtgcttgcttttataattatgccataaatgtctatacaaaaacacatcagtaattgaatagatgaatgaattaaaaacatttatcgagtacctatttatgcctatcctcttttggaaatctgaaagtgatttgaatataatttagtctcatttaagtctaaataagataattatatcaagtaaataagtacttgtaccagaaacatagaagctcctttatatttgatggtaattattagtattctagttacagactaatatttgacagtaaaacaggcaattgacaatggattagaaagggagattcaaattatgtggcacactcttgaaatttagtgagtttcaatgtagaaaaccccaaccatgttgggcacatgttgtcaggacctctggaggctgtgtcatgggtatgctcttaaccttggcaaaatgaactttctaaagtgattgagatctgtttcagatatttttggtttacagtaattaaaatcttgaaataacatactacttttggggaaatctatacctctgaaggagagtcatttgtgaggttctttgtttactgattatcctgatttctaattattttcttgggagttctggaaagctcctcaaggtaacttctcttcctatatgaaatactgttttgaaaacatttccctggagaatctaaatacaagaacagctcagattccactgtttttagacatttcccaatgctcctcacttcacacatttacactgaaacatgtacaaaatacttactgccgcatttttctttccgcctggcgaacagctgtaaagatattaattgtgcttcggttataaatggattgccaaaagggacagaacgggttgtgtatctcatcagcatgccctgtctggtataaacaatgagacaagaacttggtaaattggaaatttgtgataaaaacaagatgtgatattatgaagtcccaccagttctttcttctagatacatcgatttttaaggcactctgtgagactgctaaatcaatgattgtcacaaaatgttggctaaaagggctatattactggagtcaactacaaattagcccaaagggtaaacataaaggtagtacaaatgttaaaaagaaaaatgtcgcagctgttgtaaaatatagttggaaaggcacagctgttagaaaatgtatatggtctttttctccttttccatctaagagtcttgaatatggcaactaggaagaattgaaaagagaagaaacagaactgaattgagtgcaggacttcattacttgagttattttttaaataatgtcagaattttctttgatgtttcctcaaattattcttgtgcgtctttcaaatctgctaatttttgcttttacctttcataagcacctagtgaagttgctatttcctagtatggcataatgattaaaatttaaagaaattttaaaaattattgatattgctaaatatgttgcatacatagatttgtgcactttgagttgcatttcaaatgaaacccaattttgtaagaagtcttcaatgtaatgaaatttgaggattggggaacaaaacagaactcatacatgtacacatggacacatacattgttcatgtactataacagtcaatattgtaaaatcacagactacctttgaagttgggctattcatcatgtcactttatcaggaagatttcctttacatacctccaacctgccctccacctttccctagtagcaggtctcagggtcaatcttctctgcacacccaccactcctgcaacacgcctaggttacagtctaggcaataatgtttctttctgtgcctctccctggtaggctgtgagctagctccctaagggccaagaaggaccggtattcatcattggtactccaagaccaggaacagtttggtggcattcagcaattgagaaacatatatagtgtgagaagaagggactaaggaagtgagaatacagagaaagaaggataccaataaagagaaatgaaggaatatgttgaataaatacagcatctattcaattttcttgctatcatttcattagattacttaagaatatggtctgcgtcagattcatcagcacatcttcagggctgaaaacataatcagttcttttctttctcttatctcactctctctccctcctcttttcatcctcccaatttgaaagcctccagatattggcacaaccttaatcattctttgtaaacccattgcttagcctttcacatattattttgtgtttgccaagattttaattatgtcacgtagagttttcaatacattttttaaacaactctctctaagcatgcatgtaccaaggtctcactacagattgagtcccctaatctgaaaattcagaatttgaagtgcttcaaaatctgacagtttttgagtgctgacatgaccccaaaaagtggcaagttccatacttgatctcgtgtgataatgtgataatgtcctcagttcattatttcctctataggaagttttcaggagcttaagtgagagtttaatatcatactagcctccgtttgaagctaattctggcttatgttgggactgggttcaactctaagaagacaaggtcatgactacccttttaagagtagagaaaacccttaccgttattctttaataaattcaaaatgaaaagaagacaaaacagtagacataacacataattcagaacatgatcaatgtgctacattaatctctgaatatcttccaaaagaaaataagctattaattctctcttatttatatatttacccaatgaatatttctatgcaaagcattttctgaagtgctagggagaaaaataaaaatactagttcatattctctgcatttgaagatgtaaaattcagaaacattatagtgtttgtgtagcagttaaaagggcagatttgggagcattctcgtgtccttataaattcaggctttattccttctgtttgaattcagatattcatagcagactcagaggcttgttgcaaagattaaatgaataaatatttcatatcaggtatagttctcagcacttgtataacaaggacaatgtagattcatgcttataatttgaacaaagtgacggagccatgttatcaaggaatgggttaattctggaggggaggatgagaggggaaagttgagagaataagaaagaatattgttcctaagaagcttttagtctaaaaggggaaaatctgtatgcactgcaatttatatataaaagtaaaaggtgcccctagagacaatcaagtaaagtattttgagagttcagaagagggaatgattcaacttaggaatcaactaaatctggaatctgggtcagattgagctatgtggatagttgtggaatcacagaaatggagtgagtagtgggtaaataaagtagttgggaatattacaaagctctgggtaattggtggaaagggttgtttaaaaccctttactaactttccattctcctaaaataagctccaaactgattagtcaaattcatgggtacccttctagatttgcagccccacctgtgaacattgacctgagattatctttttctgcctgatttcaatatcaaagtcccctcataccaaaaactttgctttaactgtttatctgcccctcctgcattcttcagtatttctgtgtcacccactgcatttgatcacatcatttagtagctaattgttccattttggctctcctactggtctacccttgtagaaagcaagaatcttctaaccgcagtttctgaagcttgacacagcaggatttcaattaaaaaaaattaaaacaatgaagggctcaaataggagattagcctaatttacttccattttagctatgtcattgatggcggcatgtataggatattatatttcgtgtcagttagtaaatattttttaaaaactctgtgaactcatagttcttgtaatgattgtgaaattaaacctttttcatctaagactctcattcctcagtagctcagtggctcagtggcttttcactttgtcacatttgaaatttgataggattttgtctctcacattggaaaagggagggtaaccccagctacactattattatgttttaaagtcctggcttttaactagaaaagtaagctcattctagagggacaaaaaaaacgaacagccactgtaatgcttatatctctgttctcatgcatcttggccttaaatttatactttgttaaataaaaataaagtagcttgctctggagagcacagagtgtgtctcaaccaaaattctctcacctggagaatactgattgtatgttatttttatggagcctcagaataagaataggaagtaggtggtactattctattttttaaataaagcaatggagtcttattgatgtaaaaacattctcttcctgtgtaagggtgttaagtcatgatgtagaatatgatctcagtataatcaaataaagtcaacagaaacatctgatattataattatataatgtgtatatatatatacacacacacactatataattctatgtatgctacaattttatatgtatatgtagtatgtatatagtgtatacactatatatctgtactttcaattacatcatgctgccttcgagaaaatacatttaatgaagatttgcagtttcttacaataaagagaaaccaggtgaaaacactgctaaagtaaacttcaaatgctattaggagagaaagtctagctctcttgcatattcttataccctttgcatctaagttggtgcttggcatatagtatatactgtgcaaatagccattgtgtgattgaatagattagttcatttactcaaatagaatgaattacatttcttttttttttttattgagacagggtctcactctgtcaccaaggctggagtgcagtagcatgatcacagctcactctggcctcaacttcccgggctcaagtgatcctccaacctcagcctcccaagtagctgggactacaggtgcacaccaccatgcccagctaatttttatatttttgtagagacagagtttggccatgttgcccaggctagtcttgaattcctaggcttaaataatccacctgcctcaccctccaaaagtgctgggattagaggatgaatgacatttctacctgctgtagttgtcacataccgtagaaggcatctgggcatctgtggtgccaccagtagcataatttctcaaagtcagtatggatatcgatagctgccagtctaaagcatttatggtgctatttagttctcaagcatttacaggatttcattccataggtaacaaattagcaaaggtttgattcctgggaataagcagcccatgaaaagaaaatacttttctttttctgttgtattagaaatagaaccgccccaattccaaaaaggtgtatttatgcacatggaactataaaacaggcagcttattagttttcacaaccaggcctccaattgccctcattatctgtttgcaaaagcagtgggtaggctaccatgctagcattgtttgtgaaggatacagaaggtagttcccctctgtgcatataaacgtgtctaagattctacagttacacattttcatatgatattttccatttctctcacccaatgcacattacagatgtttgctggaatgatgcatgggtgaatagaagacatccgtgtgctcaaacacattttctaaagtgtttaattgtttcagaaagtttcaggctcattctaaaaacacaatgttaagtgtgcatggatgtttcattaagttacaaaattgtttggttccctaaattctccagaataaaatatgtaaactgaattttatttccccggtttatgtcccaaatcatggagccagagaaatgacaggatacatttcggtgctgtccatccgcctgactgcagttaagaatctgtctccattcccataataaacttaatttggagcatgtggaatttggcagcaacatttcactacaggctgagagttggcacataaggagaacacccagtgagcagcgagtaggcctttgcaaaaaaagaaagatagggaactaatcattgaggattccattgtgtggtatgtgtcataaaagagaggtttctgaagcaaaatggcaagcacatgctgcctctgcctcttattcaactggcttttctaaatggcaagactgattacccacaaaagagaagggtttgatcttctgttatcagcttgacattactcttgcagttaaccaactgtaattcagagcagaagttcctggaaagaattggaatccctgtcttcttgcttgtagttgaatggtcagatggtaataattcagtatttatttcccctagagcttggctggggatgaaatctccatatccagggttaaaaaagaagccctaactttggctgatccatgtttaatcctcctccccctgcaaagacacgcctaagttgccccttggaggtttggatatttggtagctaatagcaaaactgaaaaatactggtagaatttagggcatgcttcctgctgggggaatttgcttgaggcccttcaagagaaatgaatgttgaagactatggtatcagtcagagagatgcaaagaaaaatgaatgcatgggctgcatacacttatttctcagctttttccttcagcacatcaggtcggtgctctgtggtaacttggttggggaagcagtgtgatggggagggggtggagactttcaatcaaccaaccaaccaaccaaccaaccaaccaaccaaccaaccaaccaaccaaccggacatccagccaaccaaccaaccaaccaacacacataaaacctctagaaatatgtgacagtcagtacagaagtatcccagagcatttttccataaaactaataaataatgaattctgtctgacacatttaaaacatccaggaccagaagcttctacttctagtgaggaataatttaaacatcaacaagtaatgcaggccttatgaaattattgctctgctatacaacaacccaaaaaaggttgtcatggcaacccctgtgctcccaacacctatttgtattgcacagtacttaggggaattaataaggatgagaggagttgggttgagggctcagttttattaaaataaatgaacgcagttgcatcattgctatgaccttttaggccagtgatctttgggatgcatgaatgtttaagtaagacattttcagatgataatgccaaacactttgtctgtggattgtacatactgcacttggaacaggataactagcaggtcaaataaaaagtttgaagagcatagtagaagaccaagaatgtgcattgttctgaattttagttattgcaaaggttctgcccctttattttcccacctggtattggaatgctgattctctaaaaatgtattgcaaatgactctttgcaaatggaatttgtcttcttctgatcataagagttttagcttttccagtgggcacatttttacgctgcaccaaactgtcgttttcctgatcagggtgtcagcaccagcatttttctttctgaataatgtgcagaattggtgtgctgacttactcataaaaaaaagtatagcctcgctaacacagctgcactacccaaaccccaacatctcattttcctgaaggtctttcatcttagtttatcagcaaactggaacctccaccccgacagtgtagcatctttgatggttaattttgcctgtagtttttgctgttattatgtggaaggggagaaaaatgggtcctgctgctaatgggaggaaactttcaggtgtggcaagaggcacatgatactgtaagccttttgttaattaaaatccgagcagcacattggcaaatttcacttaaacgagtgaaacaaactaaatgcaaaaaagaaaaaaaaagtttgtttaatgcagaattcaccttggaattgatgtgttcatactcggcttgatactagcaggctgaattgtggtgacagggatcatttttgttgacaacagctggaaatacaacagctatattattataattaggatcagtatcaagttggattataataggggctttcttggagaaatggcacagtgtcaaatttatagtcactagctaaatgagtctcttgtatccttgacaaagggacaaaaacagttccaaatgaaaacacaaacagagaatcctggttgttatatttcctgggtattactcagggtcctatttatcacacaccaacacttgcagctttgaagaaacattatcctgcaaggtttacacatttcaatttgccttcgtggtctgcattctgtatgcatatccatggagaagtgtgcattgctgcttgactagcaatcttttctgctaaaagattaacctcgaaacatccattttttcccccatgggcaatcacttgacaaatgcacccacaaaacctctacacacatctattccagtgtacaggtgcatcaacagtcttgagtcactattaggagaaatatcgtccttgacggaaagtagtgctgccttttcattttcagatgtctaaagctgaaggatgtggatttccaggaagccagacatcaggcagaaatattctggatgagtacatgggtaaaagcttgtcttagctctgttgcagtccccagcccagtagttcatcttggcatggactgggagatatggcattcattcaaaatgccatccattcaaataacaatgagaaacttgtactgatgatgtgcccggtgtctagcctcctgcttaatgtataagcttttacatagtacacttttgtttataaaatactttttatttttgctctcagagcaattttataccaaagagaaaggtgatgtgagatagattagtagactggatggaagaatgagataatgagatactgtgtgtgtgtgtgtgtgtgtgtgtgtgtgtgtgagtggtgtttgtgtgtgttttcttttgagcagttttactaacaaaatcactttctttctaagcgtgtggatatattgctacatttgagattgtctttttgtgtttccccccaaatttaatgaaatctattgtcaaagccattatgcaaaactacacttaattataaattaaagcattcactaccatctaaaattgtaaaagattagtttgttagttttacctgtatacacacataatataacaatagtgacagtaagctcgtagtgtcaataactcttctgtgctctttgcatacagtaatccatataattatctcaccaaggctatgatgatgtaacaataatgttcaccttcctttttaaagattagggaaccaaagcttggaaaacttttgttacttggccaagaacacagagctagtaaatgttggagatgaaatgtaaaagaaatgttctggttgaagacattttgactccacatgtatcctctcaaccacttttctatacttcatgtgattacatgtgatcctcacgcaaaactttgaggcttgtagaataaaaattgtttgtctttgcatatgaaaagctgaatcacagagcatgtagaagatagaaacccaaccccttactccagcaccagtaataacatgatgggctgcctctcataataagataagatcaacagaaatagatatgttcatcatcagtcttgtaagctccagagaaaatatcctatcttccatttaacaggaaacagtttgcatgactatggagtatgaaaaaagaatacttcactttacaaacgaatctgaatagtagttcttcaaagtaatcacaatagaaattagtgtctctagggagaatggatgaagctaaattttaaaaagtttggtgcacactacaggcatttttaactattattttgtatcaaactgcctgaaaatattttttagaaatgtgtctccattttattattccatagatctggaagggacattaggggtctgtttttcagagggtaaaacctaatacagagacatttagtactcactggcttagcatgttgttatttctgtgataggtacctacatatattattttgtttaattctcacaataaccctattatattttgtagatttaaatctgaggctaagacaggttaaagtatttgctcaaagaaacagataagcgtttcagaagacgtcagaactattttatgttcaaaactgttaaccccatactactctgaccaaacgcacgaagcctgtgcataaataaaacaacacggtttttcagaaaatatttggatatgtttttttctctgtgaaggcatttcctaatttaagagtcacccactagaaggaaatttggtaatgacaggaagttttgacaatttgttcacttttctttttcgattacatatgcagtgactggaactaaattctcagattcattaacttaatatcatactgaatattacatcttgacttattttttttttctgataatgtgttacttcacaatatgggaacataatttctccttaaaaaatgaaagtgaatacactagactacaaaacaaagcaaaaaaataaattgttatatggtcttctacatgaagagacatctttctcataagtctctgaactctgttagttctttcggtaactctggtgtctttttcttattattcattctttttctttaatttttggactaattttagacttacagaaaagttgcaaaaatagttactacatacccctgtcttagtctgtcttgtgctgcttataacaaaatacctaaaacgggttaattaataaagaaaaaattattttcgcacagttctggaggctgggaagtccaaaatcaaggtgcagcatgtggtgaagcccttcgtactgtcatctgaagaagaggaacactgtgttctcttatgatgaaagggagtttgtctctccctctgttaagctcttttataaaggtgcctaatcaggcactgaaaggtggctcacacctgtaatcccagcactttgggaggcagaggtgggcagatcacgatgtcacgagatagagaccaccctggccaacatggtgaaaaacgtgtctactaaaaatacaaaaattagctgggcatggtggagcacactgtaatcccagctactcaggaggctgaggcaggagaatcgcctgaaccctggaggcggttgcagtgagccaagatcacaccactgcactccagcctgggcgacagagcaaggctccctctcaaaaacaaaagcacctaatctcttgtgagggaggtgccctcatggcccaatcacctcttaaaggccccacctcttaatattgttatgttagcaacacctgaattttggaggagacacatccaaaccatagcaacccctgactcagtttaccttcagtttaacaccttaccacaaagatcaaaacagggaaattaacgttgatatccacttctattgtcattacccagtgttaatgttttatcctctcttaattgaactactgttgtaacctcataacaagtctggtctcctaatctgtgtctctacttccaattaaatccggaggccctaacagagagagtggcccacaatatgggtttgctctttaactgaaatttcttccatatttcctagagggtaaagccagtgctccccatcttggcatgaaaattcccctatattttcttcttaatttcatgtccaggcttagctttggtggcagactttttctgtcctgtcatccctctttctgagtattttttggcaattttatctcactatcttccttttacctagaaggttttactcccaattcttctgcatcttatgtaatactcaaatagctacaactattgtactctcatgtgttcatttttgctagctagttgatgagttacttgcatctggtggaatgtgttacacaagaggcattgagttgcatttttttataactgcagattttgtagaacctctgagtcatcattctgagtagaaattccaattttacaggactatcaactgctcaacaaatattattattatcttttcacttggagtgactgtaattcaaaacacttccaaaagatattgacggactagatcttgctaaagttctaccctatttcagtaaacactgaggtatgctgcttttcccctagttgctgctgagcatgttgatttctgacagcccaacaccgatactccctgccaccattttgtagttgtcctcccctgaagggagctgcttgggccaagactaaggctccgttctcagggggcatcttgcatgctgtaactgtttcctgctggaatataaaagcttggcccatttcctcaacgggcatgccatctctagagccctatggagtccaatgaggctttcgttgtgactgcatcacatcccagatgcttctgtccagttttgtccttttcactccccccatagatattgatttaaaatgctctccagtgaaagtttagcaagaagtctttatctcagagtctacttccaaggaaactaatctgtaacacctgcctgctgtttctcattaaatcgtcagataatttattcactcacccatttattcaatgagtaaaggtatattcaataaccattatgtttccagcacttgctgcatgaagaagacattggccctgacctcacagcatgtgattcttgttaccacaccagactttttcaatttctttccattttcaggagttcccagaacttcccatagtctctcccactactttgccttttcttatgtttatgttcttgcttagaattccttctcctggttaaactctacctttctttgatgatttaactcaaaggcaacctctgttagaaaatgttcctgatcaccctgtctgtgctggactaagtgagagatccataattggtgctactgcattcagctgaatttccttctctatttgtttgacccttcctcctcttattccccctcgaactgcgagctttttgagtgtaaagatttgttgtgtgtgtgtgtatgtgtgtgtgtgtgtgtgtgtttgattatttacatgtctgccaacaatatacttggggaggcaggtggaagttattttttttaatggcatcaaaatgtatagagatttggttgctctttaaatccaaaatgtataggtttgctctttaactgaaatttcttccctatttcctacagggtaaagccaacgctccccatcttggcattaaatttcccctatatttttatatatatactccataacaggcaaactgtatatgctcaattgttgaatgaatgagtgaataaaaaataaatttgaaaaaaaggttatgattctgttatccattatgcctaattatgtaagcaagatgattaattggtgactcagatctaattttatattctgaataattaaacaagatggtataaaatattcttttgatatttctgtacagcttttcagcagccaatttttccaggtacatttagttgtacttttgtaagacgtaaatgtgacatggtatattatattattaaccttatatttcatattcctttgttaggattcctttgcatattccccaagcctgcatgcttctaatacttatctttaaaatgaaagctacaaagtaatcttaaataatacagatactaaaagtatctttatatagtactccaggactctttcttttaaaagacttagatattgttgaagttatgagagagcagtttatcttcaactttttaaaaagatttcttttccttttattccctacacatggatttctgtataaaatacttgacaaaatgtagctcttggcaaaggacaatgtgttaattattatcttttttctttctctattttattaggtacatctgtcactaacgtcactgcgaccgacgctgatgacccagtttatggaaacagtgcaaagttggtttatagtatattggaagggcagccttatttttccattgagcctgaaacaggtttgtggcctaaatttcgaattatatttgccatgtttttgcttcagggaaatgcttttcttgggatttgggttatgaaatattatgtgtaagtacttcactgcctgcatcaataatatttgaatatgcgacatgaggtacacagtgagccctacaaccatttttgatgctgattacgacaaatcacagagcatttgtaggatatcacctatttaacacatgatctgacaccatttttcatcctggaataaagggaagaatgtgcttatatatcagagaaacttaaatagtagatttaagtgaaaattcagttgcttattggctgtgtgatgcttgaaaagtatctaagttccaatttgcacatctgtaaaatgggtatggaacgtaccacataatactgtgaagaagatcagataaaacaataaataccaaacacacagtgcacgtcatgtggtaatcattcagtgcactttagatattattacatttgctactagattcctccttgtaaaacacaatacatatatatccattagagctcttatgaagatattattatggtcaatattaaatccagctaataccctgtgatctggtggtacagattttataagccatgaagtaagttatctaacaaacagcctttttaaaccaggttaaaaaatagctttataaaaataagtttttaataaatgaagatatatgtttttaatgttttaatttaacagtatattaagagatcaaacatattttgtctgacttgtaaatcctgtgaagttttgttgtagcacatttaaaaactattattaagaacaattattgtttaaaaagcaattttttttgtatattttcttctatatccagtggtattgtatgtaagtttccaaatagaaaaattcaatgtacaggcacatatacatatattattatttctttgattcatgacttttcagcgctgttgagataaatttctatgacttaccattaattcagttattaactaaattaaaaatttaaagactacccctgcttttttcttttaaattcaaagggtaaaatcttaatacgtttaatactgaggaaaagtacatttatatataaataggtcagggcgtaaaattgaatttagatttggaaacaggaaagaactcttgtaaaacacattaattaggggtataattatatatccttccgcagccaagaaggaagtctgttctaaactttttctcatttgggtcccttgatgatcctgaaatggcagagcaggtggctgccttcaagtttgagatgtcctataacttggccaaagttacagtggcagagttcatagcagaggtgggactcacaccctggttttttatttcgatactaatgtcaaatttgttttgaacttcagtttaataggtaataactatggcacagggtcttctgtaagacagaaatgtgttagatgccaaaatggacctgagtaatgttctcttcttggccatttgttcaattgggtctttttgttcaccattgccactgcaaaatagacattaatccagaaaatacctattgacatacctatacacattcactgtgtgccaggcactggattaaatatagggagaaaaaaatcacaaaggctaatctcagtctacaagtatctcataatccatttcaaaagacagactttttccaccataaataaaggtagcatggtaatgtcatttagataatttgtttcttaggaataaattactataaggtatttataataaaagccccctgctaagtgagaggatttggacaattataagtttcagtgatatagattgccatttgtttaattaactgttgtcagcaacatttaatatttacatttttattcagcataatgtgtatatatatcaacacaaactcattttagttttatcacttccaatctgacagatatcaaattgtctgatttatagtttagaaagtttatttggcattatcgtggatagtgtaatggagatagatgatacttgaagaattcacagaatattttcttagtaatgttgggtgaatgaagttgaggtttttaagtaaggtggacacaatttaaataaaaatagaagctaaattcaataatcgataaaagtcagactaagttctttagatgaaacataaatatgtatgagtggaatgtaaacatttttgggtaaatgtctgcaaaattatgcttgagtgtgttcaaatgaaagcagtaagtgttagttgtccctaagaatctaaattagactctatctttgaggacctctctcttaaaaaaaagaattgagactgataaaatgtgtgtgtgttttaaaggaggttatacaagctaagcagaaatagattaagaacattgtttaacattttttattagaaaaacaagaaaaaaagaggcaatggccttgaacatttagattttaaagtctgtaagcatatggaaagcaaataccccctttgtggggaacaaaagatgtgtattagttgggtcctttggaaaatagaatgctgagacagagatagtagtgccaatggcttattaggggcttatgactgtgaaaaataaaaggggtatgtagccgacttggacatggaagttcctcttatcaaatgcagatcttctacccatgcgatcaaagaggagaaaaagcagtataaggcaatgtagatctgacaacatcttgaccaaaacaatgggacccctggagcaaacattactcttaaaaggagtctcatgttgcacataaacggccaggctttaataaactcaccatgctcagtcattggctgggatgtgcctgtggaaagcagggtcttgacttggatcctgaggtcaagcctaaaggtacttcagctacagggtctcagctaactgcatggaaatccttaaagtaatcctttggcaggaaaatgcaagcagtgggcttctgtgtcttctgcagtgtgtgtgtgtgtgtgtgtgtgtgtgtgtatgtgtatatgtgtgcatgtgtgtgtgcgtacttataaacatatatacatgtatattcacacatatatgtatacatatatacacatgtgtatgtaaatatgtgcttgtatatacacacatacatatgtatatacatatatatttatacatacatatatgtacatgtatatatacacatatatgtatatgaagaaaacaacttttaattctatagatttagcaaatgtgatattaaaaactataatatgcaggaatagcaagtacttggtggataaaccgataatgggaatattaatatatacgttgattttaaaaatgcatgctatgggtcaaaaacattatgaatggctactaattttgacccaagaatccaaattctagtaaaagaaagaaaatgtcatggatgagcagagactcgttacctaagacccacatacctctgagagcacctaataagatggttctttacatgataggtctgcacattacttcaggaagtgacccagcatagatgggttcgaaaatgttggctgaataccattacacatcaccacatatgtgggaccaaccttcagttcctttttacaccaggattctggcatactatcaagggtcaaatctgtagctaaaatgatcgatattgtgacagtgaacagtccctcaccgggttacataaggcagtcacattcatactctttataaagaagattgtccattgaccactgtcagctcttctttgctgttatcatattttcaataacaaaaaataaaccagggcatgagacaataaatcttgtatgtatcttgttttttcctcgcaagaatgctaaaaacagaactctggaatttggaacagataagttctgctctccccttgcttgttacatttcacttcatggaattattttctgttgccataacatatcagagagagcttcttctattgtttcagttatcaccttaagagcacagagagaatataccatttgttctttattttcttctttgagctttaacaaaatcagggttatcttgtttattgacttgtttatattttttaagttaattaccatgctagagtgcaagggtccaggaaagaagggggcttgtatgatttgttgattttgcaaatctatgcattcctatgcctagatgtctggcacctagaagtccttcagtaagtagtgaaggatggaatgagggaaagaggggaaggaaggaaggaaggaaggaagaatggaaggaaggaaggaaggaaggaaggaaggaaggaaggaagggcagagtcagggagagctggaggaagggaaggccgggagggatgtgcaaaagaagcagggaggataaagggaaggaggaagaaagtgcaaattaatagaaagagaaaagcttgccacaattcatagagaagatgtaagaggaaacatctagggaataaagcttggtatccagtctatacttctatctgtttctctgatggaaagaacaccatattaatctcagatatgattgttttgtttgaaattcatttaggagcagcattcatgctttttccaaatctcatactatgttttaagtgtctaggcaacacaatgctattctagtatttgcaaaaatagccttgagaccataataaactcttgctcagatttgcttctagatcatacaaggagatagaaaggttctgggaccactaaacaaagaagaaatgattattaatatatcttcctattccagaggtcactgtgatggtactactagtgctgctaataataacagcaacaatagaaagccaaatcattgtgtatatacagtcttttaggtttgacaaaacactaaaccaaactgtggagtgaagaatttctgtctccattttgcaaatgacaaaactgtgtttcggagagaatgaagtaaaatgtctttctcacctttagataaattcctctgtcaaatcataacaggaagaataaaaagaacagaacaagaactttatttattgaactcttactatgttcttgccattgtgctaactgggtttgcatacattattgaatttaatttaattttttccacacaatattttgaggtaggtattagtgtcatctcacttttactgatgagacaactgagtttgacttgcatgtttcttgcccaaggtgtttgaagcaggattcaaggtgaatctgcctgatcccatacctcaatttttgaccttctcccttgcttcccacttaactttcaagcagtatagttcatacctgggaatgacattggtttgaaaagagacctaaagaacttggaagcaggttcaggcctcctctatccataggtgttggagagacagtgtagcatcagagaaaatggaaggcagtagtaattgtaaaatgaattgtcattcttgtgaatagtttttattatggtacttcaaaaggctgaaaatagtttacttgtattcttaaaatgttttttttttgttttcccctccctgccacccccaataccatatgtttgcctgtaatattttgggcacagacaaggagaaatgtggcatttatttaaaaggcactaatttgaggacagcagtgagaaaacagatgcagtccatcctaggtgattgaagatggaaaatctaaataaaatgcaaggcaagtgaataataaatgcttaattatctaaagagaccagggtaaagtttcagaacagcctaaactttgctccaggcaagtgagagtatgaaaaataacctgcttaaaaataaactaagttaattcattgacctttttttgaaactcagaccatttttcttcattgggtacaaacaacatttgtctctgtggaacctgtaaaaatgagctaagtaaaaaatattccttgggaaaaaaaatccatgtaatgaatggttctttcttagaaaaatcaagataatacatggagtcttcatggaatgccttcatggaattgagtcctttttatgccttcggagtcaaaatgataaattgcttacacacagggcctctttttaatcaggattgcatagattataatttccagtgccaagaggactggctaaagaacttgcttagtgaagacatttcagaaggggtgggtactgagataaactcaggcagatgaacaatgctgggatatacatttataggtgggaatgtcttcatacttcacattattcaatgcttagtcaatatctacatgctgccatgttgtgggcactaagattgaaatgctgtgtgtgataaatactacacataatatagggttcatgacatagggatgtttgctaagtgccaacttagcaaacatgtatgaagagcaagaaagtattttttagagtagtgataacagagaatatgtcctgaaaaactaatggtagtttaagaaatgaaaatgtggggtaaggggagctattaaataaggtcttttggcatgaggaaatcaaagggctgtgtgctcaggggaaaagataaattggtgatcagggtgatattgagaaattaaatagttttcattttctcaatggtattagaagattttacttgaagaactttttcgatatataataaacgtaatctgcaatttagaaatccaaacgtaactaatttcagtctgactttgaatgtgtgctttcacttcttgtgacttaagtacccagtttttatttttattttattattattttttgtcctctcctaatcttatgttgaaatgtgacctccaatgttggaagtgaggcctagtgagaggtgtttgggtcatggcggcagatcccttatgaatgatttggtgccctcccctcagtaatgagttaattctcattctattagttcatgcaagagctggttgtttaagggagcctggcacctccctctctctttcttgctccctgtcttgccatgtgacatgccttgctccctcttcaccttctgccatgagtaaaacttcctcaccaaaagccgggcagatgctggtgtcatgcttgtagagcttgcagaaccatgagccaaataaacctcttttctttgtaaattacccagtctcaggtattcctttatagcaacacaaaatggatagtatataagtccacttgtacataattcttcattaagtacgcaatttttaagagcactaacactgtcttctagtcattcatgatattgaaaaaatatatgtcccattatttgcttttgatcttcacaaattaaggatatcactaatatcattacttttgttatttttgtttgtatttaatgaaacaaaatgtgatatttgtgataggacattttcacttagaagaaccaaaagctcttgcattgttggtaggtagaaaagtccttcagctgtgttccacacaaaccacctgttttcatttaaactgctggatttggagttgaaagtttgaaaggcaggagtgacatgcagtggaggtaagattttgactattgctgggaaagttacatcataggagacctagaacctctttccatgccaagtgctgattaaaggatgaggtagctctaccaatcccacagctgattcactttacaaaatcacacaccccctccaaattatgtcctctcatgaagtgggaagccaggagtggagaggtgcaagggtggctaattctgttacatgtggagtcccttgtaagcctcttggcatagcacaggagttctccctgtaaatattaggcacaaggccaatagacaggaggacttgggaggaagccaaagagtggtttttgtcacctgtggggtttcctcctaatgcactcttcatccaatttcctttttttttttcttttaatgcagtaatgggcatagatttccacatttttggagtaagaagacaggcgggagacaggtctttcaaacacacaccacacacacatacacacattctcagcaactaaagagaaggagaataatatcatatgatactattattgttttaggacaaaagagagtatggagaaagacacttgcctttcttatgttctttgcatttcagatagaagaatcaatattacaacaaaaattgtaggtagcaacaaactgtgctggtggccagtgtctccagtgtctgcttgcactcttatttaatccctatatcaagtaaagtagctattttaacatatcttattaaagatgaagattttgaggatctttgaggttaaatgatatggccagtgccaaacaggtgtcaaactctacatatagtttacaataaatatttgttgggcaaattaatgaattaatacgttgaagaagaataatgagaaactaaagtgactaattttacttgtacctaactttacatctcattgatttgtctgaaatgcccaaaataaatgatgataatgattgtgacgaaatgtaattttaagtttctaataggtgtccgctcaatatatacagatgtatacccccaacaaatgtcatccttctccagtttttatggctcatttcatagttaagaggacagctagctgcgtgcacacaatgacttaacaatcacttattttcccatttgttgtcttctgtggaagatacaatatatgaactaggggctgaggtcatattaattgttttgtgattattaaaataatccccccactccaagcacatagaacagttaaatatacttgggtaagcttgaagtggtgtgatggtcatgttatttgcacctttggacaaaccatttttgaagttcacaaggagctttccagtgttgaccatagctagagtcaaagaaatgtctatttggagaaaccaaggtctgcatatgtgcatgctggatagaaagactatgaactacacagccacctcagtatgtaacacctgatattacactgggatgcgttgggatgggtttagttggaagcaaaagaaaaaatgtattccccagtggcattcatccaatgtgaacacaccaggtaggatcaggattttttctcagctttctatgtatcatgtcccttcagaattaaattgtatatttggttcctatagtgatgtcatttttgaccttggaaatctagctctgtttcatatgactagttcaaaatgatttggtgaagaacaacaaaggtttgttttcattaattttataggaaaacatgtttatctaacagcatcaaagattaaccaatatccaagggatgttaacttgtaataactccttttacaataaaaaagtgtgtgtgtgtgtgtttgtctgtgtgtgtgtgtgtgtgtgtgtaggatagttggtagatatagacagacagacagattgattgatagatatagacagtaatcttttatgtttattgttgtagttccctccttcccattcctataacctaactctgcatcctcagcatttaagactatatggaatatattctttcagaaatctccagtgctcaataattgctttaaatgttatggcaaaagtaactttagatgtaacttccaaagagaaggattatctaatgttcttgcttaacagagagttaaacatcataagtttccacccacctcccataattaattttatatattaattacatatatatatatatatatatatatatatataaaatgattggaagcttacagaagggggttaattaacattggagaccacttttctttaagccaaagttagtctctgatgcatgagtaagaatccactaagagagcagaggtagaaggaagaggaaaatactcaatttgtttcctcataaagtcaaatttcagaaacatccctatgaaataattttctctggactaaaacatgaggccataatttctctttttgtgccaaaaatattgtttttgtgttttttaaaaagagtttgtgccatatggacagggatcttggatggtttcctcactatgcattgcagggcttagaaccaggcccatctcatgatagttgttcaaataatatgtcatgaatgagaaaacaaacacagacagttaaatccagaatgaacatggttagaaaaatgggctttttcagaaggattttgatacatttaatttcagatcccaggagatgctggatttcaaaaatggatgctttctaaaaacttagaatatatcttttgtcatattcaatatatcccagcatctgattattagggaacagtagctatgggattgttgatagtggaccaggaacataaagatgcgcctgtaagttctacataagactagctcataacatttcactagtgttttctctttagatgctttgtgtctcctcttcccttctagaagcagtgacttctcatttattacagtggaatgtaactcttgagtatcccagtctgttttattttgttccaaaaattaagcagaaggtagttaccatttattgatcacaaattttgtgccatttcaataattttcttagtaactatgtgaagtgggtattatggtccttacttttcatgtaaggaaataaaatctctgggcaaattaatttctgagaagtacccaggtagtaaactccagagctcggttttctgaccacttctgtcacatttccacctccgctgaatcaggcttcccatctgcaaaatgtagaggagtctggacaaaggaaaagaagacaggtactctaaacaccttgatgctctcatttagattaatttttaatttcaattaagtgaattattttcaattaagtgaatagatacttattaatcatctccactatcagggacaaaatgtgtggggtagaaatagatttgacttgatggaggttaaagaactggagagatgccatcataaaaatttatgccaaaattataccaattggatgttttcttgcttattatccaaagtgtcataaaggaaacatataaggcaatgagatcattaatttattattatttcaatgattttactttgattttatgaaagggaagtggaaacttaatggaacattcttgaattaccagtatcattagttttgattcatctggatatggatgattcaggaatgttgggtacaggaattcaaaatggagtcatttgcaaagcatattcagtctcaagagaatcagtccttcgttccttaaaaagctatgagactttccacttggagcaaaactctaatttaaaagtaattttgagtttaagtaccgatctgtaggcttacctttttttccccttgcaattagaaaattgcatggttataaaatgaaaataaataggttttacacccattcttttaaaatagatatctgcaggataagtcggtttttcaaactcctatgggtctggtattatgtttcaaataagtgaaaaagacagtttttgagttctcatgggcagaatctaagacacatatggctatataaataaaacaaaggagaagctagaaaagtgatttaaggactatactagactcactttacaatttgtgattatgtgtaatttgccattcagaatcttaagtgtgatagttttattatgagctaggcagttttatatcaccatgaggatcagaaatttggaatttagtaaatcagagattatagtgttcatagggttaacagagttgaactggctggtgaatgcaagcatagctataattagatagttttttttttttttttttttacatatctggagagtttctttaaaggtagttttcacgtgcggtaaagttttattgtatgtgacacagcactattggaactttccttccattccattaactttaatattgttgctgtggtattatttatcttagaagccacctttgcactctaactcctgaggatcttctaaagacagaaattgagattgcctaattgtgccgtttatggacaaatgaattcatgagctgtaaatgaagataataataaatgactgtgtttacaaagtgaaacaaatagcagattttattttcttgctttcactctcagcagagtataaattagcaaccctagacacaaattataatgatagaaaagacttactatgtgtcaggggacagtagagctggtaaaaatatttggtaattgagatagctgggaatgaaccttgctagtccttagtttttcctttaccaaatggggtcaaggaaagaagtggccccatacagttcttatacaattaactttgctctctgtatgactttagtcaattcatttgagtttaaatctgacttgctatcaaagtggcattcttaataaccaggttttaccaactttacaaagtcatacttttaaagtctttcccttatggcataactgtacaagattgttattgatcagatattgataaactgattattgatgtgccacaggtcgtgttttttctcactatacgtaactttccttagttatcctgtaatagttagaagaaaggaacccaccctgacccatcaagtttcattttctatccacaagttatactaaattgcaataatcaaatactagaatcatcataatgaaatctattctgagatcacatcattttctataacattggaaaatagacttggagaaagtgcatttaaaaatgggaattgccttatttacatttcacgtgaactctaaagtaatgtgcctcctataccctggaaaatggttattgaggactgtcatctaaagtaactgaaaaattcgctgaaggaaataagccaaacaaatgctctggtttacatataaacttttttttaaactttattatattttaagttttagggtacatgtgcacaacgtgcaggtttgttacatatgtatacatgtgccatgttggtgtgctgcacccattaactcgtcatttagcattaggtatatctcctaatgctatccctccctcccccctccccccaccccacaacagtccccggtgtgtgatgttccccttcctgtgtccatgtgttctcactgttcaattcccacctatgagtgagaacatgcagtgtttgtttttttgtccttgcgatagtttgctgagaatgatggtttccagtttcatccatgtccctacaaaggacatgaagtcatcattttttatggctgcatagtattccatggtgtatatgtgccacattttcttaatccagtctatcgttgttggacatttcggttggttccaagtctttgctattgtgaatagtgccgcaataaacatactcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactacttcaaccattgtggaagtcagtgtggcgattcctcagggatctagaactagaaataccatttgacccaaccatcccattactgggtatatacccaaaggattataaatcatgctgctataaagacacttgcacacatataaactttttttaaaaaacaaacaaacaaacaaacaaaagctaagcctctgagtggtcactgtttctgagagagagaggattcaagtttgaagcaatgtgttttggaatttcaggggagacaacttggtatgtaaagttctgaatgtgaacttaggagtcagagttaggtttcacttctctccccaacatttcctagttgcatgaccttgactaagatattccatatccctgagatcccatttctttatatctaaggatgaatgatcatagctcctttccagagcatattatagggttcaagctgagatatttaaagcgacccatacatgattttcactcagctacttgagttcctttcctgccaaagtgagaaatgtcactgaagggcattaagccaaatattactgtcttgaatcccgcatctctcaattctgagtcccattgtaactgaaaattgttggtaacgtaagacattggcttgaaaatgatttagcgtgtaaaattgagtcttgtttacatttaatacacaaaacaaataccagccttattatcttggtggagcagccctgaagtataaagtataggaccagagggtccaggctgtgtgttcagacccacagcagctgacagaaagtatcattttagagccaccctttagcccatccacctccagcaggtcctggtttctgaacatttgctacaccacgtatggttgttactttgacaaagggctgttttccactgtgctgactgccaacacctgtctctgagtcaatttacctcatttttccatgcaaccatttcagtaaatgtcaaggtgctgaattttcacatgtgcaaatatttatgtaagagcgaaaataagcacaacagtaatttgatcctaaggtattcagaatgtttcacaggcataaattaatgacaccacctagctccctgttaagtagggcagtactgctctggctcttgagtattctgtagccagagttttccatcttagaggtgaagaggcaggaaaagtcagctctaatcctctatacatcttcagaagaggtctgaagggagtcactatttgtatatgtttgttttcatatagaatttctgccttagtctgttgtgtgcttctataacagaataccacagactggataatttataataaacaaaagtttatttgttcacagttctggaggctgggaagtccaagatctaggtggcagcatctggtgagggccttgttgctgcataagacatcagttggcaaaggggcaaagagagggcaagagggagagacaaaacagggccaaactcatatttttataaacaaccaattcctgtgataatggcatttattctttcctgggagcagagacctcatggcctaatcacttcctaaatgtcctaattcttaatactgttacaatggcatctaaatttcaacatgagttgaagagggagcaaacattaaaaccatacaaatttctggctgggtgcggtggctcatgcccgtaatgccagcactttgggaggcccaggcgggcggatcacgaggtcaggaaatcgagaccatcctggctagcatggtgaaatcccgtctctactaaaaatacaaaaaatacaaaaaaaaaaaaaaaaattagccgggcgtggtggcaggcaactgtagtcccagctactcaggaggctgaggcaggagaatggcgtgaacctgggaggcagagcttgcagtgaaccgagatcgtgccactgcactccagcctgggcgacagagcaagactccgtctccaagcaaacaaacaaacaaatcacaaaagtttctttattttttgatggggaaacttcattttttaaatttttattgtcttattattatttaaaatttcatgggtacatagtaggtgtgtatatttattgggtatatgaggtgttttgatacaagcatgtaagtaaaataagcacatcatggagaatggggtatccatcccctcaagcatttatcctttgagttacaaacaatctacttacactctttattttaaaatgtacaattaagttattattattgactatagtcactctattgtgctatcaaatagtaggtcttacttattttttcaatttattttctagatgttaacaatccccactccctccccagccccttactacctttcccagcctctgataaccattatgttcatgagttcaattgttttgatttgtagattccacaaataagtgagaacatgtgatgtttgtctttctgtgcctggctcatttcacttgacataatgatctccagttccatctatgttgttgccaatgacaggatctcattctctttttatggctgaatagtacattattggtggaaatgtaagttaggacaaccactatggagaacagtttggaggtttctcaaaaaactaaaaattgagctaccatctgatccagctatcctactgctgggtatatacccaaaaaaaggaaataagaatatcgaaggaatattagcacttctatgcttgttgcagcactgtttacaatagctaaaatttggaagcaatctaagtgtccattaataggtgaatggacaaagaaagtgtagtagatatacacaatggagtactcttcagccatagcaagttttttcccctgtaactgatggactacattattttattttatttaacttaaatttatgtcttatattttttcttttctattttctttattttttaaaaaaagttattttattttattttatgttaagttctgggatacatgtgcaggacatgcaggtttgttgcataggtaaatgtgtgccatggtggtttgctgcacctatcaacccatcacctaggtattaagccccacatgcattagctatttatcctgatgctctccctccctctgacccctgaaagaccccaatatgtgttgtttccctccctgtgtctatgtgttctcattgttcatctacgacttataagtgagaacatgcagtgtttggttttctgttcctgagttagtttgctgaggataatgtcttctggctccatccatgtccctgtaaaagacatcatcttgttccttttagccatagcaatttattacaagctcataaaggaaaaaaagtattcatgcattgagccattgaaaaatatttagaaatactgagagactattatgtgccaggtatttttctaggggctgggtaagcatcaataaacaacaacaaaaattcaatttgtttattgtctgtctgatcccactagaatgcacatggaccaagacttcaatggttgggtgagaaagagtaggagtgccaacagacattggttattattttgtaaatgttggtcaaggaaggctcattaataatttgacatttgaagagaggtattacaatgcttttttttaccaaggaggacaggatcagggagacaaagtggcttgctgatagtcacactgtctatgaagtgtgcctgggatataatagctgttgggattctaagcttaggactgatctgttgcaacatggaaagatgaaaatcacttttatatattcttatggtatttataaaagttatcaggggagtaaacaaggcattagtcatgtattttagtgtgggaagattggagcaggaatacctttatagaaaagagggtgctgaaagtcttggcaaattttgacaaagaggggcaggcaaggtagatgcaaaaattaggaacaaaagcacatatagaaaacaaatttggtgtgataattgttataacggagtgaagtgagacacaatagcaaggtccaaaatggtatgagataaatttgccttttagcggctgttgctcacacttgcctcatcatttgaactgtgagctatttcagatctagagaactacatctcatctgtctttatatctccaacccttagtccctatctcattaaaagtgctctctccatggctttaattggaatcacattatctagccttatgcaaagttggggaattaaggaaggtggaagatgagaacatggcttcacttctctttccctgctgtggggtgctaagagatcagggttaagtttggagtatttgacagaggtagcacaagtatgaaaaaccattatgaaagaaagtttaattcatttatcatctgtctgatttgctcacctgagatttctttggattctaagtccactcacaattgaaatggaaacctagaatttcttcataataccagatcatttgaatacatgaagatcttcaggcttattttatactttcctctaaatatataaaacaaatacaataaaactaagttcacactttgggaaaatgaaataatcagacaaacagctgtgggaagagtggctgattgataggttcagaaagaatcaacaacatcgtcttatctttggaacccttcggggccatcacatggcaatgattcctagcaaaacagaaaggaaaaaaaagttaaagatcttgataatcatcagtacaatctgcctatctatgatacaatgcattttgatgtgttttatgggatctcaggaaatgtatttttttcagtgaggatggacaaagaattacactattgcttaaggagagagctatttgaattagagttagaaaattctagattccaacgtcatttactagcactgtgacttggagtaagtcacttattatgctgtactttcaagaagcaggaaaagtatatatttcagacaaccttacatgcatttcctgatttaatcccttgatcattttagtgacaaaagattagtgtttttcatttaacaattcagggacttcatgattagaaaggattagtgacttattcaaagttactcaaaacataaatgtcagatttgaagacacatttatgcttttgttctagcccacaatgttttctctgcataaaatgattttttcttttgtatgttgaacttatatgcacatatataggttacttctacagatggtattttgttcagcattacacagcataaaatgtcacatgctagtaatggctgcaagtttctcagaaatcaatcagggacttgcattctttgtattgtaagaagcacaaaaacagaaaatgtaaacaaattaacctcaggttctgtaattaccatgagcaacgaagagtttgagggaaccagtcttttatcaacagtgggtatctttgctgcagagaatcttgcggagacacccctctatccaccaagcctaaagcttgacaaataggaggtaatcagtgagtgtttattgagttgaattgaaggaagcagacagttaggaaaggtggaacttcaatatccgttcattcatgcattcacatgccaaatatgttttcctagaatatgtatctcccttagattcattgaaacaaaaacattcaaagaaagagcacatattgcaaggaggcagtggagaatgagaagagactgataagaatcaggaagtgtaagccaaaggagagtcatgtaatctttaaaaatctagagaaggataaaaaagattacctatttgatatagagttaattttaatataaagaataaaaagcacaagccacttaatctttggaaaaacactgctgtgatgtattttgacaactgtcactaagggtacaatagacctgtaacaacctgctgttactaaccctctgtttagtaactctctattaactagagcatccacctcactttctgttctaagtgttttttgcctccggcttccctccaaggaaggtcagactcagactcttgtttatacagatctaactatctctgtcctggagggacatagagatctattcccctctgcttgcctctttatcttggggcataatcacacctagattgcaagtttcccaaacagcctgggctaagtgtagttaaaatgtggtctatgtgcgtaaggaccactagtaatgaatggctcctgcagatcacacatatttgtcttattttgtctgcaagtaacactctctctgttttataaagggaaaggctggaaccagaaagccaatacattgtggtgactgtttgctgtgtttcatacacctgtgcaacttgcaatatagtgccctgccctccacacttagaatgtagagattatgaagtcagcttccttctctgtctttatctgaaacagtgtttgatatgcagtagttgtttgataaacacttatggaatgatgaactcattccttgtcagtggctaagtatgctcatcccgcttcttttccttaatctgtataaaatagaacccaagattttatgtgccacccactttcttaggtgtatgaatgggagctgaaaagtgttgactacatgagtacaaatacattcttttggaaaatatgaaaacataaagaaaaaatgcaaaatgagaaccggtgattataagcaaaagggaaaacgaggtgcaatgttgagccaacagctgatgctatgtcttgcacagacagtgatctgatgaagcaggaatcctgcagcagcattgtctgagaagaggcataaggggaggaggaggaggagggaaattctattttcagagataaatgtgaggaaagaggcaagtcactgcactgggaagaaagagagcctgcacccccaaagaagaatgtaggaggatttcaaaaacaggacttgtggaatgcaacaaaagggtcaaggagggtattggcttgaaaggaacaaaaggagtggtgagaagattatccagggttagttgtgagatctgtgccctttgaattactgtgaaagaatcaagttgtcagaattttaagtgcctctagcatgtaactccgctcagtacttgaacacctttcacttttgtatatctcaatgttttataagtctctttggctgacaaagaaaaaccaggagaagcatgacagtggtagaaagccctggaaagtatatatatatatctcagtctagctcctgagtcctactctgaggggaatttagacaagtcgtcagtctatgttcgatggtcattgtgacagctaccgtaattaaatgaagacactccctccctggccaaagatctctcattgaaatagctgtgcttttctgccctgttttaaagcaatggaagcaattattgtctctgtctttacagctttgtgcagtcagagttgtgcaattacaacaataatgtagtcttaggggttgtagtggtagtagttattgatgttgtcatcacagtgttgatcagctaattattattggctaaatattttatcatgcgtttatctttaatagtcatcttttaaaaatattttggggtaagtgctgtcttcatgtggcagaagaaaaatcatggactcagagaggttaagaaaatttcccaggttatttacaacaactggaagtgaagaagccagaaatccaacccactgtgtcatatcaaacctgggctcctaaaacactacttgtattgcttgtgtgtagtggtaggctgtgatcaatatgacaggccctgattgatcatgtctgattgatcgatcagatatactatgtctgattgatatctaggcctttgaagcacgacaggcattaggaccacattaacattggggataagatcaattcaattaaaatttgttttgagtacctattatactctgtgaattatgtcgggtgctattttataagtctcaggtgggtatttctatgtctgttttataagtgaggagactgaggttctaagaattgaaaattgtcactaaattgtattcagattcaggtctgaattctggctccatttcttagtaggtaactccaaggccagtgccccattctctctacaactctgctgttctcttctgcttaagttctgaattgctaggagaaagcatccaattttgtagtgactttcactttgcttttttaaaccataatatacttattatacgtgtaattagttattggaattgtggcttaaggaaagaatagtgccatcatgttcttcacagaaataattccacttgattgaagtgtccctggaaatgttttcatttaggaaaaaagaaatttcaccttaattctgaataggaataattggaagtatttcaatgtaactcaaaattggcaatttaggtagcatcagtcattggctagccatatgttggtactggaaatggtggcctgtgtagaattatttaacagggaatccaagagctacagaagtaacagtctacacgaagtcactatgcatgttgggagtaaaaatatagagacgtgatataatagttaattcacttgcagggatttcatatgttattccatatggatatggatatagagatggctgtgatctacacagtgggataattaagaagctgtagtttttttagtctaagaatatgctacattataaaacaggaaactcacatgtaaggaagtaatttttacacattgagatagtggaatgatcctcagcggtctgatttaaagctttcaagcccgctattctatagcaacaatttccaagcataaatggggcagggcatatagaggttaatatataaaacctatatgacagagccatgcctgtcaaacagaatcatattaagatgctgggatagcatagaaggtgattgttggacaaatatcttactaagcattctgcggagatattttttggcaaaggagagtatattattttctacattctttttatcagacatggagtttctaggcaaattaaaaaaaaattttataattaagtttctaaagaccaagatttggacgccacagctgcaggctgcgggactttgtccaagacctttctcattgctgggtcacattctgaattcccaatattcatgtgataatatattttcacctgtggaaaatgaattgttttcctatcaactcttataggagaatttgcatgtcataaccatatatttgccaagagaaataaataactatgaatcttcaaaaatagcaagtaacaccagaacatcattcattggtaaagcatgtatatcaaagaaattgttttttcatgaattcatccccaagtaattatattcatgaaatatttctagaatccatagcccatcagcaccaccttttttgagtattcttgagaatatatgaaatattagaacactgccctacaaatttatattgagacatttaattaaaacttcaaatgtcaattatgaaatgaataaaatatctacagaaacaatgagaaccccgtgttcttcagtctataaaacacactcacctcactagcattaattgtagtgctatgtccttcttctggcaaaccagcataatctcaagatgtgactcaggctgtgatggaatgaagtagcccttgagccttgaagcagtaagacttgaagtcaaatactgccacactcacccccaccctcccaccagacacacacacttagtggctctgtgactgtgtaacaacatctgtatgtctctggtccctggagacatggcaattattaatagttttcaagtggttgcatgctccagggctgagtccctgaagcagcaagcttcaattaccacgtttttctctctctttcttcttccatcttcattctctcctatcttctctttttctctttgtagtattttcttctctcttacatttgttgaataacctattatgtgccagggattgcgttaggttctgggcgataattatgacatggctttcatacccattactttgctagcaggacaggttgaaatagaggaggtggtgaaatggaaagaaacataaaaacaaatgctgtggggaagtttctagcaaaggtgcatacaatcaaaaggaagaaagcaagtagtcctatttggaaagacttcttggcagctgagacatcagagctgggactgaaaggatgcatggaattttaagagatccagtaaagagtaagtgtgttctagactgtattatccacgcaaaattgtggaggaaccaaagtatatggcaaatccaaagaaaggaaagtgcttggaaaatcaaaggcatatgctgtgtagaataccatagtaaaaaatgtttggagacaagtcatgtaaagatttgaataagagaaaaatcactttgttacctggaaatcactgtggaagcattacttttttgaaattggtgagagatgttcacatcttgtagtagattttctgaatataatctttgtttctaattttaaaaatagcataagtatttgctgattatcataaccactgaattaatacctaaatttcatttgacatgtgtatatatgtatgtgtgtatacatttataaagcctaagtagaaaacatgcatatatttacatatgtgtgaatctatatatccatatatgaacgtatatatttataaaaaaatacaaaatttatctacatttatatgtgcatatttacagctatgagtgtgcatatatatgtgcatctttataaaatatatatactgtgtatataatattatacatatataatgtagaaaataaaacatttgcctttttacttatcatgtaataataccgaacaataatactgagtctaaactcttgattgcaattaataacgttttgtatatgagatcagtgagcctcagggaatttcagtgacctgcccacgatcacatggctggtaatagttctacaaaaataatttctcatctagctaactccagaacccattctctaagcacagatctgtgcttcttcttatagacagatgaaaaaagggggggacaattccagtgcctgcactaaaacatatcaagctatctttgtgtgtatttatttccaaatttttatatgcaccatataacacaggctaatcatggcatatataattcaaaataatattaaaattattataatgtaatcatttgcaataggctctttataacagtttttaatgtctgcttaatattgtatgcctttgatatctataaccttaaccactaacttaatatttttcttgttattatttaaattgattttcttttaaaaaatattgtacagaaaagtgaacatctaaaactaaaaatatgagtaaccaggagaaaataaaatttatgattttcttagaataagttcttagtttaaaaagtactggtcaaaatgtataaacaagcttttgattgctgattcacttgatcagttgtatttccaaatgggttgttatatttttagaaggcaccagaaatgtataagaggagatacagtttctccaaattcagacccatctatctataagtctatttatctgtctctctatttccctctctatttctctatgtatctatctatctatctatctatctatctatctatctatctatctatctattatctatctgtcttcctctaaaatctctccccatctatctaaatcataaattattagtcacaaagaaagggaagtgctgttttctttgagccttatggaggccgaattattttctaatgtgtttatctaagtgtttcattttttcctttgtggtatatctgtgcaagtttgatattgttgtgattctgttattcagtggtaaggtgggtgtgtgtggaagtatgtctggttatatatactttattcttcataactggtagcatgtagtataaatcacatagctagcagaaagtatgggtgcagtacatgacccccccacttatagaagtattgtctcttatagccttttaccacttaacctcataagtaaaagaccccttttcacagataataaaatgataattgtacactgaattggaaagggtttttggggataacaaagctagtggtttcataaccaggataatgtgttcaacaagtcttattcaaaagaggagtctagcacagcattttatatcaactgcaatctttgaacagcacaatctgggagacccgtgaagagtgaattacagtaatcagccttcaaaatgacaaaagagtcaatcagcatccccttgcctttcttgtgaagcctctcaatctggtgatatcacagaaattataaaaagaaatcttcgtgacggatacaaaatgcttctcaaatgataacgccaaagacaatgggaagaaaaaataacacacacacaagtttaatgtttttgagatgactgaagctggattctaatcagaaatactccctggatgatgagacataagaaacagctgttgagcactaagaggaacttaggccagtctaggatttaaattcttaaactcctgaaccaggaaaatctccatttgattgaataacataaagataaaatcatatcttaaatacaggagaatcaaacacgagtctattcacagctaggtaatgaatgttggttttaaacaagatgatcctccttttccttgtaattcttctactagaattcaccccttaatcttctactccccagtgccaggttcaaatttccattgaatgaacttcatggagaatggagggttctcattagttgaattctcttgtttgcttgaattttcaaaatgaagttccagggaaacttctaaaatataatcatttgtattctctcatctggaactactatgcaacttaagctactgagactccaggaggcataggtacccctgaataccaagtgtgatttttccttctcaaaattacaaaatgttacagccccccactttcaaggaaaaaagtttgtcccagggatgttctgtgttagtccaaggctagctgattatgaaatggtctaaatctaaaccctagaaacattactgttggaaatttacaaaagtaaaaaataaaagttgtgatcagataattttatcaactcaatactcttatcctggaatttctatgctggaaaaaatgatctaagctgttttctttattgtgaggttatttatcaaatattcacatcaagaattttactaattgcttcagaggaaagcattttgtcacatggcttctcctaaacttgagaccactaacttgtcgccgcaccggtgtaatggaaggttaaacttatgtgagcttctgaacatgttgctgagtgttgagaatgtgtgactgtaagcatgctagggacatggacactactgctgcttggccatttatgaaaaaagatagacacaatttatgtcttgggcaacgggatgttatttaacgtagcaccatcaaaatttgctttaaattaaactaatttgccaaaataaactattctggcaaatagcgagtcagaatcctctctctggctttttagaataaaagttgaaaatggataagaaatgccattttattgaagttttaagtcactttttagcattcacagttcaaaatttttgacttttgacttctcaaatctgagaatttaaatccttcttaaatttgaaaacagtcttccctaattactatattttgtgctctgtattaggtggcatttcataccaaacaatgatttttaaaataggggagttatctcttgtccataattttgtttattcattaatttgttttattggatgcagagtttctcatcaaacacatttcttttcataaaagaaacagcctgaaactactagtgcttgggagatatgttagccaaaacaggagaaaagaagtagaagagaatagtaaggctattttcattttctatttttggagcttgtcaatatcttgaagtatctatggaagtgaaatacattgtgaataggaatagtaaagttaagtaatatgtgtagataagcccaacacaaaaagaaaaataagaggatccaggacaattgtggtttcccctatcctgcctttccagctacaaaatagcataaaaagcattccaaaaattctgtcttggatgttttaatgagtttctgctagtcatggggttgagactagaggcagtggactcgggaaagcaagagctgttcattattcagtttgaattgaagccaattaactgcactgtgtgttctaaagaaaccttggagagacttcctactcgccttagagatcagaaaacctactcccaatgttgtggaaggaaagaggagatgcaaagattctcagaggtgcagcttcccagtggggtcatcttgagcaacccacttaaatgaataggtattactctcattttacaggtaagaaaacagtctgccctgccttcttaaggagcaggcctggaccgcagtacattattacactgaagtacttttgaactatagatgtctgtgtaggagtgacatgcaggcaaaatgtttggcacttggacagagtcccagttttgtaacgtgtattttgggatcttgtcaggaaagaggcaattgaggagaatttaacaaagggacaattgacaaaagtatggcctggttaagagagaccgtcatggaagaatgcagcaccagatgctagcgatagaagtaccatcaagactcctagaccttaaggaacaaaggaaggtggcagttattggacactagatagaattttactttaacgatatctctaaataataacctgagtggccaaatacaggaataaagtctttgcaggagtctttgggggagccagttgcacagcctcctaggttaatgtatattggtggagcctaacaaaaagccagaaagtaaaggagttaattggggcaatctattaaggccacccttacatgccaacactgggtgggtagggctgggcagtggacttgtgggagcaattgtagaatattctgtactctagccaccatcaacataagcattaaaaagtcacgttggggaaggggaacagtgtgtttgggtaactactgtgtaccaagaactttgcctgaattatctcacatcatcttggaatgtccacagtgagaagctggttattatctctgattgagaggatatggagtttggatgagtttaataatttattcatggtcacagagttggtaaggttaagactaagacaaaaaatacaaacttgcttgatttcaattatgagggcagcattggtaagaggaatcaaacttgaaaatatatggttgacccttgaacaacacaggtttaacctatgagggtccacttacaagtacatttttttcaataaatattttgtaaatttttctgagattttcaacaatttggaaaaattgacagatgaaccaggtagcctagaatgttaaaaaaattaagaaaaatgaatgtcatgaatgcataaaacgtgtgtagatactattgttaccagaaagaggtcccagtccagacctcaaaagagggttcttggatgctgtgcaagaaagaagtcagggcaagtctgtagaatagtgaaagcaagtttattaagaaagtaaaggaataaaagaatggatattccatagacaggggcagccctggggctgctggttgcccatgtttatgcttatttcttgatgatatgctaaacaatgggtggattattcattcctcccctttcgtagaccatatacagtaactttctgaagttgccgtggcattcgtaaactgtcatggtgctggtgggagtgcagtagtaaggacgaccagaggtcactcttgtcgctatcttggttttggtgggttttggccagtttctttactgcaacctgttttatcagcaaggtctttatgatctgtatcttgttctggcttcctatctcatcctgtaagttagaatgccttaactgtctgggaatgcagctcagaaggtctcagccttattttacctaacccctattcaagatggagttgttccagtttcacaagcctcttacactattctatttatatgttaatcgactgtttgtgttatcagtaaggtttgtggtcaatagtaggttattagcagttacgttttgggggagtcaaaaatgacatacagattttcaactgtacgtggggtcagtgccccttacctcccgtgttgttcaagagtcaactgtatatgcatcttaggtagtatgaagctgcttacctcaatgggggagggtaaaaagacttttgcaattgatgaagtcccatggagcatttcttgtcctatttgctaaacaacattctccactgtgacgcttcactcatattctgatataacttgtagacactaacccaaaggtgttatttccaagtgagtaaaaaaactattttaattccaaatgcctaagagacatcacagttttgttttgttttacattttcactttcacaacatataaaagaaatgatgagaataatacataccaatcttttttgactcagagaagttgcaggagttctttcacgcaagtaacctgagaagtctcatgcatagacctcacctcatcaactttcttgaaaaaaattgctgccttccttggagaacaacattattttgctctgattgttagaagctccatgtcaaattccaaagtccagtggatggcataattggtgatgaccttagaatgtggtggtacaagcattcatgtaaatgtcacaggaggaaaacaatgttttcaatcttttttactgaaaatttgagccataatgaaaacattctaggtcatgaaaatgtatattcatagcagagtagctatcttggtatctcaacatgctgatataatgaggttgttgtctttgttgctgttttttgcttatctgtttgttttcttctcaaacatgcctcagagtgatctaaatctgaatggttgatatatttctacttttatttctgtttttatttctaactatataggtatgacctataagctatattatgatgtgatcaaatcctgaaacaaagcattgcattgaaaaatatcatcgtagtattacaaatgtttccaaataagcaaggttatctaattcagtgctccctgaatgggaagccctattattaaagttgtgtcagagtctaataaagtgtataagaactcacagttctccccagagcctgctccctgtgtaggtgcattgtatttccctggtaactcttgggactcacttgctactcaaaagatttagggacttgaactccttgcagtgcttttacagacagatgatttaaataaaccatatgaattaaaaaaaaaaaagaattacaacttcagaagtggccaaggcaatggctcagcttcaatttgaattgaacatgtatggtgcccctgggttagaagtgaaggggttaaattgtctttaatctggacattttccttttagcttgaccagaaatgtaacacacatcaattcaatagaagtattctggactagtcaaaataagttttattatggacatttagcaatatggggaaggggcatcttatgacagagttaagtaaaaatgcaggaaataaaaaaatacaatattatcatactaatatatctgtcagttgtttgacatgggaaaatatgaaataactgcaatatttatcaatatgagaatgccttagccatgtatagtatattgtacaatgaaaaattatgcaactgtaggaagtaatgaggtgaacttctatgcagtgacaaggaagtttttcaaaaacatctcctgtgagaaaaagaaagtctcagaatgctgcctacatcatgatcatgtctgtggttaaatgtttatactcacatttctgggtatgtacatatcatggccttataattttgcgcctcaaaatgtcagcgttatctatgaaaaaaatatgtggaggtagagagctaaataaggatttttgattttcaaaataaacttcaggaggatctaagaaaattttggatctttaacaagaatattaaattaccagtgaaacaaacagacaaacccacatgaaacgctgaatatatatcagaagaaaaaacattaagatttgagcagtgataattttatcgtattttatgtaattttatattttatacaccttttcctatatcttcctatttttctaaactatttgctacttttacaaagagaagatgtatctaaagaattaaaatataaatatagctgaacagtagattagaacttaagacacttgactatattaattctgattggtattttattcatctgagttgattctaatgacacatttatttatttcatctctcaaatgtatctgtgaacttcagaataatttatctttgacctcagagccttcaagctatgtgtgtatttactcctcctgtgggggaattgagatctgtgataaattggagaattctttcactcccagggttttctggggtggacgagactgtgttatgatatacattataatttggtaggcaagggatgccattcagtttactttctaatgtatatttttgcaagttctttttatacattataaaatatatttttgcaaattatctgtaaatgtctatgaccacagtctttctcattgatgtaacaggcacacaccaatcaaatgtcagaagaacacagaaaattatctgactagggacttggtgtatgcttgtgtgtatgtgtgcatgtgtgagattaacactttcatttttgaattagctctgtgactgaaagtcattcttccattttccccctcagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagtaagttaatttcctgcactggatgagaatcttggtatgatgtttccatttgaatttatattataatttttagtgataattaaaaacctgacagcaactattgagtggcttattatgtgccaggtatggcatgattttggtactaaacttattcccattttacagattacaaaacagttgataccatttccaaatatcaagcgtatagtaagtaagaattagaaccagtatgtctgactgcaagttgtgcactcctttctcttttgcctgctatttctctttatgaaagcttgagagggtgatgcaaatgaagctcagatattgctctattattagccccatttgttttagaaaggaaatcaaatctctagtgcccgaggtagggaagacaaatatgcagtaggcttgctgcaaaatttacactccttcttcctgcaactgggaggacatcagtaagactccactcttccctgctaaagccatactctgccttggaaatttcaacagcgtgcattctaggcagccaacatgaaagaatcagggagacaataattatttgacaactttctttactctcatcgaacactttcttctgagcatttattcaagtaatatgacagagacatgatttgataaggcctttctgacatggggactcttgaattgaaacatgaaaaagtgaaaacaattagttggaacaaggtgaagccatgggagggaggatgaatagtgcagcttaaaaggatgtttaaaagccctgtgtctacatacttattattattattattatttttaagatgccacatataagtaagatcaggcagggctttttttcctttgatctggcttatttcacttaacataatatcctctaggttcattcatgttgttgcaaatgacaggatctcctttttaaaggctgaataatatttcattgtataaatatacaccacaacttctttagccattcatctgtcagtggatacttgggtgatgtccatttctttgctattctgaagaatcctggaatgaacatgaaagtgcagacatctttccaaggcagtggtttcttttatcaaaacatcacagtgtacaccttaaatatagtcaataataaaacaaaagaagctctgtggaaggatggtgtacagccatgtatgggaatggaaataatttcactgcagctggagcagagagtgccaggggaaagtgctgcagcaagagtctggagagttagattagactgaaattagccatacttggattcaaaagccattttaagtatgaggacctatgaggacctttatcctaagatcattaggaggccatttaaagattttaaattgcagcttgagtgataggctgtggttccagcgaaactgaaaagaaattaaatctggccttcctccaatgtttttttctgctttgcagccagttaaagagttatttgcaatcattcacataaaaggtgatggtagccctggcaagcaagggtagttgtgttggatgcagagaaaagtgtatgagtgtgatgcatagttgagtcacagaagataaaagtctaaggaaagattgcattttcagttgaggaagataaatgataatatttctaacatgaaagattagatgcatgctggtgctatttgttggtatagaaaacaccataggaaatctgttttttaaagagttaaaggagggaaggtggggtggggagagacagggagagagtgacaaagagagaaatgtgtatggagcttgaaaatgacacatttgaggtatctttgatgatttatctgaagaaattccaagctagaaaggatagaggagatgcattttcattaagaattttagaatttttacatctggcaattcataaatcagacaacaatgcaacctttttaaacaaaattattgaaatggagaacaccatttcttctactctttccctcactttttttgcctttgcagttgccattacagtgaatactgcaagatgccatatttcattataagaaaatgattattcaattaaataatggcagatcaatttcaaacgtgtgccttttcttagagataataactattaactgtgatcacactgatagagatgaggagcaggcacagaataggaatggttaaaagaatgttccatttgcttggcttcccaagactccccatgtaggactagcagcacggcgcggccccttgctgtcttatttatttaataagcataccaaaagggatcatctcaaaccttacttggaatatacagtttgtggaaaatggaatcattacaccaattatgagaaaactgggagacttcgcttgcagtgaggattttcagtgcctaccttgtggcagaactatttggaaaatatttcaatccccagtcctataacttcgtgattctaagagagatgtttttatcccattgttaaataaaggggtgttagtgctagaagaaaccttactgttatgttgagtataatgagccttagtttatccaagggactcagtggatttgagctcgaatgagaattaggtaatgttctccagatttgatttttccttttgggtttttaggtcattgaatgtttaattttcccttgttgtggttgcaaggagagtaaaactttttggttttttgagtttgggttccccagaaacagaccctgagacaagaatttgattgtaagtttaactcggagatgggaccaataaatgccagtggagaaaggagagagagagacagagagagaaatagccaaaaaaaaaaaaaaaaaaaaaaaaaaaaaaaaaaaaaaggtgcgtttttgagccagttactacagtgggttactggaactttatcttattggagaaactctggaccattgtaaagaaggaaaagaaaagaaaaaactcaaagttatcctgccacagaatggagagacctagaattttatatactaactcctgtgagtctttgagggctgcttctgcaggaggcattaattttctggcatttttggcctgacactcagtgggcaaaataggttctaaaggcccgcaataaccctcaggcaaagaaatgcaggagtggcagttagatgtaagacaggtgtacactacagtaacaatggccgggggttatgattgggacaccaacagcttcctctacaccagtgaaagtgagtgacagcagtataacaactaaagtgacttgagttaaaatggactaatgacactaattagacacactttattgcccccataggagagtgaagatacacttgattgtattttgcctaggaagtgttgaaggcaggatttttgtctttagagcaatgaggactttagcaacaagaggagtgtttcatgtgtctgaacagcttgctgcagggcacagcagaagttcagtaattgaattttatcaaaaatggtctaaaagtctgtaaatataaaggtaagttcaaaagtgacttccagtgtgttacacattgcatctttctgtgctgaaattagcttaatattttatgttggcaacgacgaatatccccatgggcagtaaatgtgattatacagcaaaaaggaaaaaatatacacatagattccctaatagtcttgatataactgctccaaatatacacttggtaaacatatggttgagtaagtttcatatctcagaagagccttgaaaagggatcatgccttcttctgggaactgtttttctctgattcagttaaaagactgaacattccagaagggaaacggatatttctgtcttttctatcactttattggtagcatctataggaatgcccagaacaaaggaggtgcccaaaagatatttgccatatgaatgaatgaatggttggaatttgtgtgactctcattgtttctcctctttttaaaggcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaagtaagctaaggaagcttttgttcatcttcaaaatatcttgttgaaacttgagttttaaagttgagggacttgtgtggagttcctggcagaattgcacagctggtaggtgtttagctttgagcagtaagacaagataactagtacagtccttttggcaactcttatctcttgggcccccttcacatttctgctaaaggtctagtaaacagctaccataatagtgcttgtcctccaacttacctattacccataaccacaggaatttactgacttcttgtacagggcacttcaattatgtggggaagtcaacatcctgtgaaggcagccctcaaccaaagggggagaaaaattggtggacagttactattgtttgaagaaactattctgagtcatattgtttaagattgtaaaaggattctcagtaagaacaggcctcagttgcccacagaggtgacaagttcagtggcttttggtctttctgtatataactctccacatgtttgaactcttgcttcctgaaatatcttccccaaatacactgaagcttcccaagtccttattgaaggctgtacattcatggaaactaaaaaaaaaaaaaaaaaaaaaaaaaaccaaacaggcagaacattcaggttcagttatcctggctttctctagtccctgaaggacagggccaaccctgctaccattgtatactccaaactatggctcagaggtttgagcattatgggaaatgaatctcatcgttcccttgcttctggatagggaggtaccattgaaaaaagaaagatctccataacaagtacaaataatgtaggaaaatttgaggctgcttttgttagcaatctcttgtttttatggtagatgtaaacaattctgtacagcattttccatttatagttctcatcataatacctacactcataagaaatgtgtagaacatagttcattctttatagtcacaaaacacttgcaaggaaaatactctttgatcctcatcctgattattttcttcaatattgttcttcaaacctttgtcatcaagtagatcaaactagcttttaaatggattagcttgttctcaaataaggtagttggtggaccacactattgggagtcaataatttttttcactttcttcatcagcattatgtagatatgactgtaaggtcatatctgaatctccatcatgttacacgagacatatttccaatggtcttgctctaaaaatcgcccccactgaagagatcttaacactggagacctaaagttttctggatattcttttttataaaacatatttttaaaaatcaattttgaaaaagatgtctacatttattttaactctctgttgagcaatgctatctttctaccaaaatcctggttgagtttagcattaagaactacaaaacatttaaaaagccatgtttgaaataaagtagagtacaatatttgagtcaattattgaataacccagagccacattttccttgactaatgattcctaatgtcatttttattgttattattcccattttttttgccataaagtgctgttataaactgaaacaattagccatttactttatttttatttgctggtattcataaacttggaagcatatactatacaccttgacaccaagtaaaatgtgtattttaccctagagaacagtgcaaaggagttgtatttctacaatttataggccctcttttttgtccaataaaattcttgggacaccagaatgtgtctgggttcattgttgttatcttgagctggaattaagcagaacataatctgttatacttaacgatgtttgtgaagaatttgaaattgcaaaattgttacagtaaaggtgattggcaaattgtgaatatgctgatgttgcatgatctattcatggatgcatgtgcttagtaattttagaatagatagtaaagtgagtgcctgcctggtttactagaaaatattgaaaaaaaaaaaaaaaaaggagccaagtcccattagatcagaatttaaatgtgaaaaccaacacaatagtttgaaataagaatatataattaagcttgtactggaattctgaaagagttcactggtgccagtttgtcttctagtttatttttaaaaatcttcattgcctatttaaagttctatttcttatgagaaatttgtaatgcagatgtatactgtctctttgaacctcgacagacttgcattcttgaaatctgaagtattatgagttgccaaaaattgggctataaaggtgctaatgcacgtgggcttctggcttattgaaggcgaattctttttacctagctttacttacctaggtcattgaccaaagtctctcagagttttagggaatgaagtattagtatgtcagaaatattgtcagtaatggtgcaatgaggtaatttcaaattgcttttaagtggtttgtgggggcacaattagattcagttatctatttatactgctcacataatttcttcttctaaatataaacacaagtacatacatatgtatcggtgcacatatttctttacatgcccacctgcctcatagcataaattcataatagagagtctctaagaatgtcctaaaaaataataaacctcattttaaccacatgatcagtagagtagcaatgctttaaagtgaaatcagaaaatactctttgtggggattagtgctaaattatgctttataatgtctccttggactaaacaatgattatttctagttctttacatttcacactctgttgcagaaatgataaaatattcttcccagacagagattgtgttcgatgtcgccttatctcccaccagcagaggcctgattaagtggctgattagtatgcaggtcatgctgtcactagtaaaattttattatgactctgaagtgaaattttgatggcacaattcatgactgtgaatattttgtgaattccaagtgaaatgagcaaaacaaaacaataggagattagattcactgagcttatataataaacagacataaataaatgcccataaaatttacaggttgaatctgggggactggagagtgatcccattaaggctcacaaatgggtttaaatgcacataactttcatccatcagcattatactcatttgttcttgctgctgtggtcattagtgagaagcatttatctttgtcatttcttaacagcctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggtatttttattttaaaaggaatactggctactgcaaatgacaagcagatcagtgaaaaatgcctttgcttgtaccttctgtggggctctccttgggactatgctcacatgaccaaataatgttggttggcacatactgtgtgtgtgtgtgtgtgtgtgtgtgtgtggtgtgtacacgcacacgtatgcctactaagtgctacatagagcccagagccaggaacaataagatgaatacagctattccagctcttagagagctctatgaaaatgcaaagttgcaaatgtttgcaatacatttgggtggatcttgttatttttatgtttttgtttgttagtgctttttttgtttgtttgtttagctttggggaagcattgctagtttgtcctctgtctcttttgacagttatggtgaattatatattagaatttagaggcacgagaccatagtgtcaatgcattaagaggctcctattttatttctgcatttggtgtttggctttgaaatgatctttttattacttcttggacatttctgataggtcagcatatctggtttggtgtctcctagataaaaatctttctctgccatttcaaaaataccctctgtttatagtttttctgctcaaaatttttccccaggatgcgaaataattctttattaaagcttttctgtcttttttagaaatgaagctccattcgattttttttttctgttgtactgtacacatcttttttctttttccagtcacccaaatgacagtacaggttctccagctaaatagctttctcctgaaagcacactgaaaatctataacttctatgctggtctccaagggtgaagtgttggctaatgatgtgttttgagtgtggatttcaaatattgtcttacaaatatttgttgcaaaatcaaggagatagagagtaagaagtagatggaggaatacaattttaaagaattgtccagctgatttctgagtttgatgtcagctcataccaaaccctttcaatttacaagtcacaaataactagggcagacctgcttccaattacttcatttggggaaaccctggtaaagtgagttatctgtcggtttatttattcgattttttaaaaaatgtattaaattcctgttactcacaagggtgctgagactatgaggctgagattaaaaccttgcaggacaatcagcaccccaaataagttgaatttgtacaaaaattatttacagacccagaagagcactttttgtttttaagtacaaatcatttctaaattcagaataacaaataagactacagccaataagtatgcaaagaagactcttcctgcagaagagtctaacctctaagaagatgaaactacctggggatttgagaaatggtccattggccattctcagttctaaagaaatttcacaaactatagacatatgcaaaaaataagggtatttggctaagaaaattatatctattaatgggccaatgttgaatgcaatgggaggaatatccaaaaaaaaatttacattggcattaatttccggaaaatatagtgaaattatgcaatggctttatgctggaatgctgacattaatggggacaatgatatttgttgagtggatgaatctgccctgttcctatgtttctcaatttcctctgaaaggaactcaaaaaggagtagttgccacatcctttacatctccaagcaggagaaagaatgtgaagggaggaaatgagattggttcaactgagacaccaatcagaggaccggttttagtgcttgatttgacaaggtttctactcttgtcagccaggagcatgtaagggcttcagagtctgccaagccaagggtccttagggaaaataagggttcagatatcagcacaataatataagctcccaacatggactacatggtaccagtgggaatggactggctgtgcagagacacgatcttaatcatctagagatgaggcttaaggaactttcatgccatagtaaaagtagcatcttattggcagagctagctataaatccaggttcatagttgtccacatatggttgcacattttataatctattcattttactgatgtaaaaatggagatttactgatactaattccagttcacagggaatcaagagaagattctcattgtagttgctagttattattattgctattgctacttttattactgttactggcaggaaagtttgtgtagaggaagcttgaggctgtttagaaataactgtccagcttagaagcatttcattttcaggaaagctaaaggggatttgagactgtttttaccaggaagagatggacagataaagcactatttgatgacacaggcatatctgtgcttctgatagatgtcaggcaagtgctagttcttcagcatctatggttctacccaaagaagggacaaatgctgtttcaaagcatttacagcagcctttggcatgtcattcagaagggggagcccacacattttttattaaacctggcttggctccatgggatgagaacttaagaatcacaaaccatatttttcaacatctgttctgcagttctacagtcctctgcccccacctccaccccagttggatcatggagagcagcttccctctctctatgcacaattggttaatttcagaagaaaattaaatttcctgactagccagagcaatgcatagttccttatgagtctagcagacagatttagagccatttaacctttttagacagaaccagaggatatggatattcagggaattattgggtaacacatagctatgcattattttctctttaggactgttgtattttatacactgacaagaatgtatccatcttttaggataacgtttaatttgctatccagcaagaaataggcagttatcccagcatctgccatgctaaaacatacagttatttgttggttggttggcttctcacgcggttcaatttctttttagagcacattgtcaagctagaaatatcatgtatttttgacttcttatacctactactatatctctatctgtatgtatttgtctgtatattcctttacgggggaaaatgaaaagtgacatagagaaaaatccgtcatcttaccctctcacttgcaggaacattaattagttccttgctactttctgcaatactatgtctttcactaatgtaaaataaagttgtgtaaattatttaaaatatgacatattttgaatttagggagactaaggttgaaatcatatcactactacttcccagtcggagaactagtctctggaattctctgagattcagttttctcctccgtatgggataatatcatctttcttgcagtgttaatgagatgattaagtgacaatattgaataaaatatgtggtagctagtagggttaccagttaataaaaggtaagccaccatcaatttcacatcttaaatgcaaattaagaacctaaaacttattttagtagagattcatctaggtggctgtgtgcagaattgtgttttttctttgacagctataggctaaatagtctaattgatctcatttagtcttattttctcctgctactgctacggatgttgttactagtgagtgcttggtatatatcaggacctgtgcaacatatacttgtttcattctctaacacttctagtatatatatgtggagtcattatgttgcagctaaagctgggttcttatcacataacaaggaaaatttaggtacgcagacacattaaaaggtgagtaggacaggattttattgggcaaaaagggaaaaaaaaacagcaaagcaagataagagtcatgctaacaggctccccacctcacagattgaatcctcccggctaggacacggaactggagaccaggcttctccccctgcccgtggctccaccctgttcccccagtgcgcatgtagacatgctcagacacagccctgggccagttccctcatctgcacaagagcatctgatgtaaacacttgcggggcaggccggagattctccaagggccttttatcagcttaggcatttggctgtctcggttatacccatttaagagatgtgaaacctgaggattaaagaactaacttgcccagtatcacacaaatagttagaagtggaactggggtgtgcacttgggtcttatgatggtgccatgcctatccccagtcctttcttttccttgtgatctctgtaactcgtcaactgggcctataagctttaggatgactgagtaggaccaattataatggaaataattgactattcattctctaaatgacctcactgaatatcaggaaagaagaaaaataaaccaaatctgtggaattaaccagagtataaatgctgtgatctttgctcatctgcctagccacctggtatgggtttgttattattggctgtgaaccagattgtgatgggcaaggtaaaggagaaaacaatgttatttttatttgatgaatccgacaccatactaagctcctattatgtattatctcacgtaattcttacaaatgacaccaagaaatacttagtatgatttcagttttataaagaaggaaacttaaaaaggataagcttcctgtacttagtgatatagcacgtaaacgcaggacgagaggttaaatccaagtttctgcttatcattggccactatacctatgcacgctcttctagattatggattcttgaaagtggaatacgatgatgacagtcgtgtttattgagcccatacttcgtgacagacactctgaaaagttgttatatgcagcaaattatttatatttaaggtaaacattcctagcccagaacagatactagaaataagtcagttctttcatgtaaatctgctgtgggccattttttttttcctttcataaacttatttcaattgtgtattgggtgtcaccatggctttgagatggtatgtgattctttctaaggaaatcactttctattgtttcccaagcattcaccttgaataagactgcatgagctgcttaagttaaaagtggaaatgatggccattcagcaggcagagtaggaggtcaacataagatcattgtggccacagtgctgtgttgtcctaattcctctcttgaatataaatacccactcaacacagaagcattgcatttttttttcctactggtattctggcatttttataattcacctgagttaccagggtggctgttcatcagcaattctcctgaaagcagtctttagattcatgatatctaaggatgctaaagtgaaaatatttcatactgtagaaaacttggaattaatttagatagtagatggtgtattgattgattccctcagtcttgcaataactctcaatttctgtaaggagcatgtttgtttgtgtgtgtgtttgtggtgtgtttgtgtgtgtaaagagcacttaataagggatccactatcttataagatttataagtgcacaatatagtattattaacaataggtgcaacttctacagcacatctttagaacttatttattttgcataactaaaactttatgcctgttgattagcaatgccccattttctttttccccagtccctggcaaccacaatcctctctgattctttggatttgactattttggatacctcataaaagcagaatcatgcagtatttgtcctttcgtgactggattatatctcttagtagaatgtccttaacattcattcatgttgttgcgtattgcaggatctccttgtttttaaaggagaaacacattgaatagtgtttcaatgtctctctataccacattttctttatccattcatcaatgaacgtttaggttgttttcccattttggctattgtaaatactatgaacataggagtgctaatatctttttaatatcttgatttcaattctttgggataaatactcagaagtgagatttcagaatcatatagtgattctgtttttaagtttttgaggaacctccatactattttccataacagctccaccattttgcattcccaccaacagcgtataagaacctagtatttttaaataattaaaacttgtttcatttaattcttgtactttcatggccaaataaaaatttgattgtccccaatttgaaaacagcacatcgtccaacactgtttcgaaaaactcactatacctgcgaattcaactaatggtaattaattcattaagtcacatattcagaaactcattcattcattcattcacattaattcatttattcattcatatatattttgactgacattttgtccaattattgtcagctgaacctacattttgtcaagaaatttctagaaaggcacaatatctgtctttgtgagcctataatacagaggttggctgaatatccccagaaaaaccaaagcccttcacagttatctaactagtcttcttttttttttttttttttttgagacagagtctcactctgtcacccaggctggagtacagtggcacaatctcggctcactgcaacctcagcctcttgggttcaagcaattcttctgcctcagcctcctgagtagctgggaacacaggcatgcaccaccatacccggctaattttttgtatttttaacagagatgaggtttcactatgttggccaggctggtctcaaaactcctaaccttctgatccgcccccctcggcctcccaaagttcttggattacaggcgtgagctactgctctcagccttatctaactagtcttttatacatgctctctgaaaatggtaaacaaaatcaaactgtagagctttaaggtcacatggaggaaaacctttcctaatgaattttgaatagaagttcatagatatccaaggatgccaataatgttatagtgaaaatatctcaccctgtagagaaccttgtagtaatttgaaggtagattttatttattgttttctcacatttttattctcccttcatttcctgtctttctctctctctctctctctctcctctctgactataaagaaattatttggatagaaaaaggctccttcttttccttagaggaataataaataatatgtgatgcagggaccttagaattctggaactagcagaactcagataatattatttattaaagcagttagagcaaccagtggagcaattagaggcaaaaagctgaaaacttgtagatggaatttttgatactcaaagtgcatgcgagaaaatgttaaaatggtttctttaggcataataacaaaagctagagtgaaattaagcagtgagaaagaaacagttggagttcagtgaaatataataactgattcataactaaggggtttatttcattatgtgtggctctaaatagcatcttcacttgcagttggctcacaattgtatcttcctataaattttccatacagaggcctcaaaccagtgtttaccaaaacattttttatgatataaaagtgcatttatgccgtttaaatttgaaaaatagatacacagtctttctccaagggcagcaaatccctaatggagctctaataatcactactgggactaaagatagggtgaccgggtcactttgaattccacggtctttgctataggacttcacaggtgagttgctaaggtgcattgcaccctctaaggggagaatgtaagtagcatctttgattttggaaccttgtgttttgctctgcacagcatctaaagtatgctgagaaccatgctgatttaaaagagggcagtcaggttcctgtcctgatctgtcctctaaattccagtgcactgagcaatgaaaatatcatgatgctttctgccaatagactgtgttgtctatgactatataaatttcaccttttttcttttctttttaaattttgctttaagttctgggatacatgtgcagaacgtgcaggtttgttacataggtatacttgtgccatggtggtttgctgcacccatcaacctgtcatctaggttttaagccccatatgcattaggtatttgtcctaatgctctccctccccttgcccctgaccctttgatgggcacaggtatgtgatgtcctccctgtgtccatgtgttctcattgttcaactcccacttatgagtgagaacatgcaggaaagtcacctttttttctttctaaagagcttactagagggacaaaaccccatgacgttagtaaatactttgactccattacactaggccaggggtaagcctgtgggccaaatacggcctgttactttttttgtttttttttagtaaagtcttttttttttttgagatggagttttgctcttgttgcccaggctggagtgcaatggctcgatctcggctcacagcaacccccaccttccgggttcaagcgattctcctgcctcagcttcccgagtaactgggattacaggcatgggccaccatgcccgtctaattttgtatttttagtagagacgggggtttctccatgttgatcaagctggtcttgaactcctgacctcaggtgatctgactgccttggcctcccaaagtgttaggattacaggcgttagccactgcgcctggtctagtaaagtcttattggaacacagccaccgtcatccttttatgcttacaactgcagagttgaaattgttgtgctgggaacactgtggactgcaaaacctaaaatacgttctttacaaaaaactttgtcaccccctacacaagactgttggaagtttgaatttccatcagtaagttgaacagtcagctcccatatcattccaggattttactctgtctcaaagctccctaaaataaatttctcaaaataatttaaagaatgttagtagtcaaataacttttttgtattaggatccagctacctgcaatgagaattgttattgccatcattgccttagagcccttggaatcttagtactcatggggcccatgacagcatgcacccatgttgaatctgccagaaaaagctggcttcctcagcctagcttttgaggaaattttcataaccaataatgcaggatgcagtgggtaccctgaagaatactgtgatgtttccctgcttagagtgaggaatttgtttccttcatggttttattataaatttctattttttttttacctgctcattttcttcttctgatctcagtgatggctataatacaggggtttggaattgaggctgttgactgccttagccaaaccctagtcccttcactgtaatctcttcacacattctttgattacagtagcatttctctaccaaaatggatgaagaagcaagaacaagaaactgacttagaatagatttgtagtttgtacatcaaacttgaatatgcattcttctgtatgacactaggttttcagcaaaggatatgaaaaatattttatgtgtctttattcatgcatatttagcattttagtacagtgctttttgcatatatttcatttacatttacactttgtagcattaactccctgaattacacatattcttattcccattaaacaaatatgttacaggtttgaaagtagatggagtctgaaatgaaagccatttgttagggattgccacctatgaaaggaaaggagcaagagcatgatggacagacagtgaaatcaaactgcacctcaatccaagccaaaacttggcccaaactagtagtttcctttggaatcagtgttgcttatcagaggagtactacgtcatgccaaagtggtagggcctttatatctctgtttgcttagtcttcagaaaacctctggagtggggattttctgaaactgagatggaccctaagtagtggatagctggaggctgtctcctgaccacgcccctcacatctctggcatcctcctttgaagggcaatctgcacagcagttcttcatgtctataatggatacgcacactgaaactctgtagtaatgaagtaattttactgaattttttgtttgtttgtttgtttttgttttttgttttttgttttttttattatactttaagttttagggtacatgtgcacattgtgcaggttagttacatatgtatgtatacatgtgccatgctggtgcgctgcacccactaacttgtcatctagcattaggtatatctcccaatggctatccctcccccctccccccaccccaccacagtccccagagtgtgatattccccttcctgtgtccatgtgatctcattgttcaattcccacctatgagtgagaatatgccatgtttggttttttgttcttgtgatagtttactgagaatgatgatttccaatttcatccatgtccctacaaagaacacgaactcatcattttttatggctgcatagtatttccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattccggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtagggtttctgccgagagatccgctgttagtctgatgggcttcccctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaacgttggcctgccttgctagattggggaagttctcctggataatatcctgcagagtgttttccaacttggttccattctccctatcactttcaggtacaccaatcagacgtagatttggtcttttcacatagtcccatatttcttggaggctttgctcatttctttttattcttttttctctaaccttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgtgtgctgggagaaccactgctctcttcaaagctgtcagacagggacacttaagtctgcagaggtttctgctgtctctttgtttgtctgtgccctgcccccagaggtggagcctacagaggcaggcaggcctccttgagctgtggtgggctccacccagttggagcttcccggctgctttgtttacctaagcaagcctgggcaatggcgggcgcccctcccccagcctcgctgccgccttgcagtttgatctcagactgctgtgctagaaatcagcgagactccgtgggcgtaggaccctccgagccaggtgtgggatataatctcatggttcgccgctttttaagccggtctgaaaagggcaatattcgggtgggagtgacccgattttccaggtgcgtccgtcacccctttctttgactcggaaagggaactccctgaccccttgcgcttcccaggtgaggcaatgcctcgccctgctttggctcgcgcacggtgcacgcacccactggcctgcgcccactgtctggcactccctagtgagagaaacccggtacctcagatggaaatgcagaaatcacccgtcttctgcgtcgctcacgctgggagctgtagaccggagctgttcctattcggccatcttggctcctccaattttactgaattcacaccgctagctgtccagctcccaaatccacagtggttaccatattggatagaacagggcacacttctcaacctacagtgtcttcccttagataaatatatatttgttacacattttgagatgcaaacctcatagtggcaagttaagttgcctgaaatattatcagtgtggtatactagacctggctattagttataaataataatcaaattacatgtatttgtaaaatattttaaaactagtgatctaaggtggtagagattgcacaagaatcttgagagagaaacaaaaaaagaaagtgctgatctagggtttaaaatcagcttttttttttctgattggtgaagcttctgtattctctagggaacaaaacttaataataatgcttatattctgagagaaacaaagatgcttgtgtaggctgagccatgatatctaacattattatactcataaggcaaaataaatcctctattttgcatcatgacaaagggagattgacatccttatctgatgttcaaatatttatgggagtcattttaactaaacctttatttttccttatatttctacattctggtttgacatgatgtattatacagctttgcttttgataaggacaatcagatttgacttaatgttgcagaggaaaacataatattgcatattttaagaagagagcacggtggaaatggagagcttctattttcattcatttgtcaaatgtttattagctctaccccatgagtatgaagtctgcttgctggggaatgggacgggtctagctgaagtgcctttgaaacaggcaataggggacaaatcaagtttgggatgatctaccgaggttcacaccttcatagtaaatgagaatacaatttatgaaagtccttaatgggtcgaagtcatggaaaatatatttagtggtacaaagcacaggaaaagacctaaatgcccttccaaagccaagggtctgagattggacagaacaagtatggaagaggaacagggtgtagactgtagtgaagagaattgtctgtttaatggcaaaagaggacacatttctggctaacatttattggacatcaaatacatgatcttgcattttgcatttgtttaattgtacaagaccgggtgagaccgtgtgggtagacattgcgtttaggaatgagcatttttggtaaaaaatatttttgtccccagaatgaattacatctggcagaacactggaatggtgtgtttatcctattattatagtgtgtaaataagcacatcatttgaatataaatgcatctctagttttaaggttgagagaccaccagcctaggcaacatggtgaaacctcctatctataaaacatacaaagaaatagccgggcgtggtggtgcatacccgtaatctcagctacccaggaggctgaggcaagaggatcacttgaccctgggaagtgaaggtgacagtgagctgggatcgtgccactgaactccagcctaggtgacagagggagacctcgtgagaccttgtctttgggggggggaaaagagttaatagaccatatcttgcttaacagttcattcccagtatttaccaaaactccttattatttggtaaatgaaccttaatatccaattaaaatttcaaattatatactcatttatgacattttacataacctattttgacatagttatacactacttttaaaattaattttggtgtgcatgctttcctcaaatatgtttttttctatatggtaaacaatttttaccaaaatggaaaccacttacataatcaaatatcaccatcctcataactttccaacatttaataagagtttactatgtgacagatactatggtcaagatattatacatatttctcttactaactttatgacggaggaaatgcatgttatccccattttacaactataaacattgagagacaagaaagtctataatgggctactccactagattataggaaagattaaatgaaaaattaatatatagggcttagcagaaaggtcaaaaattaggaaagattcaataaatgcattaaatatattattaaatatgagtactggatctggtcctatggtctgaactgttacattgtaagatgctttttttatacttcatcattctgttgtctcttctgttacctattagcgtttgtcaaccttgactctatttcctatggagagaagtatgacaggcacgatcaacagctccaaaaagatatcatttcagggaggggaaagattctcttcacttgtagattgcccctggcattgctgggtcaatgtggacctgtggacattcatagaaatcgattgggcttcttgtgtcctgggggtaagcagtgaggatcaaggtcatcatgagggctttggtgtaagagagtttatcctcacaactcctaacctcccatcatagagaagcacacacaagagataaatctcaaatagccaccagaacttccggattccatgcatttctagaaatatttagtcatcttttgctaatatttatgtgaacatttctgatccatttgttgtacttgaataattacatagaaatgggtaaaagaaaacaagacagaactatttttaacttgaaaaccaatatagagtaattgaacatgttacaaacatactataggagtgtttcttcaagacttcttcacttcctttgctttccatgttcaaataatcactatgcctggtttattttacttcctaagctcaaacaccatcatctctaacttgagtagtgataacagcctcatttgctcatctcttatcctttgatctccacacagctgccaagatgatttctacctcagtttcgacctgtgctgtttgatattgtggccactagccaaatacagctcattgaagttacagaaaattaatttaaattaaataaagtaaaaatttcaatttctcagttacactagctagatagctagggtgaaatagccacatatagttagtggttaccatactggataacacagagcatatttctgctaccatataaagttctatgcaattcagctgtggtttagatcatatcactcctgagtttatatcatgtcactcctcttaatattatgcacacatacaagcatgatagttttatgatactcggcactaaggggcagtcactaaaactttgttgacattaaataaaaaatcaaatttgcaatgtaatcctttcacaatgtgtaaaactgcatttcatttttgcattttttgttacatcatcacatttagaattctcataatgcactattattttcctggctccaggggaaaaaagttcaaatttttcaaaagtattatgtaaacattgaagaattgatcatgagtcaaactgaatgtgggatttactctggagcattttctttttttttgttccagtgttacataaaattatacatgtgattatggttttattatgttattttctaaaagtgtttgtggaacaaactttaaaacaacacaaacacactgaagaaatgagacctgaaatgaattgacatagatttggaatctgagagttctatatttaccctaaataatgtaaagatacattgatcgtgttgagtgaatttgcttcaccctattggtgcaaatagcaaatagaaatatcacaaaattatggctttttccatgtagagccctcacaccagaatctttcaaatatgtttgttgttattttaaaaaaatctggatatttggcagtgtcatctacaagtaatgataaacactcactgtgatgccatgttttaaagtacaaggaaatcttgattgcatactctcatttggggcataccttaaccttttaaggcaatcctgttgttctcattttttagatgaggtaattgaagtgctgatatataaattggcatagcacagaagttatgaataaaagagttagttcctggaaaaatcatcagctgtttcgcacaaattgcagtagaaagaatgcagttcagaataacttttttcacctattattcatttatctgttatggtaacctgtatggctgctgtgtacattccagacttaattgcagtttgttcgtgttgtactggagtcacagggagtaaaaatgaaagatccacgacattcaaaactttgttctgaaaatcttgaaagtgttctgcatgtatattgtcacagattgatgttctttattacaaaaaaacaaaatagagtaggagatggaggctttgtgtggatatgtagcattgggtatgggttgagggaaaggaggtaggagatgctttaaataaatatatgttagcaacaaaaaatctaatgtaagtccacacacacacacagaaagaggtggaatttttgtgccaaatatcagtatgaaatgtatgcagctgggctgtgttaattgaggaaacatattactctggtgaaagtttctatttaatatcaacagtagcagcaatgcagaagtatgttatttccccaatgcaataatattcagttggccattttgacctattctcaaccactacaccagtgtattttcttaaatttacttttgatctctcgaagctactctgaattgaatgaactggtgacattggcttgtgtctgtggttagtgtgctgtgtattaaattatcgtctttgaacaagttgctaagccattaggaattttcttgaatttgtatccttaattccgcaaagtaaaaggatcagttccttagcatttacttccaagaaatactactgtagattagaggaatggtggtattagaagccaatcaggatacttgttggattaaaagtgagaaagtttaaataagtctcttgtgaatattagttatcaaggacaatgcagtttctaaactatatctattgcagtagaaagagactgtctatttctaaaacttccatcattagaattgatattaatgtgacccaaggagcccattttctcacatgccacttcccattgtgttaatgagaagtttcttcttactgtggcaggaagatgactctccaatgtgcatgctattcttctcaaaactagctcttctgtctaaagcatttcaaataattctgcaaatgagcagcaaatccaatatatgcacaattctcaagaaattagaacagaaacttcaattctaaagataaaaatactagattttttttaacctaaaataaaactcattagccttttcaatgtgaaaagtaggatccaaattaatttttttctttctctttttctctcttatctattcccttttttatttctctttttctctcccatctattccctttcctcatatttttagtactatgtttcacacaaaataatattccatgcttaataagtgttcacacatccttccagcaagccttttttgagtaacttcacaatctatgtgatgctatatgaatcaaacattctttccttgtgcttaaagagcaaaggtcaggcaaatgtttatacagaaataggagagaaaattcttaaaaaagggtcaatcagcaaactctagggccaggtataaaaggctcctgtaggtaagatgtgagcaaggaaacatgatatagcttctcatctctttgcttgaagtctatgctctatggagatacctatagtaagagatattttgaaaacagtaaaccctggtatagacaaacaccacgaagagtttggaaatactttttgagtgtcacataaagaattctgtctttcccgaagctactaaaacatgtgactagtagttcttatttatttcttttcgtttttggatattcatctccacagtcaatttgggctttaagagaactcttacagattgaggaattggctcatcatttatatttatttatttttgtgtctaaatgtgaatcatttatcaactcatttactgcaaagcaatccttgtgaagtagattttctcctatttatagatgaacatctgagattaagagatagcaaaaaccataattacttttgcaccaacctgagagtttcaatgttattcccccaggtgagattccactgaagactctctggctcctcaggttgtttttattctattttatgtggtgctactcagaaggatgctgagaatcacaggaaaacaaagtggcttgaggatctacttctgagatttctacctcaaatcatgatgcctgagaaattacatgatacagatactttgaattctgaaatttaagtcattaccccagagttgttatttttaacccactctttttttttaagtattttctgtgatttggcttaaagaaagggcctatatcagagttttgtaatgaagtgttgtcctttattgatgctgcagttttatcacacagtgaaatgagtaggaagagaggggaggaattaaaatggtggaatgtatagtggcagctgtgaggaccagaaaaaagcaaactgaatctttgcagctagagatggggttggcatagctgtggtatgggggtggggaggagggtgattaggacagcatttgctgagagcattccaaaaatggcatcctttctgattttgtgattaatcttataactaagattaaaggcttataaactactcaatatgaatacaaaaatcaacctaataaacctttgaatcttcaatgatcagttcaaggacagagattttggttagaaaagttggtggaaaaaaaatactggtaccagaaatgcagagatcggttcctatttattctcccttcccagcttcatctttcatcacttaaaccaaattcctctaatttcctgtgtacacgcaggacactaacattaaggcccagatgaacttctttaaggacagagaagtaaacagtgaaaggaaaactaccttggaccttagaaaaagtcagggaatcatcaatagaaatcttacagtcttttccttataaataatgctgacactaaagctgttaaaatacatgtttacagagcttttgttttggtgtcagacccttaataagtattttataagcattacctcatttaaagttcataaatcatggtacaatccccattttacagatcagggaacagtaataacataactaaatcacatatacgccagtaatgagactaagatgagaactcaggataacagactgtggacccgtgttttttgtgaggagattatgggtatatgagtggcctttggactaagactctcctggcagcctaaagaaacacacagaaatccaggtcatgtcttcaagcagcagagcagagtttgtgagaaaaggaaggtggatttaaagtttattcataggcctgtaaagaacttgggagatggaagcttttattctctggctttcagggaaggtctaaattcttaccatcttattcaataaatcatgtttacttagatattgcattttaatatttaggtgtctaagatatgttcaaatcagtatattccaaaatgagaaaaataatcacttgttatattctgttttgtagtccatttgggcttctatacaaaatgcaaactacaaaatagactggatggcttataaaccgtatagaaattaatttcttctgttagtgggaatatgaattagttcaaccatcgtggaaggcagtgtggtgattcctcagttacctagagacagaaatatcatttgacccagcaattccattactgggcatatacccaaaggaatataaatcattccgttataaagacacaggcatgcataggttaattgcagcactattcacaataccaaagacatggaaccaactgaaatgcccatcaacaatagactggataaggaaaatgtggcacacatataccatggaatactatgcagccataaaaaagaatgagatcatgtcctttgcagggacatggatggagctggaggccattatcattagcaaactaattcaggaacataaatccaaataccacatatactcacttataagagggaactaaatgatgagacatatggacacataaaggggaacactggggcctgctagagggtagagggagggaggagggagaggatcagaaaaaataactaatggatactaggcttaagacctgggtgatgaaataatctgtacaatgaatccccatgacacacatttacctatgtaataaacctgcacatcctgcacatgtaactctgaacttcaaataaagttaaaaaaaaaagaaatgaattaatcgaaattctgaaagttgggaagtccaagattagcatgccagtgtgatcggattctggtaagggccctcttctgggttgcagacaatcaacttctcactgtgtcctcacaatggaggaagggggcttgctagatccctggggtcttttttataagggaactaatttcatttgtgagggcttcacatcctaatcacctcctgaaagccccaccttctaatacgatcaccttgggagttaggatatcaacatatgtattttgggaatcacacaaacattcaaatcatagaatgttgtgtcccagtttggggttcagaaaattgagtacatgtgtaggcattcaaggatgtcaccatgatacaaatgatatgagggcccttcacactgtgttatacacagcggtcagcacacacatgttggtaaagtgtggcacacctatcatctcatgtgatcttcacagcaatcttgttagccagggactattactatccccattttatgcatgaataagataagccctttatgtgtttggtttatgcatgaacttcacaatgactcagaagcgagtattcattctggttccgctgtttaacagttgtgttacctaaaatgtcctagttcctaagagttttatttttctgttattcattatataagaaaccaagaaaagaagggtgggagaaggaaaaggaatctagcactgtgcttggtacaaatttggtgtttcatgcatgcttgttgaccaaaacgttgagtcagaatttttgtgctgtttagtcattcttgggagctgttatcataaagtctactaggcaataaaatgtgtgaaatttctacagaagcagcaggagttttccaaaatagttgaggtagactttaaagtgaattttaaactaagtcatttctttcccatcaagttccttctattgtgtaatctggtaatattatgacattcctacctctgatctcactaaagggctgtatttatagactattttataaattcctatgactcaccccataaagtctgtcatgatctggaactttaaaaaatgagaaaaatatctctgcctttgttagagttatgggagttaaataacacacatttttttaaagttttctgccatttataaattcccaaggaagagcattcttcactactttctaaatagggaagtttattaatatatcatttaatgggagatgaagatgacgatgatgatgatgagcctatttttagtacatacttagtgccagagattgatttaagctttgtttttagtcttcacaactgttcctgggatataaataattcctatttcaccagcaaataaattgaagctcagtgaatttactaattatcctagaaacagcaatacataagtaatagagatataatttgctctaaatttgagttctgcatgatgcatatttgaataaaggattcacaaacaacaacattttttaaatgccaacttccaaataccccgtttttgctccccatgcttctttggggctagaaattctaggcaattactggacagcaaccaaatagccatggaatgtgtttctgatttgggattcatgagtatcagtgatcagactgattcttgtttactgtggcctctgggaaattggttgacgcatggatgtgtgaaatatcagcagtgagataataaaattactagaaccagaaatgcctgcaaagttatttatgaatataatgcagaaagtgataattaatcctctggacattttttagcttttttaagagtcagagtacacatgatatctgaagcaaaacacatgtctgtttagttattttacagttaaacttggaatatcattggttgaatcagccatcattattccccaggaaaatggcttttggtcttctttccataatacaatacattgaaacactttgcaataaacacatcctcatgttcaggattttgttgagagcaatgttaacttacctgtctctcagttcttaaattctctctgaatttcttcaattatcctggggattggggatgggagtgatttgtaaatgcctagtgtacaggtaaaagtcagtgtcttagtttttatttgtagtgaagtcattactaaatgggcagttattatttcatttcataatatattttttcaaatgatttctcaataaacaattgagaaattaagtcattttaactattattccaaatattttaattatgcttatctttggtgggcaggatttaacaagaagttctttttacaatgacttttgaatctagtataaatgatatgcataccttctctaatgaaaaagaaatagctaaaatgagaaggaaaaatccattaatatatctatctatacctatctagctatctaactagtaacttgctgtatagttatttatctagctatcttcataggtaggtataggtacaaattggtagatgcatattcatatacatacatacataatgttttcaatgaactctactaaaatattaacagtgcaaaattatagtgggaggattatggagaatttatttttttataatggcatagtcttattctttgtcatataataagtatctatcaagaacatgtataagaaatgcgctcagtactaactggcatggaccatgcttcagctttgagtttaatgagtatcaatgaatagagagatttcatgtgcacttcctaagccatcacctcaatcatgaaggccttcttcagtctttcttcctgaaatgcaattgcatatatccttctttgggcatccatcctatcctgttttagtgcatcactgcttacttacgggccaatagtccaccttgtagtctttaaaacttaaagattattgggtccagcattccatagccaggaaatgaatcttggtgtataaaaaagatattaataaatgtcgtgagaataatttcttttctttgtcttgatactaccctgatacttagtggtcctgagaagcagtttgctctagacaccacacatctcacgtattttcttatctgaacgagtttgcttgataaaagaactactaatatgtccctttgaaattcttaatttagtagactgtagtgtttaaatatgttaaaatatcgattctaacttttaaaaaacattaactatagaataaaaaactttttaaaaacaaccataaaatcaacaactatccaatttctatggactgagactaatagaaaacctaaatacacactttacttaaaaaggaaataaaacaaaacaaacgaccaccaccaacaacaaaatgaaatcccataaatgcagtacagtcaaatgaaagtttaacaaaatacatgttttatttgaatggacatacgtaacatgctgcctagtgccatcttgctttgggcttgaattcattgttttatatgatattttgtggcaactgctaattatcataagctgtccaataaatgtgatggattgtccaattaactcttcatcagcatccatttttgaagatgctgtctattgaaactgatggcagtttatgaactacatgttgcatatgtagctaattgctccttggacaataattactaagtttctcgtgcctcattcagtcatttttgttttataaattatgatgccactgagtttcccaattcatttgatttcacaaatatggctctccaaggattactaaaggtctgctgtggaatgtatggatcatataaacattgaagtagattacagatgtgtctgttttgtaggttttccatcgaccggcacactgacctggagaggcagttcaacattaatgcagacgatgggaagataacgctggcaacaccacttgacagagaattaagtgtatggcacaacataacaatcattgctactgaaattagtaagtgcctggatttgttcatttcttccttgtgtgactgagttcaatttatgcttattaataacgtgataagcagcccctgtttctgttaggtaccttgacattggaacttatttgattgttcccaaggagcctttgaatgtatcatctcaacacaaaataacttacactgtggtaaattactgaaatgtttcaggatatgtgagaaggaaacattcttatatccattattcagccattaaaaacaatgctttgcattttaaagtaagaggaaaagatttagtataaaacagtaggttaaaaaaattcaagaactgtacactataatttaaataattggacacacatatacatatagtatggtacatacaatatagaaacacatatttaaatcatacacatgcatacatacatgtggaaaatatagatggaagctttatcaatatgtattattttgggtaggagagattatagataattttttgttttttttagagtctaatgtattttacacagtaatcataggctgtttaaaattatatcaatatcaattcaatgtaatttttttcatacattttgtgaaaacatttgagctattttattatgggggaggagagtctagggttgttaaaataacttgttaatctttttattgacttttttttcttctttgcacttgataaaactataatggagtctctaaacaatagctatatggtgaaatttggtgccaaactgtctttaagagcttacatctactttatcaacttttattatacaaaaaatggaaaagggagaggatgtccattttatttcctagcaaaaaacatgttgcttattatctgaatagcttctttctataaaggactttgaagttgtgcacaaattcaaaggagacaataaattccaagagagttgaggtaaagggaatttgaataagaaataaaaatcaatgttaagaaagattcatgggcacacataccatatagagaaatatagatgataattataggaaatatgccctaaaattcactcactgtctggcagctaatgtgaaaacaggggaaatatctctgtgaaaaatgattactttgtttgtatttaaaaaagagtaatccaggtgttcaggagaaacaatgttttttctggttttgtgatgtgaggaaaatgtcctctaccaagccttataaaaagaacgcttgtgtgaaagagtgaagattcaagagtgaagaatgtttgtttcttttttttttttttattatactttaagttttagggtacatgtgcacattgtgcaggttagttacatatgtatacatgtgccatgctggtgcgctacacccactaactcgtcatctagcattaggtatatcttccaatgctatccctccccccgccccccccaccacagtccccagagtgtgatattccccttcctgtgtccatgtgatctcattgttcaattcccacctatgagtgagaatatgccgtgtttggttttttgttcttgcgatagtttactgagaatgatgatttccaatttcatccatgtccctacaaaggacatgaagtcatcattttttatggctgcatagtattccatgatgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttccagtcccaccaacagtgtaaaagtgttcctatttctccacatcctctccagcacctgttgtttcctgactttttaatgattgccattctaactggtatgagatggtatctcatagtggttttgatttgcatttctctgatggctagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattccggatattagccctttgtcagatgagtaggttgcgaaaattttctcccagtttgtaggctgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtagtgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtaggcggcgttatttctgagggctctgttctgttgcattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaggaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtatataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcgtctattgagataatcatgtggtttttgtctttggctctgtttatatgctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaagcctgggcaatggcgggcgcccctcccccagcctcgctgctgccttgcagtttgatctcagactgctgtgctagcaatcagcgagactccgtgggcgtaggaccctccgagccaggtgtgggatatagtctcgtggtgcgccgttttttaagccggtctgaaaagcgcaatattcgggttggagtgacccgattttccaggtgcgtccgtcacccctttctttgactcggaaagggaactccctgaccccttgtgcttcccaggtgaggcaatgcctcgccctgcttcggctcgcggacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccgaatgtttgtttcttatagcagccttgagtgcaggcagagaacatgcagtcaagttgatatgtagtttcaacactgccaaactctggctctggatagaaacagagctttggaaactttgctgtttcccctgccttaggagtactattttcttccctagtgtcttaccatcacggcagtttctccttgtaacatgaagagaagaagcaaataaagcatgccatttggtgattttggtttgttagaagtgttaacctcatttagaaagatgtaaacataatttttttagtaatttaccatgttgaagcctgattatcaccttaagcctctcagaaaagttgtatctatttagatgacttaaggctttataaaaagctcaaaaaaatccagtcttctttaatgtggatagtcaataattataaagaattttcacatatactgaaaacaatctagtagagttaaacttaattcatgttacctttgagatagatctctctcttttgcccaggcactatatcatagctcactccaccctgggctcaagtgatcctcctgctttagactccctagcatctgggcctacaggcacaagccatcatgcctggctaattgtagttttttttgtttttgtttttggttttggttttttttttagaaacagggtctcaccatgttgcccaggctagtctttaactcctcacctccactgatcctcctgctgggattacaaacaggatccacaaccaaggcccatgccacctttttaaaataagatagactcctttacttaaatatccatcaaggtttatgagttatcagcaaaatgtactcaaagcaatgaatacacagagcttggcttaagaaacatttcaggacaatccagaaacaaaagactcatttttgagaaatcccacacaagtaagaaaaacagatacaaaaatagatgctccagggcattgagctgttagctgcagggtgacaaggctaccaagctcagtcagggaagatgttcatgcacaggtgcattttggccaagaaacaagctgaattcatgtcaaacatcttaagaaatattagactgcaaacttaaaaatctgtctttgtttgaatttttgcagatttctttcttagaacaaacaaggatgagaatacaaaagagagctttaaattttagttgtaaaatactagctggggtggcataaatttgagaactttaagtgtacaattaaaccatctattttcttaatcataaagggaagtggaaatcataagatcacagagaaattaaaaaaattgaaattactatgaacatagcttagaaacttgttttgacttgatttgattatttagcccatcacatgatgtttattttccaaagccacagaccatgtcttggggaaaaaaattaaaaggagatttatagaatttgtctgagatgaatatttaaaaccattcagaatagcagaaccccatagggggaggttctaataatgataaagaaatagtcattccagggagaacaatttaaaatgactctcagaatgctatctcatcagataaaagatttaaacaaatgaaattaggctaaaaagtggattttagcaaagtccatctgttatctcttaatgagaatggagatgtcattctttatcctcttgtgtcagattcacttaaccgaggctgagatgcttcactgtgtttattacccaagtatttcagtggtagtggatctaacatgttatcctgatcaactggcacatcttatcacatgagctggcaggcagatgtccatgtgctaacaagagattaggcttgtatagtatatctctgctagtagcaaccccattccctgaaactacagtgcatggctgctatttaccatgatgatgaagatttaaggtaaatttagctgaataatgaaaacaatgagaaaataaactgaaaaaagcccttcgatgcttttaattctcataacatttgctgaaaagtgactactattattataagcattttccaggcaaagaaactcagatacaggttaagtaacttgtcaaaatttcacagagggcaaggatgagagtggaggtacaggatcagatctttgtttaactgcagaatatatgtccttaaacaccttccacagaaacctcacttcaatcttctttcctctttatcttcttgctcaatttgagcttctgatactgctacatcatttcttgaatcaagtgaacgaaacggtttttctgtgcaaaggagaaggctagggcaaggacaagggtgaggtgaaggaatgaaaaagcatgcattttattatggagagtaagaatattgcctaataaacatagcagaactttggaacttttaaaaccagaatcctaatcccattttatagattaggaaactgaagaacatagaatagagaacacagcatagtacattttagaaggctgtttttcaaagcagaccattgattagaattgcctagaaaattgtctaaaacaaacaaacaaggaatagtccagatttcgtttgagacctattgaattagaatctcaagggagagtttcaggaatttacttctcacaacttcttccttgtttccctcaccatgcgcgcacacacacacacacacacacacacacacacacacacacacacacataaacgaacattaaaatttgacaatactgcaaagggaggcaaagaaagatgaggcattgttggtttgtttgttcttttttttaaaattttcccatgctgattatagccataggacagtaaagaatactgagaatgtgggaatcaatttgcttagaatagagtctctgcaggggcattttagatgcactgaatgctcattttaaaatgtccttcacagagaacgtgatggtgtggaatagaaagtttcaaaactctctgacactctgtacctgggagcagacaattggcatggcatttgtagaaagtacatgactattggttacctgaaagtatttcaaagcaggaagcatataattgcccgttaaattaatctctctgagttagtgataatgcattgctctggcccactacagcgggctgcacacattattgcaaatgaagcttttcgctaatgatggctaaatctcccagggaaaacactagttttattgcacttaaggattgttttttcctagcatggggcccagttgccagaataattgctttgtccaacccaggctacttagaaaaaaatatacctttataggcagttcattgtttagaggaatcttgggttctggagttggatggagttggagtccttgccacattttggtcatataaccttgggtacattatttctcttttactctcagtttcctcgtctgtgaacggaaatgattactctttaaacttgtgggtatagtgagaatggaaataaaaatgatagtactacgtcttttagcaagtaatttacctacaatcttaagaaaatgatggagacatagtgtatgttcttctagttaatagggcccttaatgggggctttgaatcacagcttcatttaaaattatttatttaattttttgtctgttaccctgccccttcccacaacaaaatatttggtaattatggcctgtgtgttacttctaggtgcagttatgtttctgcattgcatagccaatatgtttgttcattgaccttcttcttgcccttggttgaggcatggtagattgatcaatggctaagcaacggccctcataatgaagcaggcacatgcttactaaagactttagattttatatcaagattgtgcttcatatatatccatctgtctctattgcctatgacatagagcgagagcaccataaagattgatagctattcccttgtgcagggtgaaggggagatagtgggagagaagctattattgagttagataacacccatggaagagaagagatgataagagcctaaagtgggcagtgaaattcaggtacagaggtggttaagaggctccccaaaatcacacaggttgcagcagtaagactgataagcctgtctgggaatatagtcatgtggcaagttcctatctagatcccccactttagataggcatgcaggttctcaaagctggagatcaatgttcttagcaaagagaaatacagtgaaggaaagtgaaaactaaaatatggaaagttaaagggaagctacagattcctggggagggaatcagcatccaaagcatgatttcctacagggaagaattggggtccatgtccttccaagtccaaggagataagtgatgcaggcacaaaatggatgtaattctgcgcatagcccatgtcagttttattctaatccttgtgactctctggctacccctgcaacgtaggtagcagtagatttgacttgggaattcctccctgatttttactttgttctgcaaccattctactaattttctcccaccacctcttcctttcatctttcctgcccttgttccttccagtctaagaaagaacacgtggattgagaatggaggaatagattttagccaggcattcctttaggatgtcagtgtgattaatagcctcccagtcctaagctcaaaaataagagtagataagacgcacctatacctacatcttgcccttgtcactctttataaaccaccctctccaaagctgtaacaataactcttactgtagacaactatagataaaatatagaaagaaggtaagcagaaaacatgaatgctagcttttcaggtgcgagttgctgctaactggtagctcatagcaaatggttatctccaggtttgtagtaccatattaaaggaagtaaggaagaccctagatatctgaacagattttaaaggtaggatagtattgggttgatttacccctcaggctttggttttctttagggatggagaagtcattaggactgggaggagaaaataaagttatcagtccagcagttgaagggaataagatagtggttaagtatccaggctcataaatctgtttgctaggttggaatcattgctttttcatttatccatgctcactcttttgttaagttactcaatttctctctgtggtggcttagttttgctatctataaaattggtaatgtgtttaaatttttattttaagttcaggggtgcatgtgcaggtttgtaacttaagtaagcttgtgtcctgggggtttggtgtacagattatttcatcattgaagtattaagcctagtacaatggggaatgtgttggtgcacctttagagatgtgtgatgaagaataaatatatttaagagctataatcttgcctaacttaaggtaaacttgataataatgtcaatgctaatatcaattttatagtattaatcataatataaactcaattctatcattattgtataattaaaaagaatttgccaaaaagtgaccatgtttgtcatcaagcaaaactacccaacctaatccagagaatctctcaaattgtttgttcaggaacatatcactttgggattatttgagggacataattttccttgattatatatattaataggagcatcttctttcctctgtcagtcccaagtatcccggccaggttggcaactttaaaagctccttcttcatccaaaaccaaagtcataggcaagttgttctaacaatttttttttataacaatagaggttattagttaaggacataagctgttgagttatagtagaggttattagttaaggacataagctatgaagtcaaattgccccagtgaaaacattgggtctaacatatgttaaatgtgtgacttaaataagttatgcaatctctttaggtctcaacggctatatttgaagtttgttatgggagttaaatgagataacacaggtaaattgcgtaaacagagcctaacttatggtaaggacttgataatattctttgtattttctctttcatccccctgccttcccttttctatcctcctctctatcctcttccagatgaaacctggtgcttgccaactcttacattccctatcatctcagtcctatatctaaaggattgtatttgtcattcattttcttcctttattcaaaccacttgggcttagagagaaagagggctgaaatagtcatatggagatgttaatatgtattaattcacttttgctacatattacatcatgacacaatttggtgacttaacataatgttttcttctggttctgtggagcagctgggcacttcttttggtttgaactggttttggtactctttctggtcagctgatggcttatatgggaccatatatataagctgatggcttatatgggccaagtcaatcttggcctcacatgtatatatggtgggccgtttagtccggggtgctttagcagacacagcttgtctctcatcctctagcaggctagcttagctttttaattatgttctcaatgttacaagatgcagcaaagcaacaggaagccccggtgagcaagcactttacaagcctttatttgcatccagtttgataatagttcattgaccaaaacaagccacatgatcaagagtgggtagaagggctagagaagtgtcatctcttgatgagaggagttagaaataatatggccatattttttctttttaataatatacttcagacggggatgctgaatctcagtatgtaggactgagggatattgatttgtagtttccacataattactctcctgccttctttccagaatgttcttctcaggataatgcatgcatattcaaaatcctttgctccaatcccttatttatctggcgaaaggattggacataatatttctctttttattacttattttttcttcattttaattttattgtttatttatttctttaaaaataaagatgggatctccctatgttgctcaggccggtctctaactcctggcctcaagcaattcacctgcttcggcctcccaaaatgctggggttataggcatgggccaacacactatcaggacacaatatttctaacagccatcaattggttaactatagattctttataatttcatcttaaatagcgatttgtattaactcattttatgtattaatgcatttttaatgcttagaacaacttctgctgcatacaagctactgtaagtgttagcacttattatttattatctcctgataccctggttggatctggttcctttgttataagtcctcactttgttgtacgtgtttattttcttttaaataactgttcaaggcttataacacatacgtatttggttgagcttttgaaaataaattcctaagggcagaaatagttaagttccctgttctcatgtaacatttcattattgctttatcctgtgggcctaccatagtgctttggggctcctaataaatattggttaaatgactgaatgaatgaagaaaggaaataatgaattagtataatgagggagtaccctgatgatttctaactccaaacagacactattaattgattggcagggaggatctttttttaaatataccctagacagctgtttgttaaaaatcccatgcagataggtacacatccattatggctttctggatctttatgtcttttttttttttttttttccctgagtgattgaagctgagacagaaagggcagaaagaactgtgctctccttgtagaaaaattgtggggcactgactgtgttcacagggaaggatccccacagaatattaaccaatcttgggagttagagaccatgagaaaggtgctggcagagaggagcctcgcgtcccctgtctgtttccctaaggactctggcttctgatcttggaaccttgatttttcttcccttctgagagcctggaggtaagccttgaataatgccagcccacacttcattacccaacaagcccgtttatcagttggtctgatctgtattgaacaagtgcaagcaggttacaaagcagcaaagccaaaagaatgaaaatgcagcatgttttctgattccaggactccctaatccaaagcttagaaactggggctaaaaataggcaccaattccatccttatccacccctacccaactggcatttcagtactaggtcaggtatccccttagccagatgatggacatttaaatgataacttggcttccatctcatttgggctgtcagggtgtcagttactccactcacttacttgtaatgctgatattttctggtccctagagcctctataggacaaggactcacctcacatatcacccagattcaaaggttatgctatttgtcacaagaataagttatgcctgctccttttatggctgccaattctatccaccctggaattcaaattagctaagaaaaaagaaactaatatcctttgaacagcatctttgggccaggcactgtgtagatctcttgagaagctctgtctgtttcagccgcactgaaatccttggaggaatgatgagaaaccatactcagagatgtggaaccactgccacaggcccacaaagccaaaactcacagagcaattcttgccaaaaacatagtactcccatcttctcacatctgtattatttctctaaaattttataaacaatacacaaataccagtacagataggattcagcttatttctgtaacttttccatttgcaccaactgtgcattaagaggtgagcacttaaaaaacaagacatggctcctttaagctttgcaaagtggggacaacaaactagagacatgcatttacaactctagcaaatcattcacacaaaaaaatcatgtatgtagtgtggagtagggtgagattcttccactacatgggatagacagtgttctctgtgaagattctctgtaggagttttcatcaggattgtgaagtagcagtaagagatgcatttaaaaattagaaaatggctttatcaagagaagaaaaacttagaatatcttctgaagatgaggggaatcaggaacgtgaagtagatatggctagaaagttcaagtaaagcctattcagttaaggatattatgtttgcctttgagtgccagatcaaggaaataatctcattctccacattaaaagggcccatcaaatgcattgaaataggaaaatatagggcccagaatattagcattcaaattcaggagcagaataggttatgaatggagtagtgagtctatgacatagagaataggaaaggaaggtgtttcttaaattttttggtgcgtcagaatcacctggagggcttgttaaagcatagcttgctggccaggaatttgtatttctaacaagtttccatgtgaggctgatgctgcaggtccagggaccatgccttgagaaccatagctataatccccgcagtcttaattcagactaaaactaaacctgtattagagatggagtttgaataaacagaaattggcatctggttaaaactaatgagaaaacaagaaaagcaaattctgctggagatcacaagccttgacaacaaggacaaatataattacaattaaaagtgtcgcagcttactgtgtgctaggccggtttttaaccctttctgtattctttggcatgtttaattttcacaataactgcatgtgttaatgccatcagttatttcatctaataaaaataccagagctcagcctcattggatttaatcctagctttgtctcacttttcagactaatttatgaacattttgcatctcaattctcctagggaaaacccaattgctattaagacataccgtgagtgatactaacaaatcagattacagaaaagatggcccaacctttccacagccttccttcatccagtttgtaaaagagttttgaacacaatgagatattactggtaggctttcatccccactgaagtaactgcatggagtggttaggtgggggaggtccagatgagagttaggaatttaacatttgcatctgtgatctttgttccagaggaatttggatatttagaaacctctgggttctgaaattttaaaataaaatagagtttaaatgaggagctggtgttgaagtttgagtgctcctgctgcccactcaaataagcctggaatgatgctgaagtctgttccacacctgttgccataatttaacaatgaatgagtaacattaggctggagaagggaggtgtggatgacaagtatggaggaaaaaacttgtacactgcagtcaaatagatatgaatttcagtctaggtttccttaaaaattacctgcttgaaagaaaaactttcctcgacctatataatttatttcttattggttaaaaagaaactatagtattcaataaaaagctgtaactcacttgagttgatgtacagaatatatgtatgtgtgggtgtgtgtacatatatatatcacttgacatgtttttgacatgtttttgacaatggtaatgccaaatcttcatcaatctgttctttcagttagattgtactgagtttgatgtttaaaggactctgactttttagagcgcctctgtccaagctttgtttttgtttagtaaaacaaataagcagccctaatacactgtaaagaaaaattggttaaaaaaaagtttttttttttttttttttttggctggcttttaaatacagcttgtcattagatttgtgtgtgaggcatagtatccaaatctctttgctggttcatatttgagtatctctggatataaaaatacccatactgagccagcatttgatttcctgctgaactgtttttcacatttccaatataattatgtagcagttacaaagaaacaaaaatctgaactccacagaataccatagaaacccacattcatttatttaagtaaagatataaaaagaagataagacaggaattgatgtgtcaggtgacttctcagggtaactgatacctaaaataaatctgtgaatatctggatacctattaaaaatgattggttagacatggattttaaaaggcaattatatattctacaaatggcccctggtatttaaataggagatcttcatgaaagtaagtgctgaatttgatatctttttatttgagccttgttttctgtatgattgcttttgtcctcagtacagtccagattaaagagttttaaggtctaataaaccattcacttggtgtaccaaataattgcaaagtgaatacagaaaacattagtgagttgaacacattttttgcccacctatcctaggcacttcagacacagattgttgaagacctagttcctggcctggcggtgaagtttctgtagtggagagggcaacttttgaactacagttacattgtttaattgaaagagacagaaagcatccaaaccacagataggaggaagaaatgagttctgtatgatgctttctctggtgcccttcgcagtcaatccagatactaccatgtggcaagtgaagaaggaaagcaagaatgttagtggcaaagggaacagcatgaagccatccaggaagttttggatatttttagatgcaaaggaggaacttgttgatcttggtctctttcattcagctatggttatgatagacttcattgtatgtccatctggagactgtgctttaggaatgagtaatagactaacaaggaagcctcagtataaatagatacccaaggcctaactttggttgaagaatggctggagaagctgtttcctgggcataataagaatcatgacttagggaaatggcctggatgcaaaaagagtggtacatacacttgccctttcatgctctctattggttcaatgtctagatctgtaacattaaatgatatctgcatgtgacaataaagaacagaaaataaaccagcatttaagatgctacttaatcccaagcagaatgctggtctctgtgtacttacatttcttgtttcattcaatcctcataacaatgtttagatggatgtaacctgaacactgttttagaaatgtgtcatgcgagactcaggaaagccgggacacaaggaaaagcccatagatgtaataaagggaggtttgaatccaccagatttgatgtcaaagcctgaactctctctactccttgatactactaagtgtgatagatgggcaaacatcctctaaacaaggttcatctttgtacagagtttcaaatgcaccattattcgccaggtcctatattagataatacacatataggaataaaaaatccaggaatcacattgcttacatcaacttggttgcaaaatcataaaaatagcaatcatagaatatggcatgttcattttatccagtgtagtttggccatgaagtttggcttactgtgactttcacatgaatagtttggtctttctttttaatgttcacgtactataattattttatctgcaacagaaacatctaattttaaaagtcaaagaggtgggtaaaataaatccatttgggaaatgttgattcaatccatgggattattgtaattgtacctctgaacatcataattctcttcagtatgtggatgaaatgagacaactactaagttttttttttttgcatttctatttgataaatctttagtgtctgtgtttcacatgatagtgaagagcacagatttagacagaaaggtatgggattgtaaactgaccacgatattgggaagttatgcaatgttagtcaaagtactcattccttttaaacctcaatttcatcacattaaggtgcagataataatacctttctatgttgttgtataatgcatgtaacatagtaattagtcttaaagtgagtaattgaaacatattgggggagaatggggcaacagacttttattctttaagaccataatattcaaagagtggtccagggatctttagagtctttgagacatttttaagcgttctgcaaggttgaaatacttttttataataatatgacaacactgtttgcctttgtctgtctcacagttgaaagtatacttttccagagactatatggcacttgttaatatcatagtgagccattagctcaatggccaatggaatctgtgcttctatattcttgtgtgtgtgtgtgttcaacttacaatatggtaaatattgagaagtacaacccaataacaaaattttaatgcataaagggttttggggttcttcattaatttttaagtgtgtgaagtgaccctgagaccaaattgtttgagaactgatgccttagaaagttatttattttctcaattagcttgaggtaattagtttgagatatagtaacaataaggattgttactgttaatatatcttgaatataacattgatggaaacagcttattacctgtaaaacgttggttggctattcaaagaagtaatgcttataatttctttattaggattcttggtatggagtaattagtaagcactcaaaaaatgcagatcattgttaagagcagagtgaaaatgaaggtaaccccaaaggaaatacattggcattataatttacactttcagggtctcaccaaataaggttgccttctcaagagacaaaattgttcccagggcagatcaagactcgcccattgataactcctttgtattaccctttcagaacaattaatagggtcacacagatagaaactggggaaattcatccaggcactgcgagagagagagggagagggagagagagagagagagagagagagagagaaagggagagagagagagagagagagagagagagagagagagagagagagagagagagagagagagagagagagagagagagagaaagggagagacacagagagagagcctgaagtgctcttccgggaaccaaccctctggaactagaggagattatcaattataaggccactaaaatttaaattacacatcttaacctcatggctttaactccatgtttttcaaatcacttggtgattattttattcaattttagaaacagttgcaacaatatatgcttacttaaataacaataataacaaccataataataacagctaccattccaccatttcttgagccttattttctcagtgtttgacacaaagcactttgaagagaatcacccaagtactttacaaaactgccccatgttgtggggaattctattatcaacactgtaggaaggagaaaattgggcagctattgtatctctctgagttctaaagactttgcagcaaataattgatggagccaggctttgaggcagaccttctgccttaccgatatgccacactccaaagcttttggcagacatattattttttattgtaacttaacaaattagctttattgttaagtgactgtcttcttagaacttggctaatgcatgtctgtgctgaagcaacattcactttaggaatgtgctgatagactaaaatttctgttcctaccaaattgaggacaaaaccctaaatctcaatgaacctagcaaggtgactgacattttgaaaaattttgtcatgaatgagggtccttgccagagaagaataactttgacctccctacttttttaatgttagtaacaggaattcttaacatttgcattatgatatcctatacattgcacactgattctttattctttactacagcgaagcctcaaaacaactatataaaatggtccatggctggtattattatcctgcgtttcaggtgatatagccagaactcagacagctgacttgtttcctgaagatcattcagctaagatggtgccaagtaattcttcaaccctaagacttttcatgaattcataattagaatgtgcttaactaatattcattttgcaagcacggatatacatcagattgattctagtgatacaaactgtgacaatgctaacaatcatagcttatgttgcttacactgaaaatcaccatcacttttgtagagtgattattttacttagaaatggtatgaatagtgtcgcacacacacacaagtcatgcggaaatcattttggtagacacctggggtagtgtcagcatagcagaagaaatatcatttagaatatgaatatttccatactcttcaagagagcaagatgtctgatggcttgctgcatagaatgcccattctctccttttgctgcagattgttttatccaaagcacgtacgtggatcccaacagtgaagtatgcttgcagctcaaaggttagtcctgcattttaaaaagccagtataaacttggcctgaagctcctcttcacaacataagtaacttgcacagaacaaacgagtattaacttttttagcataatttcctaacacataatattacgatgaatagatactgaagtaggtaggttatgttatctccattttataaaattgagatcaaagtaaaaccagaaatgagatactaccttacttcagccagaatggtcattattaaaaagttaaaaacaaacaaacaaacaaacaaacaaacagaaatagacagtgtggaggtgatgaaaaggaatgcttatacactgctggtgggaatgtaaactagtataacgtctatggaaaacagtatggagatttctcaaagaattaaagtagatctaccatttgatccagcaatcccatgctgggtatctacccaagggaaaagaagtcactatatcaaaaaggcacctgcatgtgtatgtttatcacagtgcgattcacagttgctaggatatagaatcaacataagtgtccatcaaacaatgaatggataaagaaaatgtagcatatgtatgtataccatggaatactactcagccataaaaaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattagacccatttttcagtttagaaaataagataaaattagatagaaaatcattttcctaagtcagcagtaggaagcttgaccaaaccactccaggtttacaattgcaataatgctctgaacgatttacaaatgttagctcattaattctccaacatcacatggaaattattttttaaacttttacatgatggggtatttgtatatctgtatctatatttatatcctaaagggaaggggggtaaaatatttctgtacattaaaatgaacattggaaaactgagaactaatttgagttcatttctttgtctacatcatgccaccctttacataaccctaaatccttcaataactcatgatatgagagactaggatgacagagaatctctagtgtacttgagcattgagatgaactaaaatgtacagtaacattaatctgacagttttgctggcatgtaaaatggttaccatgttgcatcaggaattgaatatgaatagttaacagttcatatagatggtagtaattaatcttagttttcctacgggaaactgagtacatttgaaatcatctgtggaagagaggacaagtactgaagaactctgatttgagtctaaaatctactcctttctcagctaactccttctgacctccttctattcattttcgattccccttctcacttctttcattgaagaaaacagttttgggcagagagatctttgttggagttttgactgggccaccaacttgctatgtgactatgggagagtcatttcctgtttctgagtttcagtttcctgcttcatggaatatgaatgataatatcaatatcataggaatgtcatgtgatttaaagtagagaagccatattttgcacatttcactatgcctggcccattgcaattgtcaagtaattttagtagacatattaattcattcgattcatatgtatttctcatcctaaattatttatctttgaatatccaaggctatcagagaaactagcatatcatgttcaataacattagttgcgattgttaactattattaatgaatgtatgccttgctccattagccatttattttgctcttacaggtataaccttatttatttatcacttcacgtaaagatctatgaaattatacagaatcctcacctatcccctaacagctttgaaacattttccagtcatgcctccctacttattcaacaaaagaattaaaaactacccttcccttgaaatctatctactctatgtgaattgtgctattttcctgaagttaaaccctagatataaaaatgataaatgattttttatgctgtcaactgtgcaaccaggtaacgcttgattctgcctgcacacttctacagaattgaagtttggaagataaatatgaagaaaatcctatccaggacaatcagagatttcccattcaactctagctcccaacagtattattttacggttagtgtgcattctgtagacttggagtcttgccctgtgatttacatgagaggatcaatgggatgctttgcgaaggaggaagagaacatgcagactttctgctatcctgaagccagaaaatcctagggtggtagatttgaagttcctgttatgagcttagtgttcagacagtaatatggtcagaacggtctgagtgaatactggtatctattctgaccctggcacgtgtgtatgcaattcatgacattccctgctgtaaatgcttggaaaccagaactggcccactggagctggccgaatagacaaagaaagcctgggcagttttgcacagtgctatgaacataggctctggaggaatccaggctagaagactctttcctgttgttcttttacatcctatgcaagctgaaatcctgggtggcctccttatgagatgtgtgattgagggcaatttgtttaacatccctgccccagcaggaagttggtgtccaaatgctcttattttcaccagaagcacagctgcattttgatggactgcatataatagttgttcagcaaatactctaaggcactgcttctcaagcctttatatgcctatgaattacctggtgatcttgttaaaacacagattgggattccctgagtttggggtgcagattctacatttctaaaaagcctctaggtgatgctgactccagtagtcattggctataagtaacaatgctctattcatatataatacacatttaatactatttattcatatgaaatagttatcacaaaacaaaaccctaagctaatgtctctgaaagattagcatgtagcacgctcacctgggaaggactattacagattacttggtgccatcttcagagttcctaattcagtaggtcttgtttggggcctgagaatttgaatttttcacgaatatctaagcaacactcatactgcagtgtagtccactagttgcaaaccattgacctggaccagttccttccctatctggaaacttctgttaacagttttgaaaatggtatttggttttccaatcttagggaggtaatagtcatcaggaagttttgttttttacttagactctctattttcaatgtttgcatgcagttttaagaaataatacagagagactctatttatcctttacatagttgtttttccaatggtgacaatcttacaaaactatatagtacaatactataaccagaatattcacatggattcagtctacccagtttattcagatagccccaattgtccttgtatgcattgcgagtatatgtgtttgtggttagttctgtgcaattttaccacatgtgtaagtttatgtatacaccaccacgggcaatgcccagaggaagtccaccaccaccaggatcccaccatatctgcctacctccggagcctcacctcccgtctttagttcatggcaaccactaatctattttcaatttttataattttatccttttctttttacttattttttgagacaaagtcttgctctgttgtccaggctgaagtgcagtggctcaatctcagctcactgtagcctcaacacctgtaggttcaagtgatcctcccacctcagcctcccgagtagctgagactacaagcatgtgccaccacacccagctagttttattttttgtagagacagagtctcagtatattgcccgggctggtctttaactcctgaacttaggtgatccacccacctcggcctcccaaagtacctgggattacagacatgagccactgcacctggcctaattttgccattataaaaatgttatacaaatggaatatgcagtacataacccacaggaagatgctgttaaagcttgctagtgcccaggtgtcaccactgtattcttatttgttttagtgtggaactcatacttttgtattttttgaagcttcccaggtgatcctaatattcagacagggtttatactctgcctaccattaagggaggtctttagctctagggattgtttgcaactcaaaggatcatgtggatgaacttccttttccaatagccaaaaacacaaaatgcacatgtaccagaattagttatcatcaaagactataaaaccagaaatcttctgggaaatgcattttgaatatgtatctaaagcttcaatttactcctaaatcaaacagaaagactgtttatactgtaaagatggtctctatttataacttgcagaaaagttatttataatacccatgcaacattgtgtttgaaacactgaaattggcagttatttcttctgtggacactcatgcttttgtttttctgatcaaatattgtctaagccagatcagaaatattggtattcttcttaattttaaaagtatcataattaattttaaattatacacacatatttatatatgtatcatgtgaaatgttataagaaaatcaatgtcatgtgatgatatgggtgtatttgtgtgtcatgtgactttgaggaaaataattttcagtaaattatagatctgcaaattgatactcttttggaaaacacaattacttcaaattcattgtttatgtcttccctctgtttttgcatcttcttgaaaacaaaccttacaaatacaatgatgactcgtctttgtttgatatttataattaattttaacccacattttgagttatttttatttgtttaatgttaatatatcaggtgacttgctagatgtttcttatactgcctcatgtaattatgtttacactatacataactaatatgacaaatagtcaatattatctgctaaaagtattttagttttagcctctattttagagattctacttaaatatttctagacatttcaagtttagaagagaggctgttaaaattctgttccttgccagatgcggtggctcatgcctgtaatcccagcactttaagaggctgaggcgggagaatcatttaaggtcacgggctcgagaccagcctggtcaacatggtgaagccctgtctctactaaaaattcaaaaaaattagctgggcatggtggtgggcacctgtaatcccagctactgggaggctgaggcaggagaatcacctgaacccaggagacagaggttgcagtgacccgagattgcgccactgcactccagcttgggcgactgagtgagactctgtctcagtagataaataaataaataaataaataaataaataaataaataaataaaatttnnnnnnnnnnnnnnnnnnnnnnnnnnnnnntaaccccaaacttagtggtttaaaataatagtaaccaattaatttgttcaaaaatgtatagtatgggtaaggccaaacagggtcagaccatttctcatctagacagtgtcaactggggtgggtttacacaggctggaagacccatgtggctcactcaaacatctgggaaactgaggtttgttttggttctcctccataaacgtttccttgggttggggtggggggtgtgttggtatctgtgtttcatggtgtccatgtttcatggtattggtgttccaagactaacaatccaaagagtgatagagagtcaaacctgccattttcttaaggtccaagcagctctgatattgacacaacattcgttgcatctgtcatcttcaattacttattcagtaagagagcccatatccaggggaagaaactcaatgagaggagtattaaataattaatgtcatgatttaaaacaaacacagttgacctttggccacaaaatatttgcattcctactaaaaacactctgagattttaaatcattagagcatcatcctcgagctgacccagtatacaatgggggaatagaataaggataatttctgtagacagcattactcaagaacagagaaagtggaagtcatatggcagttactggtaaatagtgattcttggaatcattttggcacatgttactagttccttgatgagtatccagtactgtttcagagaactgattctcctagacttttgactctagacacatggctcttggttctgttcccatcctccccttctccatcccctcttcctcctcctactactgctatactactactattactttccttctccttttccttctcttcctcttcctcttcttcctcctcctcctcttcctccttcttcctccttctttcttctttttaaaaaataaattatctgtgtctgtaactgagatgtcttctcaatctgcatgctgcctgtaaatgtttgggagtctggcagcattttttcattgtttactgtcttttttgtaaaagccaatatgctttctttaaatattttgtaagtttcttacaaatcaatttgtaattcatttcattagacagcaatcacactcacaaatctcttcagggtgagctcttcttgactttggacacctcgtgaatctgctgtggtcaatgctgttacgattcttagtagagggtctatgagacataccctatccttagcccatttatgcctcatgttccatttttggaatgctaagcatgtgggagttcgttatatcctactgctcaatggcgtcaccaaagtcagatttttcacacccaggaaattgcaacccccagcataaatggattaagctcctcagaggaccttctatttctttgaaagttctagtaaaaaaacctcagatctttctgagatattaacaacaaaagatcatatagccccattatgtatttgatctatgaactgagactctttcttaatttgagaattatttttctctggagaagctgagaatcaaaaaatatatattttcaaactcaaacattgggaagccgaggtgggcggatcacttgaggtcaggagttcaagaacagcctggccaacatggagaaaccctgtctgtaccaataacacaaaaataagccaggcgtggtggcatgcacctgtaatcccagctactttggaggctgagataggaggatcccttgaatccagagggcagaagttgcagtgagccaaggtcatgccattgcactccagcctggacaacaagagcaaaactcaatctcaaacaaaacaaaacaaaacaacaacaaaacagaacaaaaagacctcaaacagtcctaatttcagaaaaagtttcttctttaactgatttatctctattcacattttgtttaggtattgagaaaaagctatatagtaatctaatattctgcctcttccttgaatctctttaattaaatcatcaaattcactaggggcattttctttttttctacatgactcaaaggtgtcatggtcaaaattctcaccagtatatacacaggtttcctttcatctaatttccaataatattttccttgttgtagttactttactgtgagatctcaccaacagcttctgcaaatcctttgctctttcactaacaacactatccctgaggaccattaagtttttactaacaatattctcaattaatctatctccttcctgccacctggtcccagaaccagtgccacatgcttaacgttgtcattacagcagtaccttacttcaaggaactcaaatctgttttgattatctactgcggcataacaacaaatcccagaacttagcggcagaaaaaaacatcaccatttattttgctcgcaaatttgaaatttgggcagggcttgccagggtcagtttgtctctgcagaatgtgatataaactggggcagctttgaagagactgactacccagttccaacatggctcaatcatatggctggcaaattggtggtggccatcactgcctttccaagggagagtttgggcttctccatggcctggtatttgcattccaagatgaagtaccccaagagagatagaagctgctaacttcttaagacttgagcttagaaattagcacagtgccacttcgttcatatactattgatctatcacagagcctatattcaagagaacagctaccctatctttcagtgaaaggtatttcatagaatttggagccatgttttaaaagtatgtgattgtgaatcacacaaaagcattaagttacaaaatataattagagttctcaaagactttaaaaatcaaatgataatattttatcattaagtattaatagatattaaatattataaaatacatcttaaataccttaatagttgtaagtcctaaaaccatagagcattctgaaagcagagagcatttgtttattttgcctatttcttcataaacccctttaaatatttacttattgctttgtttttggataaaactagtccttggtttaaggcttggctttgcagtctaacccactgtgtgacccgggaatgtttcttaaatccactaaaacttttttactttttctctgcaaaccaagaaacattaataatatttctcctacttcacttggagggaattgtgatggtcaaatagggacaatgtattggaaatttaaaaaagataatgtagacacaaatgtcatgtctacccttctttgttgcaaagatattttaatcgagaactcaatggatctaaaaatggagtctaaattactaaactgcaggggtctataggggccagcttactggagaaatgattggattaggattcgttcagcagtatctatgtgcacacaggaagatggagctatgtttgtcgaacttctaggacagtgagaatcccatttccaaagcctagagattcttattcaatgggacatatgccagggtcaataacatgtactttttgcaaacatctcaaataatttcaatatggttgagatttagaatgtactttgagaaacctgctgaagtgaaaagaatgaagagtaactagagatttagacaaaaaaatatgttctctatttaatttgctgggatagcacactatgttaaatatgatagtaccacataattgctctctttagacaaggattttgatcttggtattatgtatgtaattacaatttccagttattcagaataattgtaaattacaaatgtgtgtgtgtatgtgtgtgtgtgtatttctgttgcctcccaaaatctaaaaaggaatcttttagtaatacttcatgacttcccttactttactagtaatccgctatataatattttcatctggggaatttcttgaaatggttttcaatggtttcataaagtaaatttgtaagtggagagaatgacacatgaattcaaatttaccttaaatatttagtaatagaaaatattgctggttattggaaaaacagagaagaggcaactgtgacagaaaatgtacaagaaaatcttgcttgtattatatattttaaagacacaaaaatgtacaaaatatcagtgttttgggagactggaagtaacaacttggttacaaaatctctattaaggttggttgcagtggctcatgcctgtaatctgagcactttggttggctggggtgggtggatcacttgagcccgggagtttgagacgagcctggtcaacatggcgaaaccctgtctctattaaaattacaaacattagccaggcgtggttgtatgtgcttgtaatcccagctactctggaggctgaggcacaagaatcgcttgaaccagcgaggcagaggttgtagtgagcttagattgaaccattgcactccagcctgggcgacagagcgagacgcgagaccctgtccccaccaccaaaaaaagaagaaggagaagaagaagaagaaggcggagaaggagaaggagaaggagaagaagaagaaaaagaagaaaactctactaatgaaaataaaataaaattcagttattttatcttgattaaatgtgtgatgcgtggataacacagataaaataaataaaataaaataaaagagaaaatcattaaagaacaaaatcatccataggctcacaattggcacacagccactgtataaaatttaatatatttgaaatttatgtaaacttttcttgaaactgacaatttaaattgtttaattcaccctattatttctactattttgaaatatttaactgaaagtaacagtataaaattatttctctaatatgaatacatgtttatacacactacacacgccaatacgtggctatacataaatacacatttaataaatatataaagatgtggatacattaaatgtatactatatatacacaaaatattaataatcatagtcacacagttcaactaaattctcattttctgattattccgtatgttaattataactccttgtgataattatacattccttaagattaatactcccttactgacaaatagttggctttcacccaatactttgcactcttcactgggcctgaatttacctgaggcccatattctaactcttgcaaactgacttaaccatgaaacttcttttcacaagagtcgttgtttgccttgtatctcctatattgacttgaagttctgaattatattttacattaagcaaaatatactgctcttggaaaactaaatactgcatgttctgacttgtaagtgggagctaaacattgggtacacatggacataaaactggcaacagtagactgatgcctgctagaggagggaggaaagtagggggccagtgctgaaaaactaactgttgggtactatgctcattacctggttgatggggccattcataccccaaatctcagcatcacatcatacaatatacccaggtaacctgcatatgtccccctctgaacataaaataaaatataagttgaaattaaaaaaatatgcagttagatagaaataggttttagtattcattattaaagtagggaaaatatagttaacaataatttattgtatatttcaaaatggctggaagaattgtaatgttttcaacacaaagaaaagataaatatttgagataatggatatcctgattagcataatctaatcaccatacattctatacatgcgtcaaaatatcacatgtaccccccaaaatatgtacaactattatatataatataaatataaacaaaataaaaaaaacaaaaaatggcttctggtagtattcttcctttgactcatcagttcatgcaatcacttgtttatccatccaacaatcaacctagctattaattatattttcattcattcatctagtgatttaataatcattataaatgaaacacatgaatcattatttctctggaatgcttaacacctattagaaatatcaaggatcagtaataatgtatggctttgattttaaccttcaggaaaatattttggaacaaaatgctaagagtttttttctcatggaaaactgtgtaacatgtcttgtatctacattattttatcaaaatccttgtcgataagtttttgtgtggaagctgaaggacgttagaaaggattttatctttgagaacctggaagttttcctaagaaagggaagggatttcacattcagacagtattaagtttgagaccttacaattaaatccagaaatgttgggagtcctgcattcatttcttacgggtagcatatgtagtttcttcattttgagtggttgtactgatttaattttcacaaataaaaaagtaatatataataatatccaatgtgacctggcagatgaaagctcctactgtttttattattgttttttccttattacttattattattactttttctacctccactcaaataagtaagagcttagatactttttgtttctgacatggtacatattaattctttggctcaattttggccccaataactggatttggattataaagtgtagtacttttttaccgactataattaaaaaatccaaactatcttatgaaatctaaacttgcagtgtctctgttaccatctttatagcctatatgaacatatcctctaagggcctctttatgaataaaaattgtttaagtgggaatcattatttctttggaatacttaacatctattagaaatgtcaagtatcagctgtgtgtggtggctcatgcctataatccgagcactttgggaagctgaggtgggcaaatcacttaaggccaagagtctgagacccgcctgggcagcatggtgaaaagctgtctctactacaaatacaaaaattagatgggcgtggtggcacatgcctgtagtcccacctacaccagaggctgaggtgagaggattgcttgagccaaggaggtggaggttgcagtgagccgagattgcaccactgcactccagtctgggtgacagagcgagaccatatctcaattaaaaaaaaaaaaaagaaagaaatatcaagcgtcaataataatgcatggctttcattttaaacttgaggaaaatgttttggaataaaatactatgaatgtttttctcatccaaaactacacaagatgttagtatctacagtagtttataaaaaaatcttcttgctcatcacacgtgtctcaaacattttgtgcagtgcccttactctggaattttgtccatcatatgtttttgtggttgttgccttaaatatcttgtcgtatctctgcacttccacatactacttttccttcaaggtccagatcattacctcccttagaaagctgtctatgttgctgtaagtaagtgggctttcagagaaggcagtttgatctaatttatagttattgttatttgtgtatgtgccttttgttccccctccagcttaatgccttcaagggcagataaaacatgttacacttttctgtaatactcgtaaacttgtagcatgcactgtatcactttataaatgaatggcaaatattcattggatgaataaataatcttcatggctacttttgcatgtaattgcagggtttttaatcacttacttataatagacaaaatactattcaggaaagaaaaatacatcagactgtcaagatatggggaaagtgtcacacagaatgcttgcagatattctgaggtggagatgtatcaggagtggtttctaaagaaaataaaatatcctacaagaacacagcagttggttgtctcctttaaagttaataacccaagcctaattctttgttaaaacttagagtagttttgtcttatattatctcaattcagtaatcaagaaaaggaggttgtttaattctctttgcaatctgtccatatcatgtgcaagtctattactgaatgtaagaaattaagttttttgctaatcatccagaaatctgtgattgactacttcaagacattaaccatgcccttcttttagagtctctgccataacatgtctgcctggaatatgcatcccttgctattgtcatagctaacttcattgttttcaagtctttgctgaaataagactaccctgatccccacaagtaccagatcctccttattctgatttatttgtttttattagcacttactcctttctagcataccatattatttagctatcatgttcaatgttcatgaactcttccccctgagtagaatgtcttatcccataaactgatatctccttaacatctaggaaagtgtctggagtagtaagccttcaataaatatttattgaatgagggaactgttgattgaataaatgaatgaagggagaataggtaatccaggaataaattattaacaatattatttggcttgaagaatattggctaatacctaatatcattggataattaaatggtagtataataacgtgcttagttttcttagacatcttcaaatatttgaactagaaagtccaccacaactcaatgtaatataattaccattcagttttcaaaaagtggagagtgaaggacagggaaaggaaatatgtttcctgcgacaccaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgagctaggatgtgtcttctttcctttaagccatttttttaagagtgtcatgtttaagtaaatttttaaatacgttaaactgcctggtttttttttttttttttttttttttttttaaggagaatatggaaggacatttgtgccaactacttaacctcagagttttccttgtagaggaaaatcttctctggtagtatgtaattccactttcacggtgtctatgtctatatcaagctaaaattgaaggcatatgttgcataactgcaagagatttgaatgtgttttagagttaggcacacatgaattttgtgctgtattgcatcggtatttattaattgtttgacttcagtgaagtgagatagtttctgtttatctttgtttgccatatgtatgttggacactaatatacaactgagcatctatcattattagcttcttttttctcttcccttcctttgcttttattttctatgttaaccagaaactgtactcattgttattcatgtgatgaaatgatttgtttaattgctttaatacattaggcaattaattctttttagtgttgagcaaattccaacaatttcctaagaagaaattataatgagggtttatgtgcaagaaatcaaaagctatggaatctttttattctcatatagctatgaaaaaaatcacctggataggcaacatttgaaattatgaaattctgaatagctttcatgcagttaattagaatcaaatatggatattagcatgagaaactacatggtggaactcattggtggcatttttatttgagggttttattttttgtagagaatcctgggagtgacatcaccatcagtcaaagattaataatttagttggaggaaaacttgaaaaaatgtataataaactagagtcaacctgcttataggaaaaacagaaatttgtggtgctgtgaatgcatgtctgtaatttcaatgtaagaaccacgtgagatggaaaattattataacacttcctaatttagtttcactgagtcaaccctgagatacaactttcccaatataagtttggtcactaaaacattagtcagaatgaaatgcaatgtttgttttaatttagtgattacaggagatatttaaacctaccccacatccaccatttcacattccacttcactctcccactgtcttaccctgtgcttctttacttgcagtggtcagaaacttactaccttgagagactgcgtagtttttctcttgagcaggtatgttagaaagcaactccttagagtgagccaaaatgtgccagtaccattatcctaagcaaatgaacacaggaacagaaagccaaataccacattttctcacttataagtggcaggtaaacattgattacacatggacataaagatggcagaagtagacactgacgactactagagctgggagggagacagggggacaaagggttgaaaaaccagctattgaatactatgctgactacctgggtgacaggatcatttataccccaaacctcagcatcacaaaatatacccaggtaacaagcctgcacatgtccctcttgaatctaaaataaaatttgaaattaaaaatatatatattttaaaaggtgccagtaaagtacaaagttcctttaaaaatagtttacatgtcactatttaagttttctggaatcatggctaaggagaaaggtgtgtttatggaattagacacagaggtatcaggatctcagaggaaggtgaaccagtaaagaggtaacttggaagttcagagcaaaataaaacggggacaaataaacaagggctaactctttcagcactgcagtttgcttggtgcttttatatataatttcattcaagcctttcagtcacccctgagataggtattatcttgactttaggataacaggtgctgttttgaatacatcagtgaacaatatgtggaatacaaccttgaacaaaaaaagactcaaaatttttctccagatggaatttaccttctattaatgttaactggggttttctaaactgtaatatttgcttaccagtcagataaaagtccaattttctactgctagaggaaatcctgggacagattctttctttctagaatcaaagcttctgaaaggctgtatataaatataggaagtattaagcctatctttcaaacccttgcaagattcatggtatagacagaggaagattcttaaatacagagttttaccactatggttcttatcattcatattggtcttgctcaaagctctggcggcctttttttccccctctaataaaagttcctgggttccaaactagaactattgaatcaaatgatgtcaaatgttctgatacccacaagaacctataaaaaaatctgtgtacgttttattgtagatattccaaatgaaatgaatttgctactctgccttacctcaatattgtaagcctgggcttgaagagccagtattcagtaagctcatttgttaccttcagagaagagtattagaaagacaataatgattttccttctgaacaacctataccctcctcaaacatcagttggagaaatattttagggcatatttgacctttggaagccattactctgtgatcattattggttgccaacaggcctgctgctgagagtagataaagtttccctgcattcacaaagaaggaggtcttgtttcattttcatattgaggatgaatgctcgggtcaagttgtcagaactaagtagagataggacaggattggtcattgggagaagaaaatagagaaaggaagtttacattcttataacctggtattgcatctctgtatgtattgtttgtaagcatgagagacaggaatttgggtggagaaacgacatttagaaggactaaccccttccaacatttccctttttttttctttacctagttttatttttattcgtaagtttcaataatatctcagacatcccccttatttctaagtatctatgaatataagtgaatgtgtgtttactctgtttatttgtttttctgtttggtatctgtagcgcctataagtgtagctggcactcagtaggtgtaaagtcagtatttgtttaatgaatggatgttggaaagttaccttggaaaatagaattatcatatgttaagtgtttatgagagaataatcatgccactttctccataggattgttaggaaaattaaaatcatggtgcctgaaaataagtgttcaataaacagcatgtaatcttaaaaagtgatgatgatgatgatgatgacattctcaaatggcagacatagattattaatggagtagggtagtggtttgcaagtaggatttcaatgttagtttggttgtactgactgagacttatataaagaatacacagagcttggacaccaaccatattaatctctctaacacctagaacagtgctgaggaagaagtcaaccaaagtggtttattctccactgactggttccaatgccttgatggaaaaaatctacatcaaactggttgatgttctaagaggcgtgtgacaatatatgaaaataaattattttttagccaaataactgtgttcaaagccctgccccggcgatgtcaaggagaccaccagaaacaactggattgtctgcaacagcagaaattcagaggttgacaattgaacttagcatttttagttacagtggatttcttcctgcatcttttttttttattttagtgtgccaacaatttttttttaattttaccattttttaattttagaaattaaaatatttctggtaacaaagaaaggttttcccatcctacattaattcagggtaaaaataaacctctagcaggtttttcttttttgacattatttggaattattttgttaataacattgaagactccaatattggtctatattttctcactttctcataatgttttggaataagcttgttgctttgtccctgtcagcatctctgttgctctatattgaaaatttgcatgatggatatactgggtccaagattagtttattaactttccattaacatgatgagtattttaaaagtgaacatgatgagtattttaaaagtgaatttttgaagctagcacatcattttagctatgccttttaaaaaggcttacaagcatcttgagcaggataatgtcattatacacaggccctctgcattacctctgcaagtacatcgaaaaccaacacccaaaaagaatgtttcctgttccttgcagatttgcatattttactcaatatatcttttacaatcttattacaagaatacataatattctatctctagttacctttctaacatgcatagatggacggatgattttatggatactaattcagttagaggaagtagtaatgtataaatgtaactgtgatctatgtttacattcgcatatatccaaggcatttaatgttaacatctgggagtaaatcaacaacatctagtttatttttatgtacttgacactgagatagtgggttgtactataatcatttcagccagttctgctaatcattcatcttgaattctgctaatcgttcatcttgaattatgtatttgtttatttaactcaatatggtgcatgcatcttggtccactgtcacaataaatgcagaatttactgtggcaaaagcatagactgaggaaaagcggtctcaagaaattggtctggctttgtagccagagcatcaactaaagatagcacaatcttaatcaccatccatgaactctgtctggcactgaccacagtgtcctttgaactcacggaggattagagtccttctagagtaaattttgtctgttgctaaacaagtgcagggtgatttgcagtttatttttcttgggggaaataatgaacatattacatcataatgtgtgtgtgtgtgtgtgtgtgtgtgtgtgtgtgtgtgttgggggggaatcaagtgttttctttacgtctatgatggtaacttacatcagacaaactctcccatggagaacaaccataaagttagggagaacaacatgatttaaaggcagccagcaactaaggaactcagataccagagagaaagaaaacaaattgaggtgactcctcaattcagcactgcgtattcctttcagagtttaactgattcaactcacagggcatagagaccacatggaaatcagtgacctggaatttttgatggacttatgggactctggagacaaaagttagatttcagggttaccgaggtatctagaaattgagaggccaaggtcacagagcaaagataattagagaagaatgggtgttttttcacccttgatgaattggccacatcttaacatgtgcaagaataagaggatttaaacgtttcaaagagctagtactaagaagctgaaaagctaaacaaatattttagcagtgtaaaagaaataatggaccctagaagtaacagaaactcagaaattaaattaatccccataattctgaaatccggtcttagtggtatcaaattgatctatctaaacatatcttcctgggagaagaaaaccaaatttgtctaaagggagataacaccttttatatgaaattttcaaaatccaattaaaaaattctgaaatgctgccaaagaggagtgggcctgcaacagtcagaaaaaagacaatagaaaaacatccaaatgatgcatatattcaaattttccaactaagaatatatatagttaacatgtccaagaaaatagataacaagtgagatggatactttgcccaaagacatggagcctataaaaataatcaaagaaaaggtctgaagctgaaaaatccggtgtgttaaagtaacaatataatcaactgaaacagaagatttgcaaaccagatttagaatagaaaaaaaaaaaaagaaagaaaagagacaaaaagaaacaggaagaatcacagaaagaaaacaatagtaaaaatacaaatatgagcataagatgtagattatatgtaaagcgaaagtatattatatttgaaactgacactccagagaggaggaaggccagagaagatgcaatatttgaagaaataatggtcacaaattttcaaatctgatagaagacatcaagatatagattcaagtggatcagtaaactcttaaacagggtaaatacaaataaaagcataccaggacacatcatagtaacattgctaaaaataaagacaatgagaatttaaaattaacccaaaaaattaaggtctcaaaagcagacagcttatttgataatataaattatggaaggcagagacaaagaatgtcattttaaaggacagaaggaaaataattgccaagccaaaatattatatcaagagaaaagagccttcaaattaagttgttttctttcagaaaaaaaaaaacttgataaaatgcattagcagcagtttttcactgaaaacatttttagaaatatatttttctaaaaaaaaaaaatgaaaaccagcctaaatggcaatatgataatatagaaaagaaagaagataaacaaaaatattaatatgtggaaaaatacaaaataatatatactacttaatataattagaatgtgttacatgtataaagttgaggtagaattaaaatacataacaaaaatgatggaaatgggaagggtgtaatataaattatcataaacaatgcattgcaaatattctttcattatagatataatgtttgatacattatttaagatatactttaatgaatcaaggatatgtatatgaattatatatttagtgttgtcactaaaataatattaaagactatataagtaatataataatggggaaatggaataattaaaactaattagttaaaaaacatagaaaaggggaaaactaagaaataactgattttaaaaaacatttaaaaagtacaaaaagaaatccaaacccatatagttacatactttaatattagataaacattttcagattagatttaaaaaggaagcaagacacagatcatgtctcttatcacagataaagctgtaatataaggataaatagagactgagatgattgaaacaagatctgactacaaattgaaactgaaggaaagttgttcaggtgtaaactaaggagaaagaaatgtttccccaaatatggagaaaaatgttataatgataaataactaaattcagcaagatgtaaaaatcctaaattcatatataccttataatgtatttgccaagtatataaagtaaaactttggcagaatctaagtgagcaacagataaaccaacaattagaacaagtagaccgaaaaaccgaagatagagaacatttgaatatcgtgattaataagcttatttcattgaaaggtataaaatactgcacgaaagagttacagaaaaatcattcttgtcaaacaaacttgaaatattgaccccaaatggccaaaaactgtgtcataaaacaactctcaacacatgcagtatataccttactgagcagtagcattaagttataaaaatgagtaacaacaacaaaaacttaaattattcttaagtattgaaaattaaaccacacacttctaaataacccatgaaaaacagaggaaaaaacccatgaaaaacaaagaaattaacacatttaaaaaatgaatgatagcaaaacaatgacatggcaaatcatgtggaatagagttaacagagtgcctacagggaaattgaccttaagtgtctacattagaaaagaagaagtgctgaaaatcaattatctaagcatccacttcaaaggggctgaaaatgagaagaaaattaaaattaaaaagtagcagaaaggtgaaaataagtataggatagaaaataatgaaattgagaataaatgtatgatagtgaaattcaacaaaactaacggctgttcaaaaaatgaataaaattgataaaaccttgcaagggaaaataagaaggcaagtcatcaatatcagaaatgaagaaggaagcattgctacaacttctatagagattcaaaaagataatggaaggatatgagggcgatcaggctgtgacgcctgtcaccccactgattgccagggttgatttggctgatctggctggctaagcgggtgtccccttcctccctcaccactccacgggcatccctcccgaagctgcacgcctcgtggaagaaaatgaccatccccgaggaggaccggtctttggtcaaggatataggagtagctgtgctcccgtgatagattcttcagacacggtctcaagcttcatttgtaggagaacgtagggtagtcgagcttccaagacctcagacacatccaaatgaggtgtgacgtgtggcagtctgcttttaaaaaggaaaaaaagaaaaaagataaaggaaatatttattccaattttaaaagttattggcaaaaatataaatacatttagcataaacacagcatgaactgaacatatttatgtcaaaaacttttaaaatgtattgtgatagaggcgagtttaaaaacgcaggctttgcaaaatggcataaataagaaaaaatagaaaaatatgtctattacttctctattgaataattgaatacataattaccaactctgacacataagttctcatgctcaaatgaactcaccgatataaatttcaacagagaaaagtaaaagagggagcatttcccacttaatgtcccaaagtcagtgtaatcttaatgctaaaacctgatgagaattttacaagataggagaattaacagcctgcttctgatatacaaatcttaggtaacatattagcaaaacaaactcactaatataccaaaacattacactcagggaatacaaggacagattataacatttaaaaatgtttttattcaaattaaaatattgagagaagatagagaaaaagatgatctatctttatagatgcagaaaaagttaagtatgcatttctttttcataataaaatttctttgcacactagaaatagaaggggacttaatttgataaaacatagctacaaagaaacatatagtaaatatcagatctagtggtgaaatgctgaaacctttctcacttagattccaaatgagatgaagttgtctaccattgctagttttattcaattatactgaaggttttagtcaatacaataaggttcgaggaagaaataaaagcataaatatcggaaagagagaaatatgattgtcattactcacaatcaacatgattgagtacaaaaatacaaaaataatctataaactattataaatagtaagtcaagtttgcatggttgtcagagttacaaaaattactgcattttgttttctaccaatactcagaaaattaaacaaaatactacctataatattgagcagacttcaattacatagcaaaacaatctgatgcaaggcctctaaacagaatactacaaaacattactgagaaaaattaaagatacaaatgaagatacagattaaacacacaaaagataaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgaagtaattaattttgtttgttttgctacttgttggtcaggccaccctaggtttcttggtttgtttttttgtttgtttgtttttcttttcttttcttttcttttctttttttttttgaggcagagtctcgctctgttgcccaggctagagtgtagtggcatgatttcgtttggactcagtagatattcaacaatacatacttcttcaacatattaggttggtgcaataataatttcagtttttccattgaaagtaatggcaaaagctgcaattccttttgcaccaacctaatgctatgttatatattacatatagattgatttcaacccatatataccctgaaatctcttccccatttgaaaaaaaaatcttcattttgatctgacaaacttcaaagagagagtgaggtataacagatcactcaatagatgctgggtagtttacaatattagctttcgtatctagtaaattgtgtgtgttgcttgtgtttgcatgggcatgtactggggtcactatgttgtaaagtagtattaaatgaatgtttaatctgaacattagatatgtcgacacattaattcctctgaaactgagtatccctaaggttctaaaatataagagattaaatagaaacacttagcaaagtaaactcaagaaattcacttccaataatctcgagtcaatcctatttgaaacaattagggggaaataccactaaggatttagtaattgacatataatgcaactcagttggcagagtagaattagagatttttgcaaagaagacttagtttactaaaagggacatgagaagcaataaactcactatccaattttatttctttacctgttgcaccatggaaaaaataagagatatgtaaacaggatagaaatatgtacttaagggtataaaaggaaggagtcaatattttagagttacaaattgaaccaaagtaatacataataggatgaagacacagatcaaaactaaaacaaaagaaacaaaagccatatatgtgcacacacacatacacacgcatcaaaagtgaaacaaaaaagatgacatttgtatgcacggtatagacaacagaggacaacaaatttgtaagcatacttaaataattaaaagtaggacgcattataaaacacaaattaagagaaaaatagaaaacataatagttccatgctcattcacactattgatttttataaactgtctctcatgttatctttatttggagtgtgattactaaaattttacatttatgaaatataaagaaaggatctaagattaaaaggctatgaaggataaagtcaggtctctctccagtagctctaaatcttttccccatcggattaaaattttacaaccgtaaatgtgcctaccctggttttcaagatgtcaattcttgtgaggaggagaaaggattctgagggttcattgtagatacgtaggaaaaggtggagtgaagaacttgccaagtggttatacagaactccactatttccaggttcactgaagacgaatgtaataaacaagagacctgcacattttctccccatttagagagcatttgaaaatggagtagcaagatagcatgctttttggcagtcagggaaaacacacaggggtcagtgagggcttgaatcaaagtcactgtttaagagtcactttctccagggagtttaaggcattttcaaaaatgtctaagtccacagctttctcagtgagagaaagaatttcttcccctctcttgagagagccacttcttggttaatagaaaggctataacttataagctttgttcattagacactaaagccccaatttgattaaagttctaatttaattataaactactctagatatgactgggatttcaaggagtgaaataaagtgactactctttatactctggcttgctggaaatttcacaatcttatcctcaaaaattattgaaattctggtggtcaactcctccttctgtgtacaacacaacgcagacattttttgataagtatttgatggtgtcaaaagtctgcatttgaaccacagcaagaatacagttgccataacagagaaaggggaatgcataaaaacaatactgtaaagataaaaactatcaaaaatatccccagaagcatggctaccctcttggtgtccgttggttaattacattctaacttgttcctcagctatctaataatctatggatttgataaatcatcactaatgatttagaaattaatatgccatttatgggcaaaatgtgtctcaaaaagtttcgtctttagtcattgagagcttaaccccactattgacattatttccaatatcttctttcaaattcccatcaattttattttaagcttactaagttgctgtatttccatgatatattcaattcacatcttcttatttttataaaattccactgctcctcttattacctattcaattataaattctcttattctgcattccccaattgactataatttagtgctcatagcttctacccttctacttgtagaaagctcaagaattatttattgtgccccactagtaaacctaaatttgtcaaatcatttttctctcttatagcttgaaaaggcaagtctgtttatttcaatcgatgcctgcaaaaacagcagctcatggaaaccagttaaaagcaaattcccaagtaacttagacttggcagtattccattacctttcattataaaagggcaaaattaatgggcaattcatgagggtatgtgacagagaggtgataggaagtcactactactcaaatggtagaagtcaagaacttgtttataccagatgctatttcagccttttcttctatcatatgtgaaaaccgcctgacttttgtgaccaattgatatgggcttttccttccagaccactttgtcacatctcttgtgtttagcaaattaatctttaatgaatgttaatcaagtttctaattataatatctttatatttagtgtttgtatatcagatgaaaggcaaacattttggggccagtcacaaaggacataaataatttccttagaagcttatctgattagttttattgctctataatatctttaaaatttgaactgctatcatttcattaatttagatacaagtgaatcttcagtatttaaatatgacacttatgttggaaattataagttgtaatttcagtcatgtctgttcatataatatcgataaagataagatattttggtggtgtttggggacatggaactataggttttatttgttttattgttttttctgtgttttagcagtttcaagaaatacccagtagatttctgaggcattcatatacctgggataaacattcatctacttagggctaaacaaaatgaaacataatttctctttcagtctgctttttgctaatttttaaaaaagaaatctgatccagaaatagttcaacggcttgccagtgatcacatgatatatatctggctcattgccatataaaacaatacttgtcctcacatggcccccaatttctctcctaatatcaccattggccttatctcaggatagtcccaccattagaactcctgattatttggtgatggcatggtctctgggcctttttacatgccatttactctatctgaaacaattgtccacctttctttctttccttccttcttccttccttccttccttccttccttccttccttccttccttccttccttcctttctttctttctttctttccttctttcttgtttttcatttgtttttgagatggagtcttgctctgtcatcaggctggagtgcagtggcatgatctcggctcactacaacctctacctcccgggttcaagctattctcttgcctcagcctccagaatagctgggactacaggtgcgtgccaacatgcccagctaatttttgtatttttagtagagacggggttttactatgttggccaggatggtctcgatctcttgacctagcgatctccccgccttggcctctcaaagtgctgggattacaggtgtgagccactgctcctggcctccacctttctatacctaaagtaaagtacttttcctaatttttaaaggcgaaagataattccctattttaaatcttcctgtgactgtagaaaagtgtttcttctttctgtattcttccacaatacagtgaaaatgagtaacttgtaggataaatgaatatatagataaaccactataatgtgatatttcttaaaatactatggattacttggttgtaggagattcatcttaactggacatatatatatataactatgtattgaataactgaatagaagaataataaggtaatgaatgaatgacaaaaggcatttatcgaaattctcaggagagagttatggggtacttaaccttcttgagctgatatttatgatattttgaagaatgaattcaaataattatgcacaaccacattaatgtcgcatatctctgttttctaggacaaaagggtatttgtgatagtattattttagttagtcatgaatgtcctagcttttgggaagagataatttagtggactgaatagtggccttcaaaaaagatatgtccagttcgaaaccccagaaacctgccaagatcacatttggaaaacggtctatgtagatgtaattaagtaaggatcttgggatgggattattctagatcacctaggtaggccttaaatccaatgacaagtgtccttattagaaatagaagagaagatacaagaagaagacgagaaagccatgtgaagatggaggcagaaactggatttatgtcatcacaaaccacgaaatattggagatactagaagctgaaatggacaaagaaagatacttcactggaggcttctcagggcatgtggcaccactgagaccttgattttggacttctgacttccaagtgtgagagtgtaaaggaatacatttctatgtctttaaggcatgaagcttgtggtaatttgtcatggcagccctaggaaactagtataaacaagtttacgaaaaagaaaagaaaaagtcataatttttttgaaatatgtttttaacttaattgaagagacaagaaaatctcacatttactggatagatagaatatttactacacagcttaataactctaaacaactcttgtgaagttaaaaaaaatgagagacagagagagagagagaaggaaggaaggcagatgataattgctgctgattctaacaaaagccttctggaaaaggtggggcttgtaagggactttgaaagaaggatggtctaagaaaactggaaggacttgcctctcacaaagtaggcacaggcatggccagtatggacagaagtgccacgaaaatacaaactctggaaaatggccctagaaagggagtaggaggtgaacataaaaggcaaaagcagatctatcactggagctagagacccatgctcattgtagcatccttgcaaatactgaaggaaatcattttccccccagcaaggttgataagtcaacgtcaacaaggtcccaatatgttctctaaatggaatgcttcctagttcacctacctcaactccaactgcgaatgttcaaagtccatcctctttaaaccctccaacctagttaagctctctctgtgatgtgctgcactaaaactgtctgcttttcttcatatctctcagtctagtgtataattcaacactgtttgattattctctgctactgtactataagttctgagagaacagagtctttatctctgtttgctttttcttatattgaaggcacatagaagagtacttatacatcactacacatattcaataatcaaaatgagggcagagagtagataaagctatcaagaaaatgaatgaattaataaaaataatatattatttaagattatgggttagattacattaattagtttgaatgttttgaggtattcattgatcatttactggatcactgtggtcgtagataactatggaggagatatagagggctcaagaatcaacgagttacaatttaaaccacataattttgaaaagaatgttttagggcagtacaaactcaaaagttgttttatgataaattttatactggacaaaaaaattaacagctggagaaatttatctgaaagtgacaggaagggtgggaagggcactggcaaaagcaagaccaaggaacatattaataggctgtaataatatatcaaggaacgattttatgattatatgactttagatatatgaatgtgatatgttttctctattctgtcagtgtctttttactttatttgatagtttcctttaaaacacaaatatttttaattttgatgaagcacaatatatttttttattttcttattattttattttagtgtcaaatctcaaataacatgtaagatgtcaaatcctacagcataaagatttttttttgcaaaaagtcactgtttacttcctgtttatcaaatcagttatattccttacagaaaatttggagactagggaaatgtatttgtatacaaacatacacccaaaagtatgtaattatttgtaacaaatatttgtaagtttttagtggttcttccagggcttagcatatacattttacttggcagaataagcttcagatgtatatcatcttaattcaagtgagatataaaaatgctactcctatatagttctattgccttcccctcctattttgtgatatcactgatgtacatcttatacatatacattataaaccctaaaattgtattgctataattattactttatataatattgtgtttttaaaagaatcttagaggagtgaaagtatatattcatagcttttgttatagtaatctttttattcatcatttctgttcttttcatttgttcctgtcgatttgaattacaacctaaattcattttcttagcccagtacactttcatacccactcacctcctttttgctatgattggcaaacatattacattttgatatgttacaagctcagcaatactattatatacgataatataaatagatacatagagttttatgcaattatggttaaaataagaaacgaggagtaatgtggatttatacagtcttttataagggcataattacctttaccgttttcctttctctttatttttttcgtttggattagaattattgtctaggatcctttgttttcaacggaagaatttatcatttattgtgagtgtagcagggattctactaggaacaaattttctaagattttgcttatctggtgatgactctattttaccttcatttatgaaagatacttgtgatggatataggattcctggctgacagttatgtttcattgaacactttgaataagttatcctactgttttctcacttcctttatttcagatgagaagttagctgctatttttattggggttccctggtgattagtttttgtttgtttgtttgttcacctcccgctggtctcaaaatgttcttgtttttggcttttagcattttagatatgatatgtctgtgagtctctttgtgtttatcctacttagagtttgttggggaagttttaggatatacaggctagtgtttctcaataaatttgggaagtttacaggaattatttgttcatttttttctccattctctgtctccttttcttctctcattactattatgcatatatgacacttaatggtgtcccatatttcactgaggctctgctcatttttctttatttttttttaactgctgttctttgattctctactgatcttcactttcagtaattctttcttctgccaatttaaatctacttttgagtctctctagtgaatttaaaattttggttatggtaatttcctactgcacaatttccatttgcttcctttttaataatttctgtctttttattgatattctctacttgatgttatgttgttatggcatcttcatttacatatttaattatgcctttttaaatatatgttaatggctactttgaactctgttaaatctgacatatggtcactctcacatatgatttcttttgcctgatttttctctgacctatgtttgtttattgtttgcttattttcatgtcatgtaactttttttggaaactagatattttcaataatacaatgcagcaattctagttaccaatcctcctctggagtttggaattattactcacttgtttgtgacttgctgaattgttttagtaaaaccttttttccccattggtgtaaaatctgtgatcttacttctccagaggtacagtgttggatatttacataaacacctggaaatacagtggttttggcagggctctctttgattgtctctgtccctgaccacatccagctattaaggttgtttaattgccagccaactgctcaactgtattcaaaagcgtcctaggtcataatttgttccacggtatgatctgttcaaatttgggctctgttaaagaaatgattccctagataaatgtttgagatttgttatttttcctagaaggctcatttcagctgactctatctgcattctctctggcaactagcctctctctccagtgaatctaccagatctaccaacactctctcatttgtctttcatagcaacctttagtgttttgagtttacacttaggcttgaaggtcacattcctttgtatatgaaggaactttctgcttcaaggcctgcttttctctttcactctcaagcaaaatctttgagccatggctttgaaactcctttctttaggagtgaagtgctttgtggagagaaggaggcagtgacctcaatctttttgtctcacctgctgtatcccttaggactttttccatagactaattatttttaaaaaaactttcaccagtttttctggagactgggtttgtagagttcctcaggctatcatgtaatgagtcttaaaaagcaacaaggaaaacaaacaaacaaaattgaacggtgtgttaagatggctttctgaaagagatgtgacttatgctaaattttgagggataactagagaaattctaaccacctggaaatagcttttcagtgcagagtaaacagtttaggttttattttgcttaacttttctaaagaaatagataaaatattaagaggaaacatctagaaatatctacaactaaataagaacaaattaatttagtacacttgcgtaattgttaaataaatgtaaaaaatagttgaatttgtgtaccatgatattctttacagctataaaaagtgggttccaaatttagttcctagtttctcaccgaactataaactaacaaaccacaaactaaagaagaaaataataattatttacaaagagttctttgaccattatactaaaacattagtcgcttgcagaggtgccgggacacaagaaagatgataattgaaaaaacattatatatcattcatgattttccaacagtgttaagtaatagctccctaatcccacattgttcctaaaaagatattagttggtattttgcactgggccccagggatagataaataacactttgtcccatatatgacatatgagaaaacctactttaatgttgaaaattgcctccaataagaagctgatggagtttgttcattctttatgcctgagttttgccacctgttggtcatctaggttgaagagataattgcaatttattgcaaccatgaggccaaattaaaaagaaaagagaaaaataagaatggactttgacaattttttaaccaaaagagtgggaagaaaatgtgtatatgcatgtttgcctgcagtgtgtagatatgagtgtgtgtgtgtgtgtgcatgcacacgtgcatgtaatattaaagataaggaaaacaaagaataatatcatacatagttgacttggcctaatcaaccattgtcagtgtatctgaatctgtaaaattagcaattttttcacttcagaaggagcaaaataatgtttaaggaatatggtagctttttcttatactttcagttttctaagactgtgcccctattattcactgtctaatctgtacatgcagtttattaagcctgtgctaatcactatttattaattgaatatttagcgagattaaagtaaaaatatctagtagaagtttctttaattatttacacacacaggaattggtctaggatgtcgaatgaaaagaatgagtgttacagagttaaaaggaataaccggcaattcttggaattaaaacagagaattacaaaaagaagttaatcaattaacgggactccagttgggtgaaataggaccataagcaaaattctggaagttaaactgcacagtttcatagggagagttgcagattacgagtgcaattctgaaactcttcatgatggtacaaccccttagacattcggtatttgatatttgggccaaaacttcaaatatttatcaaatttcaggtaagtatttgtaacaaatttataaacattcttgaggagatagtagtaattagtaaccttcatacacacatacacacacacagaggcacaaatacacatgtatatgtatttttttggacttcatcagtattatactatgaaaatggcttatgtctggaagagcaaaatcacattttgaagttgatgcttaacttagtaatcttggtacaattatataatattttaagtgtcaggtttacatcttacatatggggatcccattagctacttcatagattttttgtgcagattgaatgaaatatgattacgtgaaatattttgcatcatgaatagtaaacattcaatatacctgatgctgttcatgtggaaaattgcaaaaggcaaaggctataatacctttgaatgtgtgtccaatactgtataagacacttttaatttttctcacatgacatttataacaattctataacaaaagtgttaaatttctgagtttcagtttttttaggaaaaaaattgagtttaaattaattgctcagagtcacacaagtagtagaaggaaaagctgggtctccaaaggtgcatgtttagcacaaaatgctatgctcctttttactttccaagaactgctatttagctaatggtcaggctggaaaacggaagtaaatatttaaaaatataaccacaccttactcaaattataaacttcctagagttttgttgaatagataaaggataaaatatgagtgccttgtgttagagtcataagttaaatgtctatttagattcttccttctatcaaaactaggaaagagcatgtttcctccctgaatgaagaataaacaagttcattagatatatatttaaaaagggtatatgaggtgagacatttcaggccatcaccttgatttttgggaagtgaagtcaagttccattaatccctcaggatagtattcagccacttgtagttaaccaaattagaatattggagagtagtcatggcactcaactaaattcaaatcttgtagcagagccagcagggcaaaccaactgtaaatctgtagcataaatatagctatttggtgtatactttaggagtacttttatctttaaccaaaaaaaaaaaatgagtattttagagctccaaatgtaatcaattgtcaaaaagaggagtttgatatatcaaatgaaaatctgtttgttcatattcaaagccaaacattttttcccctcttggcttgcttataaatattcagtgccacagaaatgcaaataaataattggctatctccaatgcattctgtataatttataacagatcaaaagattattacatggtacagtcaaagtcaaactatattccatttattgcaagtgaaaaccataacatgtcccaagtcaggaatgtattaatggactagatctccttctgtgtgtatgtgtgcatacataacttaaaaaaataaggattcagggattgaggattatgtattgagttctctgctattggaattgacctggaaagattagaagattattattcgtttgcattgataaaagtcctcatgaaaatgacaatattaaaatcacttgggatcatcttattcaaaaatattccagggtcaattttaatgaaaaatgtgattcataaaatatatgatatttcatctttaatcttacctcttttatcattgttaaggaccacttctcaacaagtgatttagttctggccttttgctaggttttaagtgttcatctctattatacagccagtcaagcaagtaagagcttaaaatgggttgtgttctactcaagaaaaaaagagatacatttttgttgtatacaacatttttcttttaaagaattgatcccttatctataaaataaagcttgctttatcaaagaaacctcttttaatttattcagaaatggtctttatcaagctaaactcagcaaatggtgtttgaaataacaatttatgcttttttttaaagcagtcaagcacttgctatttttcttatttggtcagactctataatcaccatgttgaaaacatcctaattaagggaagttggaaacagacacacatgctttcaagagaaagttgagttgcacgttaaaatgaaataccctcaatgctgatgttattttttccttcccatagggaaccacagtcagatatcacgagtacctgttgctattaaagtgctggatgtcaatgacaacgcccctgaattcgcatccgaatatgaggcatttttatgtgaaaatggaaaacccggccaagtaaatatctccatgttgttaatgctgaatatgtttgtatacaactgtctcatatttgactaacctgcattatattgtgcatttgcatcatttatgatctgcaaagtctcaggcaagaaacacatccaaatgggaacagagagggaattttttttctccatcagatgttatttctcttcctacttatgaccaaattggctcctaaagtggaacaacctgctgtgccacaaacccagagccaaatcactgtcttaaaatatcttgggatatggatgatagcaggagatgtcttagagtgacgggggctgaatttttactttcaaatgacaagaagcaaggtaaaacctcgtggagaggagacatttgtttcacagcaaacatatgaataccaaataatagtgaaacccaagaaggccagtggtttatagaaagttgtaggaagtgaatattgaaatctgtaaatatgtaaatatatttagataaacataagatgaacaacacgttttacatgtgtgtattagtagaacattttttgtgcctcatattgcatagatgggtcaatgaaaacagaaaaaaaagaaacataaagaaagtgagagagagggagaaggaaagggagagggagagggaatgggaatgggagtgggaggaagggagggagggagagagaaaaagagggaggaagaaagggaggaaaatagttaaacaagcaagatgaacagaaacaaatatctgctatactctgaatgtcaaaatggaaatagcctgtgtaaagttctgcaaaaccataaatgtaatagatttattttaacaaggtaccaaagtactgtatgtttaagaaatttatcatttttcaacttcctaatttatttctggatggtgacattttaatttaaataaacagcagctgacagtatgacactggagttgttaatccaactattcttgtgcctcatgtgggtgttaggaattaaacttactatttgctaagcagcttacctgacaagagtcagattttttccccctaaagaaaggactggcactgtagctgtatgctttattataaatgatcaatttgttaccctcctataaaacagtgggcatttctccgtagactactctcatgtatctggagaattagcattgtttccatctaccagaataagacacaccacaccacacacacacacacgcacacacacacacacgttaaagctaaaattctaataataaaactgattaacttttaaacatctagccatgttctcatcaaagcattcagctttagtagagatataggtttatttttataatattctaacattagcttaaatgtttcctaattttatcatgtggaattaccccctatcaatcacacgttttgagcatcttcatttgtgatcctttgagaagggagtgtgtatatgtttatatatacacatatcaatacatatcatttacctaaattggtagattgagttgtcagagagagtttgatcaaaatatggcaggttgtttcaaagatatggttgttgtgtggaccagatcattgctgagataatgtagccaaatcacagactggtaagctagactttttcaatcacatagagtctgtaaaatacttcagaatttaaataaaactccattgctcatgcaaaactcatcagataagttcaaggagtcaatgacattgatatttcaaaaactcaacattggcttcacttgcgttattgacaagcatgtttcttggatctctgggaatttgtaggtttgccctgtggattttgactgttttcaaagttctaatgatttctcagtcgttcttcttaacttcagaaaaaaaaatgcattgttttctcatctttcctatgcaaaaccaaaataaaaaattgattctttgttttatgatttttgcaaatcacaatgaatgactctttctctgaagaaatggttatgttgtgtgtatgtgtgctacaccattttatcctctaatgatctgtttagacatatcttattagagttcattagttacatgaaaggatcatatctttgatgacttaacaacatttttggacatatggctgactgatgtacatgctgttgttgaaacaactttcttgaactctttgaatcctttatgttagtcagaattcaggttttattccttacatcacttctaggtcacttttaatgctcaatgatctaatttttatatttaacatttaccaaaatttggatttgttattcacacaagtgtttacttatagaagttcaacaaagatatactttcaatcgtctactcataataccacacaaatgactgactcactatggaactagaatattccttagcagatgatcacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctcttctttcatctcatctttctgcctctgaccaacattgtagaaatataaagtttgtttattatgggggtatcaaagttcaaataaaaaggtagtcacttatacttctggatgatatgtatctagccaatgcttgacacataatatatattcacaaaatcttagaatcatggctctaaataatttcattcagcaatgacagatacttcaaaaagtaatttcctagatattatcatggaaacacttgttccactcacaaacacacagtatgcatgctaacctcttcagatgaaaaattcctcatttatttattggacaatatttattacccatctacaagatgctaattgttgtaatacaatctgaagaaacaatgtgaaagggtcaaaaattattttttcttatgaatttagtgaagaagagattttatgagaagaatagaatgaataaaataatttaaaattttgaaaactggtttgaaataaatattcaagcaactagacagaggaacaaagaacaaagaaaactcagggatctactttatatagtattgtcaaataaatttttgattttaaatgagtgttgtttatggtgaaactggaaaaaatgagaaagagctgggcatgaaggcagtcttctagccaacagaataggcatgtgcaaatatcctgaatggacaatgacctcagtttgttagaagaatggaagatacctgtgactagcatgtaataagcaaaaatgagattgaacataaagagttttatgcttgaataaaatacacacatgcacacacatgattaagcaggaagcacatttaggaagctgtaactgcaaaagataatggtagccaggtctaaggtggtggctatggagatggaagtaattgagaaatctgattgcttacataagtgaaaaatgtacacacacatctaacgttcctgctctaggagcttggtattagcaaccacatgttatagatataaaagctgagaccgaaaaagactatgagtcttacttaagatttaccatgaaaagtggcaaaaatgaattttaaagtctgctcttaaaagtgctaaagtccctgaaatttctaggatgtcgcaatgctctccaaggaagcagaactttgaaatcctatgtctgtgtgacacatctcttataaaataatcatgagaatatgagtctgatcaagagtgaacattttttttcaaaagaaaacaatacattcctgtgaccaatgacattcttactcaaaagcatttcatgaaaccttaaatgaaaagaaataaagcttaataagagaagtaaaggtaattatccctagataaacactagcaatgaatgggtttgatactttattttttttgtctagtttctgtgagtctttttctaataactgtgaaacaataaaatgaagttatggcactttataacactcatgaaataataaatataagagatttaattttagctttcctgccagcaggcatctttcataatatatctgcatacacaagagggagacaggattgattttaaaacagatgaaattgatagcctccacaaaatgcataaaatactactttcactttattttgggtggagtaaggagatggtaaattaatggaatgcataaaacaacatttgaagaaaccacatgtagcaaaacacatttcaagagagtcattaacaaaagtatgacttttggagcacaagtttgacagaaaagcaaagcaaagtgaatatatatatattggagggtttggagcttgaacaatctaaatgtgagatcagatctttcctatttactagttttgtgatgctgagccataatctctgttagtttaaaccctaaaatcttcagaataactagatagatatagatatatagatatacaaatacatactaaataaatacttgcaattttcagtggtatttatttgaaccagtcttgtggtctacaaagcaaaaaatactttatttctattatatttgttgggttttattgttatggttatatgtttatgaggtggcttaaagcaacacactatacatgattcctaaatgggtcaatataatagacaaatctattgctctaatattggaataactattcctgtgataatttacaagtactttatttgtcaagggtgaaagaaagatccatacttcactcttccccatgggaatctgtgggttaaatttttttaaaaaaaattagctggaatcatcatatagaaacacattctacctaaacctttcgaagttttacttgcagttctgtatgtattgactgggaatcttgcatggttacaaatttcacgttttattctggcccctaatttaattgagattgattatctacagagaaaatggtgtaaaagattgtttaaagtcttgggctattacggactgatatatttttattgtattttcaacctacagaatactggataagaatttaggatgggagccaggtaggaaacctgaatacgcttgtttccatttgttcataaaagccatgatgatgagcaggttttttaaagaaagtcaaattgactgtaggtagtaagagattttaagcctaggctttgtgtttgtgatgtaaattggatacaatctggtactggaggatctgagataatactgggaagacagagaagctaatggtaacatggctgtaaccattaagctatgtagatacacaccttcacacagaggctgagaaagtcttccaatcttttaaagactcaaatggagttttagaggatagcattattcaaagtgagtttttcatagaaacttgtgcggtagcatgccaatatatgatgtggtttggtgtgtgtgtgtgtgtgtgtgtgtgtgtgttacctaataagattgggagacattaaattagacaaaattaaacatgatcttctgtttgttttgttttactacaagtttctcttgcatttagaaatacatatgaatccccaaggaaattatatggtatctcgagtttgccaaggatagttgactataaaatctttcaaatttccttcagagaaaattataaaatttgtgggagatgggacccagttggaaaaatcttgccctgggaggataaacaatggaacatattttcaatataggaattactgtttataatcttaaggaggtatcaggagatattcccacaaagcaatagagtcatggtaaagaagagataagattgaaaagggtgttgattcttctaagctatgtggaaaactgtgaattttatcctactaatgaaaatgaactatagatttttaaatcagggtaagagatggagtggtttttatttaatattgataatttcagtagtatacaaagtacacatcagatatacagagtccaccaaaagaatgcaagaggcagaagaaactggaaaatccaaactttgtatagacgcattcttctggaatcctagcgttgtattggtttacttcaatttagtttcaagaaaggtaaagtgaatgaaaaacccaacgctgaaaaaaatgttggaagttctacaatgcatttatgaaggcagagtcccaaattctacccagaggactgaagacttcatttagtgtgtcaataagattagaacctcatctacttcctcctgctgtatttcctgtatgtcagaactgcaagctacatgctctgaatagccacctaataaactttaaggcaaggatgtttcaggccaaaaaaaaaaaaaatggtgagctcattaaacatgttgaatgggtatggaataaaaatcttggtagcaactggaatgccatgcaaattatcaaaaatatccagacaatatattttgattagatatgaactgtgaatatgtttgtactacattttacagttttgaaataattgggttattgtgtagattttgataaaatttcttatttacctatattcccccctttcaattaatcataattgttataacttgatttgtcttgtatgcctatctatttttaagcacccttctttaaggcttttaatgtattttgttttgttttattcagttatggacatcattgataatttgataaaagctacgacctttcccctcataaatgcgcatatgtaaataatttcatactatttcattttcaaggtgaggaatgacagccatataaagctcattcatggatcattcctttctttcccaagttgaaaactactccaagagatagatgttaatatttcaggaaagttaatatgatcatcagaaataaagtggagataataatagaattaatagaaagccaaacattatgctgttccttcttcatcgaccgtaacttcccttcctttccttcaccccctttctatcaccttacaattcatatcattatagaaggatttagagaaaagagaaactaagttttacctgagaaagtgacagtgtggttcaattgaagataccatgctgttcattattgctggatcttcctagagatagacatatattctagaagccttggaaaatattccaaaagttacaacagaatagggttttctcaccttgtccatacatagaaagaactatttcttttaaatgttcacttggtgtgcattttactggttagaatcaatcaagaaccttcagactgctaaagcaaagcaagcaaggatggatgggtcatgcttacacactccaaaatattgaaggtctaagccccaatttaacagaaatacatatatagaaattataaatatctacaaggttttgaggacgcctggcatattgagggcaatgggtgcagagaacttgtaactaggcttatctgggatcagacattttatacacactcacacatacgtatacacccacatgtacatacacacatgtatgtgtgtatatatacatatgtaatatatacttcatataatttgaatgtatataatacattagatatatcacagtgctgataagtttcttaatatttacctctcaaggtattgtgaggataaatgatgatgcaaaaatgtacctgccatcgcttatttattattcatccattacttcatttagccaatagttattaaatagttgccatgtgccacatgttattctaatagtagtgaggggggatatctcatatatccccctgacacataaggtcatattgataaataatatctacaggaactcacggaagaggttctaatagatcctgtgatacagctatgcttgttaacagatcagatcatcaaaaatgtatttctttgctgactgcttgacctttcaaaagttaataatggcagtgatattctgctactataatatatttttgagttaatgtaaaatagtccaaaataaagtttaatatactctgttaaaacaatctaatttagatttagaatttttgataaacaatgaaagatttttaagggtcagaattatactgtagcacacaattgttttctagtttcatgtcttagaacgtttatttaatttcaaatctgtagtctcaagaaatagaacagagtctgctcctctgaaaatccaagcatggttctggacttcttttccttatcccaacatcccagatatgctttgttttctctaataaagacatatattttgctttcagctttccttaaaattgaaaatatttcaacaataaattatgaaacattagatttttcagttgcatactaactttattagcagaagggaaaatatttaagcttaactttagatgcatatttctcagaatttatgactgctccagaaatttttatattattgccatgaaatgaaattacttgaaaaaaccagctgaggtcatcgtagctcacagtggaccctacgtggtctccagttgccctctactcggtatgtcaatacaacctgcctctgtgaaggtacatttctttgaacaaatctgttctttttcttttactgtttaaagctaagtgcattcaaaagttatttcatcaatgaaaactttagcctcattagtatggatatcttaatgcattttaatggtatgaagtccttcaagtgacctacttggcatctacttttagataaaatgccaaagcaggggatatctgttttgaagtgtcaaatgtggtttaaccaaaaatcttaatcataaccagtttatgggatatttggaagaaaatgtaataattcaccagttcagccaccttctccccagcatataatgcactgagcttgacatgagcttgacaatataaagcctcttaatgaattatgaggagagaactatgaatatgaatcttttccattggctcaaaacagtggttctcatacttgtgtgtacaccagaattacccagaaggctgtttgaaatacagattgctgagttataatctgagactttttagtcagtagttccagtggctcaataaattgcttatctaatgagttcctggctaaaataaatggtggaaaaatgtattaaattttggtgtgatgtttagaccagacttctgagatgtgatgtggcaggtagttatgcttctttgctacaggtaagctatatcattgtatcttttgttttggtcatggtggcttagctaatcaaatgactctcctgtagatgcaacagcaggtatgagccattttcacgcagattacttgaaaatagtatgaatggtattaattatgggagctttatccactaagtgtactgtaggaaagcatttaattatgactgatctctacttgagaaaaccaagacatcttctcttcatttgcccttattctccatatgcactcacacacttcaggaattacatcttcaatggttgcacctggggctagaagtcctatagagagaagtctgggtaaatggagaaggagctgctacatttgctcacaagcaatgtttttccctgtcttctttataattgcctgaaagaaagctcttgtcaaagatagtcattcccttgactttttaacatgaaaatccagcacagctgttctgaggtgaagtggtcaactcatacttttctgttaaatatttttacttgcaggctgtccaaaggagttatccatgtttcaaatctagaccccttgtactttaactcatgttgatttttatgaaacaagtaccctagggcctctctctacacttaaatgtcaaggcaaatatgctatgtgtttaggtacagtaaatataattgcattctcctttagtctgatcatgttgggtcattgagtaacagagttgttacatttataaaagatttatcaaaatgccaggtcatcaataaatagcaatggccctaataaatatgataataataatgatatgatgactaaaattttattgaacattgactagaaaccagaaactgtcaaaagatttatatgaatttaaatccataatcaaaacacacctatgagaaaagatggtttttgcatttgtatttctggcatacaagaaattgaagtttcagagacttaagtaactccttcaatgtcacacaatgagccacaaacagagctgtgacttttatcttatctgggaagcttaactccagagtcctttctcttgatgactatctcactgtcttaaccatgagttatactttaaattattttatgttattttgtcactcaagctaagaataattataattatttataagacattataactagacaaaaaggtccttaacaaaaatcaaacacttacaaagtaagattatgttccattttaaaaagggagacctagaaattaaaaaaaagtattttatttttgcctcaagtaaattgaatgaattgcctatcatataacatgtgcttgatacaatgcaaagccccatagctgctaaaagttctgaaattgtgcttcttacacttgagtggtaagttagaaagcaaagatgaccccttctcaaaaggaatttttttttctctttaataacatttcaaagttcaatgggacataattgttcacacagacacaatagcattgacatcattattatatcctcgaaatatcataaacctgagaacatttcactgttaactactttttatggtaaatctattatcactataggagtatacattcaaacttttcctacattagctcttgtcccgcttgtcacattgaactagcaatatcacagaatcataaatacaaattattaagataattatctgacatcccaagaaacaactttagcattaagttaatgcagctttacaaatgaaacaagcacatttaataagcaccgattccaagtacctctatctatccaaacatttctctgcaccgtggtaattctaatccctataatttattcatctcaggatacactccaaagcattgtttgcatgtgttacccactagctttaaaaaacagtattaattattgggagggaacagaagcaactcatcagagaggtttgttgcagtgatgtttgtgctgaggaacactatttggcaaacatttataacctgatgagtaaaagagttgtgaggattcaagatttaagccatttacctcaaagatcctcccaagaaccacactacaatcactgtaacaattccaaatctcattctagatgcccgtaaatactcaaattggaaagaaacctgtaattgcccagtggatatttcaaatacacttaactttgctatttcaagccacagacaccaaatggacacaaaggtaatgctcttaattttcatcaacttatcaaagctgaggttttaaagtaatggatttttctccttattcttggcacaaaccatccatgacaatttagaaagctgaaaaagagtctctgagccaaagtatcagaccacaaaaagaatgtcactaagcttttaccgatggcaggagcctctgaaatcatcagaaatgctgacgtcaagttttatgtttcaggtcattcaaactgttagcgccatggacaaagatgatcccaaaaacggacattatttcttatacagtctccttccagaaatggtcaacaatccgaatttcaccatcaagaaaaatgaaggtaaatatattagctttgtgaaacagagtacaatataaattggaaaataggatgcaatttcataacataactgaaaattatcattaagataatttttgttcaactatgagcacttgaaattcagcttatcagtataatggcatggtaattaccttacttcctattttcaatatttaagcaatagataagaactttgttaatgtaaaaagttaattttttccccaggaaatacttcaatcaccttactttaaaaaatgaagagtaaaatttaacccctgtgaaagcttccaggtattttgagattctgagatatccctaagagggagaattggcctacactttgtagttgttaagttttaattgaatgtttaccacgtctttagggaaagctattctaattttgcctggtttgtgagtacacattaaaggtatttgttttaagcctgtaccaactttaacaataacagttagttcagaaaatcctctttgaaggacattgcttatcagcattattttggagctaatatgaactgatttattgttaagtctttcactcactgagcacatttaatccatttcattagattttctgaggaccaaccttggattactgttttctttaactatactatttattatatgtgaaagccatagattattgtttaaagtctatctcatttgaaaatttttattttctaagcagccatatattaaaaaaaatttaaaacttgatttttgttcaaatgtatttaagtcttagttgtagctgttttagaatgattagcaaaatataagcaatgtctcaggcttttttctggctttactgcaggtatctgtttaggtctctcaatggtctgtatacaagctatactcagaagagtaaaatttgattcatgatatctgttcctattgtttgcaatattctatttaaagggatagtgaatcttgataaaatttcctttatgaagtaaaataacattttatggctaaatatattatggccttgcctttgaacaaaatgctacatagttctgtggggacgctttgataaatgtggatgaatcacaaaaaggaaatgacagttgttatatagatattactaatttagctgacttccactattataaacactgaggagacaaaaccctttctgtctcctcaataatggagtattcatttgttagccacccttgattggaaactgtaatccaagtacattgtcattgtttatttattagcatcaccaatattttttaatggaaatcatatgaatatttctaacacaaagcctccttagaaaccccaaactgaactggaagtctgtgcataagtgtggtccgtgtttattctgattttgaactagtaagtatcaggcactatttttgcatataaaacgcacagcatttaaaattctccatgaataagttatttcccattccaaatattctgagatccttagtgtttcctgtaaattttgtaatttcaagatacacttcttgtgtggctctagaaggcatcacataaggtattgggtgaatgggaagatattattgggtaccaaggaaagtctaattttgacacgtatttattatgccttaatatttttaaacaggagatttaattctacaataaatgaattttatgtgttttcttgaattttggaattagtagaaggtaaaagtttaaatatttagaatacctcattctgcttcatcacacattatgataaaccctgtaatagaatacttaatgtcatgtggattatctgttttattttgaaactggaaaatagaagttaaaattatgatctatcttataggtttttcatattattttgctttgtaaattttttaaagatgtcagttattattgaaaaataacttgaaacagaaagagtactccatacatcatgattgcttgttttagactgtgtttatttgttttacaaagagcgaccatgtaatttattgtttctactgggacatgttttaaagtgagaggggtggctgcttatatttatgtctgaaaaacaccataaaccaggactgccttatggaaagtaggacttatgttcactgtgattttggatttaggatccaaatcttcaacatctccttcacaaaataaatcatgaaaccacaggtttgaaatagatatataaagtttatactctatgttcctcttcctagatcagaaatccatgagttttgcttcatagaccactacttacttggcacctgaataggtactgtaaaacagaaaaaaaatgggcttgtcttaatatgtagaaacaaaataatgaaaagaagctgtaaaaaatgttggatatatatatattttccttcttaagatgaattttaaaatggtcagtatctgatgcttctctactgagagcagtatgagttacaagttccagcctgcaagaaaaatgttaaaatgttgagagagctaatataatcaaatctattgttgatgaataagtttgtctcctatttaatttgatctttaagggagatgatttcagtatttggcattttctaaggaacttgccaccatatatttcaattcaaaattattgtaatttttcttgtctcttatatggattggtcctaatgcaatttctatcaattaattcacannnnnnnnnnnnnnnnnnnnaaatgagctctctcttgtctcctacacagttgaattatttcacaaataattctactaaatatatgagaatcatatttctgccagaataggaaagcaaccttcaatataaataaagatagaagtaaaggtcaaaaatacagtgaaccttttataccacatgttcacaccaaaaaatcaaagcaccttgaatatggtcaagatattgatttcttcatcttccagttggctgaatttataagcagagagttttgttgaccacatttcagtattggcctcaattttaaccatggaaatggaaaatagctaacaattaaatataacaagacagggaagaaaaaaagtgaccttttagagattctaaaatatcttgtttgcaggaaatttgaggtctccagaaaactactcttcctcagcctgaacactgtaggtaaaaaatgtgattcaaattgccagagcaccgtctggtgaaatgggagccctcatggtttataccgcaatttttaaatcatgtgtgtaaagaaatgagagaaaatacaaatctctgctctctaaggagagcctatggtaagacgagaaatagacaggggacctggatttagttatagtttggttatgtttaacccagcaggagaaccatagtacctgatgataccaatttgtttttccttcttaatgtctcctcattgactgaaatattgttgataagaagcttactttaaatgcatacttttgataattaatttgaataatgtagatgctaaccattactttggaataaacatgcctcgtgttacctcattgtccataatatagttaactgtatagagtataatttatgcattgtctgatagatttctgtctcaaccgagtggcctagttcaaatggtatacagtttatttatttttatcttctggaagtatcgaatactcttactttaagcaaatcattttaagcctcagttttctaatctgtgacaccaggataaaatacctgtctcatagttgtgctgtgatggatatgtgtgaactaggacttagacatcaattggcacaatgcctggcatatagaaaaacacgcaacaataagtgggacgaggtccctttatatgtgaattcattaattccttctcatactgtatctcctctggcttatcattctcagccaggtctctttgaagctttaaatcttcagaattataaatcttgtgcagtgattttgaacgtggcttcatcagtagttgggaaaacactgatcctcactagaatgcattgcaaaaacatctgcttatacagtaactgcaatgtattgcattctaaagggtattaaaatagacaaaataaaaagaaggaggaagaagatgaggaccaactatgaaagtatttatcagccacagaaatagctgcaggattcctgcatatggttttgaatatgatgactttttttttttaacctttctatagctccattgccaaaacgaaactcaggtttctccacacaatggtagtttccaattgttgggatcactttcaattctagcatataaaattgttctaaattgcctccaaacttccatctctccctgcaaacacacatactctgtgggaaccatttacatagctggaaaattacagacagccttcctttgcatttttgactaccatcagcctatctcaaacttcccgtgttgcaaaaccaaaatttgctgcctgaaagtggaagtggattttcctgattcccatgccagccagagctaatgctctgtccttcctcttttctccagctgaatcttcaggaatacattttctgtattcaggatgtaggtttcaaggcagacagagtcattctgtcctctgccttaagccaggtatacctagccaggctggattgtacttgaaggacctatatgctgatatacatagcaaggagggccaccttgctaagccaattgtcctttttctggccacctgagtcttccttaagttctgctattacaataggctgctttggaaccaacagaaggctttcctaaaagaaacatctcttgttcaagtgtcctttataaaaacatccatacccttagcttcagcagatccattattattgggtttcccaggcaagcatccccaaacaacaagcagaaactgtgtacttgcatgagtatgatagttaatatcttaatatatttccaatatgattgtattgtctgttctgctcacatagtggactttttcaaagcgcaacacacagcaccaaacgttgactggaagtgttttccatgtaagttgtctactattacctatatgaagcatgggacatttcttcaatgttgaatcataaaaggtagtgctcaatttgcatgaaacaggaggtgtgacagatcatagatacggagaacagcactatgcatatatgatccaaaaaggcttccgattcagtaatttatagtttattgtttatgcttccagcaatgtgctgttgataaaaagacatttatgtttcattttgtcacctaaactgtaattaagggcgatgtgcaagctaagaaaaatagataaaacagatttgtgtttccagtttctaagttgcatatgactgtacacttagtgtcacaagacaaggaggttttctttgcttgggtagtttttgtaaaactcttgttattttgtagttttcatattttcattttctttctaaaattgtaatttaagagtacctgcagaagtgaacaattttctttatacatgttgaaaaatcctgaaattattactctggtcagacatagcactgctgtgggtatctattttttagtgtatgttatggaaaacaatttagttctgagattactgaccactaggatataattcagatacatagcatagattttatagtttataggtgtggttgtcaaaatgctgttcaaagttttgaattgcatcagatcttttctgtcaatctgctagcaaacatttccagcctttacagagctttctaattctgaagaaaataaattggtacatgctctaaaacttaaagtataataataataatcaaaaaacaaaataaattggtacatgcttagttatcttaaagatgccttcgtgcgtagaatctttcctttgagtactttgctttctgagactgttgccccaaatcattatataaaataataaaggaagaatataaagaattatttagaaaaaatgtttttcatttagacagtcttgtccataccactttgttgtttgtttcattaaataataatgttatttactgatttatcttttacttacaagcataaaaatcagtcttgggattttgtggatattaaacaaacataactgtcctttggaaagcacaaccaaatattaaaattgaatgtggaaacaaaatgatctgtcagtctgtgcaaattctttttttttgaaaaaagatattaaatgtagttgacaattatttcaactcattacagcacagaagtttgcattttgcattaatttcagcactttatagatacaacattgggcatacgtgacattccatctgctaatgtgacctgagtaacacctaccaagtgcttcagatccctcagtttattgaagaagtagatagagaaggcaggaaaataatttggcaacaaaaaagcaggcactctgcatagataaacatgaaaaaaattgtcttgggatgaattagaatgaaacataagggagagacactatggaatatataatagcacaggctttatagttaggaatatttagggttagctcttccgattacgatctatgggaacctgcaaggtaattgaataatcttgaacatttgtctgtataataatatttatccaatgttgttttaaataataaaatattaagtaaaaaatttaaatgatgtacaaaattcattgactgacaaattggtgataataaatagtttccttgtcctcttcctctctattaaaatttaatgaacctcttgaatctcacttgttcacccaatgcaacaaataaaaatattaataaggaacctaaataaggtatttgggagatgattaataatatgcttttccattttcccttactcgatgggccaatgattgaacatgtctgcaaacattgtccatgagtaaagcacagggaaaggaggaaagagaaagagaagtatttgggtaacttaagtagttatttgaacataagcatcattacagtaacctaatcaaagaataaaaatggagagtacctaaaaattgttctttttcatttggctggagagagcataaagttatttacatagtggcaagtggaatatttaagagtgacagaatgacccaatttttaagccaggagtatcttagcaaatacatagcttatgaaagtcttgtatgctaaatatagaacttcatatgtacttaaaaagcagaaaaacaccaggcaatgagattgaatgtctatcttcctaactttattttccgttattctcttccgtcttctgtgcccttatacatgctttggtttgaacatgccaagccagttacacttttttttttttttttttttttttgagacagagtcttgctctggtgcccaggctggagtgcggtggcgcgatctcggctcactgcaggctccgcttccggcgttcacgccattctcctgcctcagcctcctgagtagccgggactacaggcgcccgccaccacgcccggctaattttttttttgcatttttagtagagacgaggtttcaccgtgttagccaggatggtctcgatctcctgacctcgtgatccgcccgcctcggcctcccaaagtgctgggattacaggcgtgagccaccgcgtccggccgccagttacactttttaaatcccctctcgcttcccctttgaaattcccatcctctgctttatccctcttctatttagcccattttaaatcattcacaataactcaggtattggcttcccttatctatgggcagagcaagtgggtggttaacagttgctgtaaagtttttcctcttttcttttctctgtaggacagggtggtaactgctaaggcaaacacatgactcaaggaatgttttccccactgtcttctgaggttattaataatggatggtatctttttttcccttattcattcattcaatacatatttatttggtgtccatcatgtgccaggcacacccttaagaattggaattggaaataaagcagtgaattaaatagacacaggttttgcccttctatacagtatatttttgttttcctcaggactctgtcttataacaatttgaaatcttagagaggaaactataatttacaatgaaatgttgtgatagagtggggaaatttgcaggcaagtctgaacaatattatgattttgtgggaattatcacatagtctaacttctatactttcacaaacaaagtttcctccttaacccaattttgtgaacctggccttacataaagaagtgtaagatcttccatggattccatcattcccattccatctttaggaagcatttgtctggtcagaatggtgatgtgcgtctttaatcatggacagctaattctccctctgagtttcatattggtgtccttattatgcctgagctcagatgaggtatgtcgaaccatactattcaatgtctttatactagcagggtgaaagaatgtcagtgagccctttccaaatgcacagtgatccgtagacatcactgtctttggtgataaagtactggcagtgaactggggctgatgattccattttgcaggcttattggaaaccattatacttttcatacaagttgcattatgtgaggttcatgcctttaccagctcctatgcatggttgtttcaggtacctgtcagttaatggaggttttagctcactttcagtgtacagtgtttactgaagcctcctggaaactagagaatactattgttctgatctctggccgtgacactgggttcatattccatctgttgcctattctatctgttcgctaatgtaccaccaaaatcaatgtgctgatgcactttgttgaggaagatagtaattgccgtgcttggatctttttgggttactcattgcctttgctttcattctagtagattgcctactagaatttccttcctctattgctcaagtatattatcctcagccttttgaggctgtttatcttagggtggtctgaaaagaaggtgatactgtactggtatgctgagcacaatcatccttccctgaatttcattcttttgcttggccagacagtcattgctagttccatcaaggtcacactgtgatttacttctccctggaactcagttttttctcttacaaaatgagtgggttcatgctagggagctaaaggctcatctatcccaacatactgagtgttcaaacatgtggtgttagaagacatatcacaaacgttaaaatcagacaagtcccaagtccaccaattaacagagaagtgactttggacaaggcttttaactttctgtaacagactctaagtgtttgaaaatgttggaacaaaagcactgtgatgaataaatgaaagaatgtaggataaaagccaatggaagttactgtaatttctgtggtactttatgtactttctcatttttttaactttcaaaaatcatggaagtgatctttaccatagaaattactgtataaaatatcttccatattaaaatattggatagtattattaaaagatacgcttctaaaacattgtagcttttctttctcagtatctttgggcagaattcttgagaaactaaataattaaatcattttcataaaataaaataactcaataaacatatgacaaatggtcccaatagttcgtaatttgggaatatatttcatttaagtctggagacaaggaaatagaagcattttgtaaagctatttatttgatgccattttggtttatcagagagatctttcaaaatgagaaagctttagtaaacttttacagacatgaaacatcgctatgtgcgtgtcaaagttaagggatatacctagaatgtagtttacttaaaggagaaatagggattgtccaaaaaagttttttaaagacaaaagtttcatgaagtattttctgtaaatacataggccgtatgatcataagaccttgcttgattctccaaaaggaaattaatgagatggtttttggtatcttgatgtgcttacatcctttgttggtgtttatttgaggcttttacacacacagacacacacaaacactgtttaataatgggactggaaagtatattgatatcaatacatataatatatatcagtaatacgcatgaaaactttttttttttatatggagtctgtggcccaggcctggagtgcagtggcacgatctcggctcactgcaagctccgcctcccgggttcacgccattctcctgcctcagcctcccgagtagctgggactacaggcgctgccaccacgcccggctaatttttttgtatttttggtagagacggcgtttcactgtgttcgccaggatggtctcgatctcctgacctcgtgatccatgcgcctcggcctcccaaagtgctgagattacaggcgtgagccaccgcacctggcctgcatgaaaacattttatcagtgcatagtttaaaagataaagaaataaaaagtaactttggccatgttttgaaacatatattgtgagtcaatgtgaaacttgcctttgttttaaatgttggtaagctaaagttgtacaaagaaagttttagaatgggtaagagataattatctaaaattctctatcttttttctcaaaggaagaaaatggaaatatgttcaggtaatgagaagaagttcacatgttgagtaggtagggaagaaaggagaagaaaaaactatctccctatattaacagtattataagttttctgtcttcctaaaataaatacgtattctacaatgtagtatataatttccccaaagaataatctagctaacgttacattccatagaaacataatttcttgtgaaatagttttttcagaaatatgaattatgttataaattaggaagcatgtttacatatctatgattttatttgggagttttgtaattattttaagacaaatttattctctattactcagtattgattatatatcaaattgcaagaaaaatcaatgtctaaaatttattaggcacctatttatttcacacaacttatattacttctatctctccatttatctttctatataaatattcagggtgactattattattgccatttttcctgatgagaaaactgaagttcagctatagtaagtgacttgccaggcaaagaacacggctaccaagctgctaaagctgcattttccacagtagcacacactgtctcttaaatccttgcagtttattcccagaacatttgctcagtaagactgttcttattttattttataattttcacaagctgtgcttcctttctgcaaactataggtcagcaaccatcagctaagcattagagaagattctcataatattagttgttgtaaaactgagtaacattacaacagaaagatagaaacaatcaaaatgatctatttcaggtattacaggtctagatcacaacatgataattgtaccgactacttcatgagcagcaactatatatcaatcattatttttgactctatgtatctgaccttcacaagtctttgcaagtcgttacaatgacactgactcattaagaaataaagtatgactgacttatttttcttttttcttttttttttttctttttttgagacggagtctcgctctgtcgcccaggctggagtgcagtggcgcaatctccgctcactgcaagctccgcctcccgggctcacgccattctcctgcctcagcctcctaagtagctgggactacaggcacccgccgccactcccggctaattttttgtatttttagtagagacggggtttcaccgtgttagccaggatggtctagatctcctgacctcgtgatccgcctgcctcggcctctcaaactgctgagattacaggagtgagccaccgcgcctggccaagtatgacttatttttcattcttaggaagacaacagtgtctcttgtattgggctaatagtcctgactcaacctcgcacaactttccgttctaaatttaacgaaggtatagaaaaacatagaaattgttatagaagacataaaaaaggaaaagcataaaaattaagactgacagtcaacatatggccaaagtcttgaaggactgtcaattagttaaaacgttgaaatatctagaataaaaaatactagcaatgacaacaacaatggtgcgcccaaagtaacctttcgtggacatggaggaaatctgcttgctggaaagttagtcagaaggcctggagtggccctttggtgaaaaaaattgcacatcaaccataaaagttaagtaactaattctatatggatgtccttttgctcttcccgtatcttgctaatgattgaaactcactgaaataaattggacaaaggtatctagtgaataatactggaaatttgcaaaactaccatttaattctcattattcacatttattctacattatcctattttaatgatcattcataatcactcaaatgtacacaatatattaagacaaaaagaacacagatgattcattattaaacttttaaaataaaaagtatctcaaatgcattaaatgaaaaggaaacatttagaaatatttactgttttctggaaatgagaattgtgtagcactgtgattccacataagcaatgtttataaactttttaataatatgatatgaaacttaaatgatttaaagttaggtacacagaaatacaagagccctcacctagaccagtgtatatgtccctgaatatctctggggattttatgttcatagagaacaaagtagggacttcaattgggacattagaactatacatcacggtagtctagtgacccatttgcgactgggatagatcactcccagtggcctgaaatcacaacaggtcaacgcattgtctttgccttttctgacccaaagcccaaactctaatctcattctttcttattttatttattcttttattagtattttaaactgtcatattaactgtacatatttgtggggtacaatctaatatttttgatatgtgtgtacaccatgtaatgatcaaatcagggtaattagcacatatatcacttcaaaggtttattatttatttgtgttgaggacattcaaaaactgctcttctagctatttgaaaatatacaacaaattgttgtttattatggccaccctatggtgcaatagaactctacagcttatttctgctatctaggtgtacttttctatcgattaaagagcctttggctacccatgccaccatctatcactcctaccagtaacttctgttctggttctacttccaagagatcaacatttttagcttctacatataagtgagaaatcttatacattgttattgggaatggaaattaatacagcccctagggtagaaagtattgaggttccttaaaaaactaaaaataagacaggtgcggtggctcacgctcgtaatcccagcactttggtaggccgaggtggggggatcccaaggttaagagatcgagaccatcctggccaacatggtgaaaccctgtctctactaaaaatacaaaaattacctgggcgttgtggcacgtgtctgtagtcccagctacttgggaggctgaggcaggagaatcgcttgaacccaggaggcagaagttgcagtgagccaagagcacgccactgcactccagcctgggcgacagagtgagacgccgtctcaaaagaaaaaaaaaaaaaaacaactaaaaatagatctaatatatgatccaataatcctgctactgggtgtatatccaaaggaaagataatctgtacatcaaagagacatcagcactctcatgtttattgcagcactgttcacaatagcagaaatacagaattaatctcacactttaatattttaatgccatcaaatgtaagatactgttaatgagacatcagtttatgtccaactaagaaagaaaaactgacaattaaatacaataaaactttaagaaactctgattttgggaacattacaacataaaatatatatatcttagagtcaaagaaatataatatttccattaataaagcacattggcttatgaaaagaagcagagaacaagaacaagaacttcagtacaagaataatgctgggtgggccgggcacggtggctcatgcctgtaatcccaacattttgggaggccgaggcaggcagatcacctatggtcaggagttcaaggccagcctggccaacatggtgaaacccccatctctgctaaaaatataaaaattaaccaggcgtggtggtgggtgcctgtaatcccaactacttgagaggccaaggcacaagaattgcttgaacccaggaggcagtggttgcagtgagccaagatcatgccattgtactccagcctgggtgacaaggcaagaccctgtctcaaaatagaataaaataaaataaaaatgaaaaagaataatgatgagtgaaaagactatgttatggagatcaacgctccactgaagttaaagtgtagacaaactgaaaaaattgtaaggaagcaaaggcagccatcatttggattatattactcatttaatttcttaatgcagtgtctttaaaagtaaatgaagtaccattaacaaggaattgcttgttcattttcttcttaaaagcacaatttcaaatgttgaaattgcaaagtaagaatttaaaatccaacgcatggtggtgaaagattctcctggaaatgccttatcagattatgttctagatcctgtttttgagactaaaacgtggagttttgcatcaaagaacttctcttaccaggaccctttcttctcagaagggcgatgagaatgagcaaatggtacagaacaggaggaaagtagcagagatttttagtaccataattcaggtgaactgaatagcaaagttggtggggcttcatgaaaggaagctggcaccaaatgggaatggagtttaaggggttaaactagctatctaaaaccaacttgaagtatattctaaatggagaccttgagaggtataaaagggttcaaataaatgaggattacatggcagcaggaatttccaaacagcaggaaaactttttaccctttgggacataaatattcccacttcaactctccttcttaagagcatcacccagctaaggtgcttttgttatatgggtgacgtatgcctccttagaagagcaaagatgaaaaaaaccaaagaaagatatcggagaagtcataagtccttggaggagattcagtgtaactcaagaagtgaaggccaaacctggtcgtggagattaagcggatagagtttacaatttactggttaattcctgggtccctgccagctccagtattttaggtccattagatgttggacttacagaagcgaggacactcatattgcaatgagtctgagcctcttgatatatggaatacatttgtttgttttcttagcagcctgaggggaaaaaaggaggatgcagagaaaaattggaggaactggggaaggcatggtctgtcacagctgtgattatattatccgtgatcccacacaattcttgtctttattatgcttctaatacataaaagactctcggaggcaacatgatgaaagtgagtagggacagagacaagcatacaagacgaagaaaccatttcccacagattgggttctgtctgtgtgctccatcactagctagctcatcttttataagctattgccactctcaaccttacgcttctcttaaaatggatacatccagggataatttacagcattatgaggataaaaaaacacaaataattatacgtgggctcaaagggaaaatcaatatatggagtctgtgattaaagaatgtgagagactgttaaatgagtgaatgcatttcatgtagcttcacacaaaagagcttttttctcagatggagaaaactaaatggagagagtaaatacatttataaaacttatatgttagaagtgtcagaaaatcccactcaagctatctgcactgtaaagggaaattgatccaaataataaaaaagtctagtgtttaaatggcttgtctaataaccagatccagctgcctcaagcacgttgcatgagcctgttttttgtttggttgtttttcgtttttcctatttctctaattttctctatgctggcttatctgctctgcacattctctctacagagtggaaacaaaaaaactccccagaaggggctggccacaatggcttacgcctgttatctcagcactttgagaagctaaggcgggcagatcacttgaggccatgagttcaagacctgcctggtccaacccgtctctattaaagatacaaaaattagccagatatggtggcacaggcctgcaatcccagctactcaggaggctgagacttgagacatgagaattgcttgagctggggaggtggagcttgcagtgagccgagatggcaccactgtactccagtctgggtgatagggcaggactctgtctcaaaaaaaaaaaaaataactctccaaaagtgtagttctgactgcatctcatagcttggtgtttgtggataagagatgttctctatcccaggttccaaatcaattcctgggtaagggtctatgtttggcctcggtggtgaacatgtgacccaactgagccattctctgtctgcataagggtgacatgttctcaaagctgctgtgtacagttgtgtgagtgtttcctgtacaagatgctggccctggaaagaatgaaccctgaaaaccaacccacatgcccattgacaagataataatcccagtgagggctcccttgtcttattttcagaaaagcatcatctcaatgacaagcccctaagcctatgaggccgtagcttcccagaggtaaatcaatcttttattttatttttctacaacctttattttaggttcagaggattcgtgggcaggtgtttttacatgggtaaattgtgtgttgctgagcttttatatatgaataatcctgttacccaggtaatgagcatggtacctgagaggtagtttttcaacccttgctgcctcctcttcctcccccgagtggtccccagtgtctattgtttccttctttgtgtccatgtgtacttcactgtttagctactgctcataagtgagaacatgcagtatttggtttcctgtccctgtgttgatttgtttaggataatggcctccagctgcatccacgtttctgcaaaggacatgatttcattctttttaatggatgtgtagtgtttcatggtatatattaccatatttctttacctagtctatcattgctggccatctaagttgattccatgtatttgctactgtgatagtgcatgcatgtgtccttatggtagaattatctctattcctttgagtatatacccaataatggaaatgctgggtcaaatggtagttctgttttaaattatttgagaaatctccagacttatttacacagtgcttgaattaagttacattcccacaaacagaatataagtgttccttttctctgcatcctcgccagcatctgttttttgactttttagtaatagccattctgactgctatgagatggtgtctcattgtggttttgatttgcatttatctaatgatttaattcacacaaactattgctttaggttaactgcacctttgagacctctgatgggtcagtttaattccccactttccactggagccacttgattgatagccccattgcaatcagaagaaatggaggaaggtccgttttaaagcaagttaggctgtgaaaataaagagtaagtcacagacataccagcagcattatggctgtgaatgacctcagcagagggattccttcacttcccttgggaagcttttcagtagagaatggctctcagaaagttacgaattgtagttgtctattatgtgacttacattgcattacattgcaatatgtcattgtgagatgtgacatagtataatgtaagtgacagacagctaaaattttacagcaggaaaacttttttttatatcaagatctgctatcaaatttgatagcagctatcaatccatttttccctacagatagatcaaaatttgatgttcatgaaaagtaggtcatttgaaacatccgcaaacacttcaatgcctgcacaactcggttatcataaatcagttaaaaaaactctaaaaactgtatccatctttactcaaattctggttttgcattctaagacaagagtaatattgttttagactgtgagtttagttttcttctagatattactaagaattgatgatcaaataagttatttcagtgcccaaatcacatcagtgggttctcaactgggagtgattttgcagttcaggagatatttgacagtgtctggaattgtcacatctaggaaaggggtgggcagttactggcatctagggattagagaccaggtaaacatcctatggtgctcaggacagaatctgcagggttgttctgcccaatgtcttcacaaggcctcagatcaagggattattactaaacgaattgacccaaataaggtcatgaactagttgaaaggtggcccaagtaaaactgataaatctagaattgattctcttccatttacccaatcttcaagacaggctatggcaatgtgttaagtaaatattcagctacatttggggggcttatgggacagttaactgaatctctttgcacatcaaaattgactggggactttacctactgacagccttatagcagagcctataaggagaagaaagtaggagaaactagggtctaattctatctcagtcaaagtcaatctttgagaaatggtttcccctctcggactccaatggttccattcacattatgggaatttgtgtacagcagaagtattccactaaaaaaaaaagaagaagaagaaggccgggcatggtggctcatgcctataatcccagcactttgaggggctgaggcgggggatcacgcggtcaggagttcgagaccagcctggccaatatggtgaaaccctgtctctactaaaaatacaaaaattagccaggcgtggtggcgcatgcctgtagtcccagctactcgggaggctgaggcaggagaatcacgggaacccaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgcttcaacaaaaccttctctgtacaaaagcaaaaggcagactagatttgctccatgggtcatagtttgctcttctccccaaactagtttatactttgagaatcccttatcatattgaaagacaagaactgaaggaaatacttttattttttaacccggtaagccctattttttaaattccattaaattatgatgataaaattagtaatttttgttgccattgttttgttttagctctctgtctctgcacattattatgagttattaaaataagtcagttaacactttcaacatcttgtctggaaaatatcctgccaatatccacaaatttattttgtgtgttttttaaattaatttgtcatgttatcgtaggcactttaccaattgttttgctactctatgactcagttgaccactttgccagtttgctatggcagttttgtcaccattatactacattatactaactaagaagctaatagtttccctgctgcttttccagcatttgctcaaagcttcctgacctcccaaagtcaatcttacatattttagactttaacccatctactcaccgaagattagttttctccagagaaaaacagataaaagcattctgcaaagtaatagaaatccactgttcttgttttgggagagggccttctacagactttcattaatattatttagcctgttatgacaggggaaatctcaaggaaaataagacctattctccttcaatgaaaacaaacaaatgaaaaaaaaaaaacccacaactctcttttagctggtgacatcaggacaaatctcaacacatacatacacacatacacagataaacacacatgcttttggtgtgtatgtgtgtagaaaagctccagcagtctcagcaaagtatatgcatactcttttcatactccctgaagagggaaattttaaaaaatagcaatataatagacatttttatacagctagatctgcaggaagaaatgcgtcaaactgcaataatgacgcgtagcaagagtgactaaaagaagtatccagtggtcaggttcacaggcaaccacagacagaggtaaaaatctctgatgggagaatctttacaaaattggtcatcacgtttgcattagggcattgaaattcatgtcagcagagtgactctcataaaaacattgtattttttctctagatagataaactttcatcacaaattccctggttgtgtccccgttcatgccagttgttctagcattatggttggtaataatggcacttttattcccaaagtatttggatgataaattatatgggtacccaacccttaggctacatctgcttccttaacatagaaaatcactgactttctcacatattaataattttcaggtggataatgatgtatttcccctgcatatcacattattaatgtctaaataggaaaaaattcagcagctgtcaatgtctaataagttgatcacagtggccaggaaatgttgatggaatggttaaatacataaaagtcgtgcattattattactgctgttcagtgtattttcagtgtttgagccaagtactacaaaagctgccttgtatactttttttttttaaccttttattcatctgttcaggtacatttaacaagagtgaactgtgttcctgtggcttacgagaaagaggtactgtgacaaataggggggatgtggattaacgttatgatccacctcttcatcaacaatcctactaaagatcgtactccacccccaaatcattgatttgcttgtctaaagtccgaggttctcaaagggcacaataagttcccagacaaatggatctcaagcagattgggtgacagaggcacaatgaagaattttaggagattgagacctctcagctggtgttatagggataatgagatggaggcaataaaaatttagtggcactctaatgcaagaaaacaaactgaggaaaaaaaaaaagataatgcacatgtatgcaaaccacagagcttgatagtgcaaataggtaaaatcagtgcagcaatggcctaggcatacccaaaatgagtatgatcctttaccttagtagaagccttgagagtagaaaagcaataattaagacaatgagagggacaataatagcgtgtaaatagaacacagagaaggaactctgataatcagtttctgaaggaagttaacctggactgacttctcaaggtgtgtgcggcaaacaaaggtgcatgatttatctaggtaagggaaaacaggccttttcgaagataatgggagcagcttggctagacagccagatatacaaggagaattggttggtactagtagactataaagtgaggagcagcctggcatcaatatctaaaagtgaggctggagagaaactcagggagattttgagtaattgcagagctgaggttgaaaaatgagtagaacaacatggaggtaattcttaaaatgattttgtagactgcaatcagccttgagggaggagtcacccacgtatgattaactatacttgttaggaaaaatgtttcaaagatttcaattatgagttatataaatatattcatcatatccctgcattttcttatattggataatgctcttggagccaacatatggttctgctaataaacgtgttacctggcacaggaaaaagaaaataaacaacaacaacaacaacaacaaagaccagaaagctgagagatttatttcaaaagtttaatcaatagctactataatataaaggtatgtgtgcttatcaaaagtgtacaaatatttcacaactctcacttctgcaaattctgaccaaaccctgaagatcttatcatgcatattgatacaaatgatattccttaaaacctcatttttctcatgtgaaatagtagagcttatatagatggaaaagaccattatagaatcaacaatgtgtgagaaaacacatttagcaagagggtttataacttgccaccactctgcccagttattctacggtttcagaaagccagtagtgacagaattgcaacaaggatcaataatgcatctattcaagccaagaaatagaggaattattaacctttagaatctatctttagacctccttctcaacaatgccctcaagagtcagcaggctacttcagagatgctcttgacccaggcagcttcatcatttttaaaacataaatattgcattgccaaaataccagtataaatcccctaggactcactattcaacatatgttcaacacacttccttgctcctacacattttgaagtatgtcaacttttatggaattgtggtatgaatgtagacgtagacaatcacagtgtaactggttaactgaggtgaaattggaaaaggaaagacagtctaaatcagtggcttttagaacatggtcagactgttgtatcctacctataacatatattagtgatgtaaccttgagcaaagtagttgaactctctaaaactcaagtctttatctgaaaaaaaaatgtattagtaaaaccatcctcatagtattattatgatttatgtttaaatcttcagaaagattgaataaatgttttcttgtaccaaatatctggctattcttatcatcactgaagaaaaataaagattctgcaatcataatgaacacatagtaagtattgcatcttggcttacaaaacgatggtttcacttttcctgacccttttgtttcccaacaaatatctttgagctcatattattgttatcctcattttaaagctgtagaatttaagacatggtgaggttgaggctaaatgattgccctgaagtcacaaagctaaggaggggtaatcaagtggcagaagtagtattcacagtctgtatgtgcctgggtgtggctggagcaacttagaagagaaagttgggtttggggtagagtttggctgacactaattgagtgcctcttatgggccaggtactttaagcatcttatctcattttagcctatgacaaccctacaaaagaggtattattgttccatcttacatgtgtaaatacctgagtgattgcgagagatcttttccaagatgacagaagagctaaattcaaactggaatcattttgattctaaagctcttagtatgtcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggtctctcagtagacgacatcccttgcctgaggatagaatggcagggaatttaagctctttgaatcttcatatcccccactgggatatgatccatctcagtggggtaattctgcagaaactcaaaccacatgaggatactaacaccttcagagctcagactgctgcatttgggattattgtagacagtaagtacatttcatttcttccaaatactcaacaccccacactacacgaaaaaggaagcactcataaaaagggcaaaactcctcctctaacttaattgaaaacaaattgctttgcaggcaagtctgggccctgggggaggttagcatatggaaacaattgccaccgtacatatcttaagtccttatatctataggtaaagaaagccggtgtccttcattaaagtttccaagggctatgtgcccatatggttacatatttggtttgtgtcagagttgaaataacagaatgtaaattagctgctcaggcagggaggtgggtatggaagggtagagctaacactggcaggtgacacaatgaaaggaattagagagaacacaaacgtgtgggtttccccttccttctccctctaaaagtacagcatattggaaaagttactactgggaagaaagacttcaaagttgtttagaacataaattctggatgcagagagaaataaatcagagtccttttaggtcaggttacgagatgagttatttcactgctttcacttttagtattctgatttgccaacggatgctgatgactttcctcacctttaagaggtgggaactgattgaaatcgtgatgataaaaatgaatgcaataatatataaatgagataaagcttagaaaagactcactacaattcttagcttacagatgctatgcaatcaaaatagctagaaattacgtaggttaaatctgttattttcttcattttcaagataaaactgaagcacataaggattaagcaacttgcccagggcacttagtggatagatggaaaaccagatttaaacccgaaaagtctgactccagaaagcacaattaaaaatattgtgttaataggtgtttcttatagcagattaggataattacttctggcaggaaggtttgtgtgagggctgaaggcgttgttagtatcatcttgtagtatatttaaattgatagcatcctcttcatgacaggcatcaagacctttataatatccattaaattgaagacactaggctgtggcatcaggaaacctaggtgcccagagtgctgctaaagaacagaatggcttttagaaaagtagttagactatctgagcctcagtgtcctggtctacaaaacgggtatgtgattattatgtcctcatctaaagttaagattactggataaaatctgtatgtgtacagtacatattaagtaaagaattgactcttatgtactttatgaactttgtgaccgatttttttttggcttagaagtgggatcaggactgaacattgccactttcttttacagttgtgtttcttccctttttattgtggtattacaggaaaaaaggaagacaaatgagactataattaatgtattataatccaggcatactgttcaatggttcatttaatccatcacaacctttaaggaaagtatcaacataattttaaagtttacagtaccgtagtaaaggatattatataatttgcatacagttgtatgattaagaatttggagaattggtctatagaaccctttttaaaccctatggttgctgctttcttaaaaaatatctagttgctgtaatgaactatttatttttctgttgtttcaaaagctactttttaagcacagcttctgctttcaaacctcaaaaggacacatacaagatgcagaaatgtccttctaatttccaaacacatactgctaacctaaaatgcattcactcaaataaatataaagaaacacaaaacccagctctgtcagggtttctagctgcaagacttccaattaaaaatatctctttttctttacccaagtagcatttccaacatagataacaatttcactgcaacatctttaataccattaatgatttgatctttctgcagagaacttaaaagcctgtagaagacagcgacagacccggggtaggtaggtggaaggttacacagcaggaatatctagtgatctgaacatattaaagagagtgcacaggaattaaaagaaccagatgaggggcacttaaaaagtaccacttgaacacaaaccaactgctgatttttaaaataagaactttggaatgagaaagtggattttcaatttctctttggttttattttcacaggcaaaactaaatggatagttgtggcaatcaattctgggaacagtgccctgtatagcgtaggtgactacgaaatttgaaaaatcaataattcaggcaaaaaaatcatgctgctatgaaaatagagtaagaagattggaggtattcctggacgaatattgatcattatttgaataatttttctaaacattcagattatgtttgtgtggctttactttggttttgagaaatcagattcactgacatagaaatatctcaacatgaataagactttctgcttcagttacgtataagcaaaaactggcaactccacatttatctaaatttcttaaattagataaccaatgtggaccagaatattcatctttcattctgtaaacaccaaagcctgaatacagcctcagtgctagattctaattaagttatttaagacaaagactcccgcccataaataaatttaccatccaattccaatgaacacagtagcaattaatttagattcattttcaagtgggagggcaagttgtgctttgatttagagccactgattctgccctaaaacctgacaatcatcttctaagaaaagtatgggtgaagcaagtcaagctcattgtctctgcaggaaagggtagtagtgatggaaaacacaaagaaggcaatagtaataaaaataatgataataataataaattgaccttgctatgctgtgcctggtctatgttaagcactttgcataccctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttgtaccatgttatattgcttattgtttatatatgcagaactatttttaatatttctaatagtcctatggggggtatcctatcattttatttttcagttaaggtaatactcaaggaggttgaaaattttgcccaactctgcaaagcagtaaaaaacaaatatgttattggaggttatctatctaggttttcttttaacttttactgtgaaaaatattgaaaatataaaagtagaaaaagtgctttattgaacttcacatacccttatttcaaatattaaaaattctaaactcatgtccaagcttaattcatttattttctcactgatttcctccacttgtatttctttgaagcaagtcccagttatcataccatttacccatatattttagtgtattttatttaggttctctgttgctgtaactactttttgtccttatagatggaatcgttttgtgtagaactagttattggttgggaatgttaaaacgaatcacttaaaccttcactttaaaatgtcactggcaaactgctgattccagcctgcacacggaggggcaattgctattctgtaaatcaagcaagataattgcaagtgctccatggcttcttggacagaacaagcatttccaacaaaacacttgtaagccaaaacacatgttttttttttttcttaaacttctttatctttaaaatgagggctgatgaaggacaagagtaataattgaggaaaaacaccatggctgtagtgaacaggagaatttaattggagatactataagagggaatactaataatttttaaatcctgaacaatattcaactgtgagaccatggtaacaaaagcaacacaagtatttaggcatcattcccattccctagactgctgtggatattgaggttttggcaaatgggtatttaaaagtaagaatgcagagtaattagcagaaaatccacatgtgacatctcttgggattcttttgaaaccagtttcacatcttcttagatttctatatttttcatttcaaattctaaaatacaataaaattactattttttcctaatacatgaactcccattgcatctgattactaaaaattaatgagctattaaatgcctagataaattgttttcaatcttcaatgacttattataaaaggaaaatgctataactctacttgaaacattggcttagatttcacttttcacaaggagagaaaaaaagattgaatattatctttttttgttatagaagagtaagttgaacagcaggatctacttattgagttgtgggaatgtctatttcttaaaatgtgaaatatctcaggggcttatccttctgtacttagagagattattttcccagagattcaatgaaggtttttagagcctttgcaaagcattatgaataccgttagcatcatccagattaccatacaggactctcctcagatgccagctattgtcagcattcaactcgtgcacagtattgctcaaaggaacgttctgtggataagctttaggatcacgattttagctttgcaactactcttccaatcttcaaagggttagaatatgctgctttcctatgtgaatgctaattcaactgtgacaatatcctctttactctcaaaattttaagtaagatttttgagaaatcatttacattccataaaatttgcccattttgtggtacaatttaatatttcacaaatttagaaagctgtgcaaccatcagcaccatgtaatcttagaacatttctatcacctcaaaaaaaaaaaaccttcttgctcattttcagtcactttctgtttacaccacgagctgcagacaataatgaatctactttctgtctctataaatttgccttttctgggcattttaaataaatgaaattacacagtatatgattttgtatttgtctaatttcatgtagagtagtgagtttgaggctcattcaagctgtggtttgtatcaggaccttgtttcttattattgccaaatagtattgcattgtgtggataggctatgttttgtttattcatgcagcagctgatggacatttggattgttcttacattttggtgactgtgaataatgcttctataaacacttgtgggcaggtgtttatgtggacatattttcatttatcttgcatagatagctcagagtgaaatggctgggtcatatagtaaagataagtttaatattttaagaaactaccaaagtgttttccaaagtgactaccccattgtacatccttgaaagcaatgtaagagtgatccaatttctccctgtctccacaaacaacttttacggtcctttttttaaatatatataaaaaactattatagtcattccagtaggtgtaaagggatatcttgtagtttctaatttgcattggtgtaatgaatttctaatgccctttgccctgtactaaatattatgcccagcttggcacatttatttgttctttcagccacaaatatttattaatatacagctttgtcttaggtgctatattaggtgcagaatctacaaaggataataagcaaatggtattaaatccatgaaatttaaaaccttacaggttataaccatgggatctatagtggcagaaaacagatgactcaagtaataaagttaatgttttaaaattacatatgtcataggtgccaattgtgtgtgtgtgtatgtatgtgtgtgtaaaacgaaggggagggagcaagtgatgttatgcagatttataagtattaaaaaaatccttgttctcatccacaagttcaagtccccctgagtaaataatgattgagctaagatgtaaagtatgagaaggaatttacctacagaaggtaagtagggaaaactgtattacacagaaatggttgtattttcaaaggaaatagagagggaaagagaacggcgtgtattagaatcggcattggtaggatgttccatgttatcataggtgattttcctaagttaccacctactaccatcaatcacaaatatgtgtaatcatcttcaaatgtggctttatttaatggactagattgatacggtttgcatgaagccagagaggaaatgtgacctgccaaatatggtaagcactttgtttattagagtaatggacaatcaccgaagtgttttgaagatgtatgtttgcccaagtttaaaacagatctcaggatgtagtgaggagaacagatttgggttggcaagaatgacgcagggatatggttgatggactattattagaaacctcacatgcttaagtttaaaaaattgtgaaaagatcaccagaattgttttcattcacttgacagcttttaccttatctgaagacttatattcacagaacacaaaattcaaaaattgaatgaatgatatttggagaaggatatccatacaatacaatgaggaactttctaattcttttcggttgtttaaccatggcatagactacaatgaagcagtgatccttttatcttgagacatattcaagaaaacactgaagagtcatttgggtagaattagagtacttcaggaatggaacaaactagagccatcatctagccaaacattccttcagatgcccaatgatttgtgattgatttaatattttgatccccgcattagtacagtttcaaaggaatttggatgccaatgacaaacatatgatttgaagataaactattgaattacatcttattttttaaataaacattgatcatttgagataaaatctgtcctctctcttagttattttgtgactttgaacaaataacagcctctgcctaagtcttgattttcagttcattattacgggcatgaaaagattgctttttacagagcacagtaactggtacatgtctgacagatgctaattgcatggtctgcccagaaatgcattcaaaaaaattgttccattggtataatgataacaacttaataacatatggtaatcataattaattataattacagaattttaaatgaagattttcctgataatgtcccatctcagagatttgacagtggatgcaaaagctgattttggctgtgaactagtttaggttgtgtaaatataacaaatccaacatccttgctcattgttccatttttaaagaattcatcatagactgatttatggggacttaggataactctagcaagaaaaatgcaacacgagaaattgcttttattaaatctttagcctggaaatgacgtacgtcacttctgttcacatttcattggccaaagcaaataagataaccacacaattctaacttagaaggggctaagggtacagtccaactgtttccttagaaggtgagtcagatacacttgctgaacagcactgttgatgaccatcagactccaagttccaggtcatgacattgtctatgtaagtatttcaaaagttcagaactaagtcaatgaacatcagtttgtaagtcacagctccttatgaaaagtggtcgaagataaagaagccagtaataaggactgctttaaaggtgcttaagattagcaggggagggtatgagaatatggcttcctacaattattttaccagtaagagaactcaaagagggtcattagaaggcattaacatgtgccagtatcatgctatttttgttactgtagccttgtagtatagtttgaagtcgggtagcatgatacctccagctttgttcttttggttgatgggtgcagcaaaccaccatggcatgtgtatacctatgtaacaaacctgcatgttctgcacatgtaccccagaacttaaagtataaaaaaaagagaaggtattaacatgtgctttagggcgtcagggacaaaggaattgatatctgacacaaaaggaaaacgaaaagcaagtggctaacctggtctctattctgtggtagagcaaacagttaatagtgttgagaggaagttgcagtttcatcagtagtgttgatgaagagtcaaactctgtaaaatatttgaagagacttattctgagccaaacattggtcatgaccaatgacccgtgacacagccctcaggagattctgagaacatgtgctcaagttgatcagggcacagcctagttttatacattttagagagacatgagacttcaatcaaacacatgtaagatatacattgtttcaggccagaaaggtgggacaacttgaagggtgttggttggggagcaaggggcaggtgggagattccaggttataggtagattttaaatttttctgattagcaattggatgaaagggttattaacaatagaaaggaacgtcgggattaccataagaggttgtggaaaccaaagtttatcatgcagatgaagccccaaggtagcaggcttcagagagaatagattgtaaaggtttcttatcagacttaaggtctgtgttgacgttaaatgctggtcgacttttccttaattccaaaagggaggagggtatgatgaggcatgtctgacccttccttcccatcatggcctgaaccagacgttcaggttaattttggagtgccctggccaacaggaggggtctattcaggtggttagggggcttgtagttttattttttgtttacagtagcagaacattttatatgttattattatatgcaaatgtagactgcagctgggactggctggtattagaaggaaaatagatagatgtacttacatagaggctgaaattccagcccaactacatttccaaagcaaatcacgtttttggttttccaagtattgggggttgttgcaatttgtcctctctatgtaattttctgactgtataaagtagcagcaaaacataggatcatcttaaaggaaaccccagtcctagtagggccagaggacctggaatggcagaaatctgagttggggactttttaggaaaagcatggtgtaaagtaaatggagcccatttgtatcaaaataattaaagttggaggctgccactggaagagtctttgaggaacatgtgaaagatgccagtaaggaaaagtaccagcagtattttatcttcctcacataggccttcagtgacaggttacagctatatcagccatacgagattatgtcatttaccttgatccctgtgttttctgggaaagacgatgaagagatcagaatcagatacagcagatactggaatgaaagagaaaaatcgaggaatggagcgagaagacaaaaacataccccaattttccaggctatcttccagacctgaaggaaaaccaagcttgtggaaggcagatgttttaaatttaacacattggaaggtttataaaaagccatctttttttgtggtatagttgacttacaataaacctcttttcaagtgcacagttccaaaagtttgacaaatgtgtacacttacgtcactattaacaataatcaaggtgtagaatattttcgtcaccctacaaagttttcttatctctctttgcagtcaatcctttgcacacatatggtagcaagcagtgagggaatttgggggatgatggaaatgttctacatcttgatgagtattttttatttttaggatgacaatgtcaatgaatacaggcaatttatgtgtttctttctaagctgtatgttaaatgaaggttgagagtacaaccttgcttgttgctgatgttttggaaaaatattcagtctttcaaaattaagtgtaatattaactgaaattgttgtggttgacctttaattggttgaggaaatccccttctattcatagtttgctgaaaaatttgatcatgaatgaatcttgaattttatcaaattcatctcttgaaatgatcatgtgcttttctactttattctgttaatccattgattaattttcagaatttgaagaaaaaacaaacttgtgttcctatcagaagcaccactaagtaatgttaatatcatttttagtgtctcttatttaattgaccttttcattattatgatggccctctttatcactaatattcattgttctaagatttatttcatttgatattaatatagccacttcagcttccttatgatattagtataaccaccctagcatttttattactagaattttctagttgtatatttatatatatttttttcttttttgcaattttacttgttaaattttctttgtctttataactttccaagcaaaacgttgtggtttttttttttttgagtgtgtgtgtagtttgtatcttactaagtttttaaatctagtcatgcaatgactgcctttttatttgaggacttattctatttatttttatgtaatatttgacactgttaactttaagtctacaattcgtgtttgctggttcactctgttttattttttatcttaaactgtcttcttcagtattaagtggctatttttgtgctcaattttatgtcttctgtcaacttattagtaatagctcttttattattattaatattgtcattagtctaaagtttataatatttgtctttagcttatcaaactttaacttcaagtaatattatactacttcacacagcaatgtaataatatatttcttacaatgtaataatttttcttcatagacatctttatgctctcatctcatattttatttctatacattataaagtcataattgagttattttaatttaatcagtcaatatgcatttcttaaatttcataaatgataacactatttttatttttttttattttnnnnnnnnnnnnnnnnnnnnnnnnnnnnnnnnnnnnnnnnnnnnnnnnnnnnnnnnnnccagagtgtggtattccccttcatgtgtccatgtgatctcattgtgtcaattcccacctatgagtgagaatatacggtgtttggttttttgttcttgcgatattttactgagaatgatgatttccaatttcatccatgtccctacaaaggatatgaactcatcattttttatggctgcatagtattccatggtgtatatgtgccacattttcttaatccagtctatcattgttggacatttgggaaccacatatttaccaattctggcactttttgttttgttgtttaaattcatgtttctagctggaataatttgccttcaagattaataacttcctttaacctattattcagtgcagatctcttggtgacaaaacttttcattttattcattctttatttatcttctgcctcctctttccccttctgggactctgattacacgtatatcagaccacttggtattgtctcatagtttttttgtttttttttttttgctttctgttcatctctgtgttcatgttcagatagttgctattgcaatgtcttcaaattcacagatcttttcttctgcagttctttatatgttgataaagcaaccaactaaaatttcatttcagatattattttattatttatataacatccatgtgttttaaaagtacataatcttccatttctcttattgttttctttttctttaaatacttggatgtacatacaacagttcctttaaagctttggagtatcttatcatcactgtcatttctatattggtttctattgactgacttttctcttgattttagataacttatttttgtttcttcacatatcttgaattttgtctgagttttagacaccacagctgttaacggtaagatacctggatttcactatagttcttattgccccttgagtttggtagaaatgaatagaattttagatcagttctaatcagtgtgagggttttttttttttttttgtgagttggagtcttgcactgtcacctcggctggagtgcagtggcacgatctcggctcactgtaacctctgcctcccaggttcaagcaattctcctgcctcagcctcctgagtagctgggattacaggcactcaccaccacgcccaaataattttttgtatttttagtagagatggagtttcaccatgttggccaggctggtctcgaactcctgaactcataatatgcccgccttggcctcccaaagaggcttatttttaacaacaggtttagggtagatctagagtagctattccctagaattagtttctctctacttttatggtgtatctttcttgtttctctgctgaatgacttatgtattaggtgaggtctttctgctttacatagtcaaacctcaagtgtttccaaccctatgatagtcacagtagtcattcaacatatatttccacagttgatattttatcccagtagttgttctggccaggcctcttggattctcattctatatgtgtgtagcttggtagtcaaccaaagattcatgaaccttatcatatttcacaagatctgttttctgcagagtttcctccactctagtattcacttttgcaaattccagcaatttcaccattatcaaccccctatctctgtatcttcagctcagcaagactgtcatcctctgtttgggctttacttgagagtttttaaaatacattgaattacactttttaaatattgaaatgtctcttgtcactaaatctcactgaaaaagtgagaatgtgcctcaaatttcttccatggacaagaaagaacaaatatagtatgtggtttctttcttggtaagaaatgcatgttttatgcatgagttatacttattgtacatattgaataaaacattaagtacaataactaaacaagaataatgcaagtctagaaccatgcatcatggaatatcatggaatttggaaggggaaatgctgtattttcattttagaaaaatctgaattcacagttaaagaaagttgacttatatcagattattttaaagaaagaagtaagctctttaatgatgaatgaaatgtattctgaagtgacatggatacaatttcctagaggacactaaatatttctcttaatagttgaaatattccagtcaatagagatacatgaatgtaagaattctgtgaggaagaaaaggagaggcctcaatacaaaaataaaaagatagaaatttataaaatgatgtcaatgaccttgggctaaaagggctacacattaagataagagaggcaattctgtgctatttaacagcacctactgtatacacagtctaatgctgaatacctgagataggaagatgtaaacattcaactaacagtcttgtcttctaggaatcattatctctggagagtttcagaatttggttcataactatagcattttcctagttgcttttggcattttctttggtgatgtagaaagatgtaagttcacatgagcttgtctattattaagatagttttaaatcaacatctgtattacctaaagcattgaatgatggatttacactgtgttaggtagaacatttgcttgaaaaccactttatattgcatctgaatactataataacctcatatttcattctgagaactcttcctcaatatgaatcttgaagaaccttacttttatcttaacatatatatttttagttttttacaatttactttatatatcaactatgaggcttccaaataaaaatttattataaagtatgaaagtgtggaatccaaacattcttaaaagattgtagctttctgctttgtttcaaagctgagataactgataatcttgcatatggtaataataactactattagtttaagttttattgaatattttacacatgaaaaactctgaaagaacactttaggtggaataacaaatgtattcctcaaagattttttcatcttcagttccttaattagtaatgtgaacacagtcaaaatatctggtattaccttggaaaaattattttaaaatgcaaccaaataggtaataagattggtatgcaaataaaaatgattccagagcctgggcactgtctactatgatattcaaaaatattctgaaatatgcatcataaagaaattgcacctaatataagcctttcaataatcagaattttgaaagggaacaaattccctaaaattctctggatttgttaagcataactcttctgattctaaagtgtgaagaatttgatggtggacatctttatatcactacccactaccaggaagtaccacacatccattatcaactagggatggcaagcttagaaaatcaaataccatcttgagaatattttataagactcattcaaaaaaaatcccttttattttaaaagaaagtattaaaatgaaataatgcatgacttcaaaatgtatttagatttctctatagtgtacaacaaaagggaattgtatcagattacattttcagtaaaaagagtttgaatgagtttgatgtgatttctgtttcaatcataagggtgacctacacaggtatctttttttttcaatcatttgtttctgctctctccatctgtattttaacctgttcatatgtgggtgaatttgagggaaagtaaatcagtttgaccttaatgtaaagtcattcttgtgtgatcaaaacagtactatttccaatattaggaagaatgtggattttaagattcaaaagcacatgccgttctcagcaacctgggaggaatgataatgtgtccactgcttgaatgataattttatctacataactgccttccattctcttgccttcactgtgtattaagacttctgcccaaagatatatgtttagacaggctgttttaatatcacatattaaactttaaaatgattcaaggacaaacactggactttagctcactgtaggataccacatttccttgcatcatttccttttttttttttttagcagctattttaccactaaaccaggaaagtaggaattatgcaggaaaattgctatcagctggtaccctggctggaccacacaatccagagcataatagcttccccagtggagcctctgacggcttgatccaagccattaaccactgctaacacctaagggaagaaatggaatacggtgaaagggctatcaggcatcccagaagatctttacgccaacaacatttgtttgaaatgcagatacccagggcccatccccagaaattcttatttagttgatttagagtaaaatccaagaatatgcattattaatatgctcagatatttttaactgaattactgcaggatttttttttcacttggcatcagtttatatgaatatatgctcagacccaagtggtaatggggttgaaatttggattggcaaggtggatcagatgcaatagttcccccttatccatagttttgctttctgaggtttcagttgcctgctttcaaccttggtctgataatattaagtggaaaatatcagaaataaacaattcataagttataaattgtgcactgttctgagaactgtgaataaaatctcatgcagccttgctccatctcgctggggatgtgaattatctctttgtcaagcttgtccacacctttagtcaccaactacctatgtaggtaatcagataaaagaaaaaaaaacagtaaatatagggttcaatgctatccatggtttcatgtatctcctggggtcttgggatggatatcccacagattagagaagactactgtatatcagagcttagtatgtataggtatttatttttaacattttaatcaacaagtaataattctatgtatttatggggtacaacgtggtgttttgaactgtgtatatatttgtagggacttaatttttaaaatttttaaaatttttaaaaattagtgtaataataagttcaagatcagtgatatatgtttctctcattgcattccatttgtgtagggttagatacactcaggacttctcaagacactgcttgttattttgaatctcttgttacacattcaccctctcatattcatttatgcctattatgtatttattcaacaataaatacagcaccattatatctactttacatttactttataatcaaatctccattacatctctgaatttgatattacaaaatcctcaggctgtttgttcctgctgcctcttcccaaaaggaagcagtaaattttcagctaactattgaagaatgataggacttttctacatttgtaaggaagaagtgagtttattggatggaaggggagatatgtacaaaatcatagaatcacaaagatagtacacgaaatataaccaagaaagagattgtaggagatgggaaaaaataggcaatcaatatcattagttccattattgaacgattgaatctgagatattgaacatccaggcacacttgcttaataggtaagtgggagagtcataaggctgaagttttagaaagaaacatagcttgttatttgaaatcagaatgcaaatcaggttaacagtttgtaaagaggttagagaaaaacgctaacgagaaaatgttatagaacagaaagatgggaggtgcagagagatgaaggactgctgttctctgtgttttgtcccggtaacaaactagctttttcttcttgactgagccactcctttcttaaggcattctctcattcgtatctgatggtagaaatttaaatcgagatacaaatggcatagcggaccacagtgtatgggagcagagactagaaaggcaaggatcaccacaagaggataaaccatcaactgactgatattttgactagttagagtctgttttctccttctgggtaagaagtttcttgaaatgcgtaatcattttcctcacttaccgaactatctatctgttccttcatcaaggattaattgaaatcttaccatagagatttctttatagtgacacatataacagattctaggatgcacgtactaaaaaggcaaactttctgcatccaaagatcttacagttggtgaaacagaaaagcaacacacaccactgtattgcggcatgctgggtgggatgtgtgttgaggaagactttcctgtgccagtgacgtcttatagatagcagatgctaaataactgaaggtggaattaattaaatgtgtcaaagtagacttgaaagaatttaagatggaggtatagctgatggcaaggaaagttggatttgtactacatttggtggcttgcctgatgaagcacgttatgtcttattttcatatgtgtgaatgcaaaatcttcagggagatcacgagattcaacaaaatgattatgttcagggatatttgacctacaaatcaaagcaagttatttagaaaacacactacctttggtactatagtttctttcatatcttcagctctctattcacagtattaaagatttcaatattttgaaaacactgtgtacttcacttaaactagtgctttaaaacaattttactctttggctcaactactctttatatcaaatgtgttaatgagcacacatttataagctcaagtacaaaatgaattaatctgtctttttccagtttcttaaatatttagaggcacctattcaattcatagagacatggtagggaatttgctcttctgataatgcaagctttctaatgtctggatatttacctgctattaggttgttttctcaaattgtcacaagaaattccactaaaggccttggtgtgtgtttgttttttttttttcctaagtggtttatgtgctgacaaaatgcattttttacccttcttcataaatccaaatagataaaatattctttctagatctgttgatatttataaaagctttaaaattttcattcaaacacaatagaaattgtttattggaatagttttcactttagtgggttagttaatgcaagcattcctcagataaaatgaaagtaatattagtcttcatccctcattccccaatgcctgaggtggaataaacctgcctttcctctgagcattaagggatctgcaaaaggtgcgtggagcattttgagtaagagcaagcatactaattaagagcagagaaaaaaatcatcaaacacaccagaccttgggcactgtgattgaatctagcatgcaacttggattctgtgatacttgcattcctctctcataccaaaaatgataactttttcataattaattcatggttatgctctgctctgctgtgttatggtatgctatgctccgttacgttgaggctcaaagtatggaatttagatctatagagtatagtgttggatatatttttaatcaaatactatactcttgtccaccagttgccttgtccacttcgctttttgttgtctctaataaaggtgtcataacatggaaaaacttccctccatatatgtttttctcttatccttgagctttaataaaaatgtcttagagtctatgttcccttgttttttgaggtaatttttgttaaggtgacaaaggcagagtgtagaaaatacactgaactaggttgtaatttttagcctccagctgagaaaccttgaacatctcattttatctttcaaaaactttgttcctcataagtaaaatgggaataagaatgccttgctgtgactcagtaaatcataaatatatgtaatcagattttcttattgcatttattttctagggatgccgtaacaaataatcccaaactggaaagtgtaaaacaacagatgcttattctcttagagtttctggaggctggaaatctgaaatcaaggtgtgggcagggccatgctctcctcaaaaactctagaggagaatccattctctgcttaagtttcatagatcacttgatgactcctgggttttttaaagtgaatagcacagcccactctctgtccattttcactccaaaatgacaatcatgcagatatttacagaactctactgctagatggttacagtgcagaaagagcctgccaagtgatcttctgtattaaaatgttctaattcattttgtgtataattgtaaattgttgggtaaacattcagtttggtgttagtctaggaacttccacaggaatccaccatgatgttgattttttttttccaaagccaaagtggaccttgctccaatattttatggctagatataccacattactaaatattataatatttggtaatgagtcaacactccaaaaaaatggagattattgacatcaggtggcatgacagaaaatctaatgagaaaatggaaagcagtcacaaataagccaacgatctaattaggtggcttagaatatccagttgctcgtggcagatttagtatgttggtacactttcaattaattatgtaggaagttataatggtactgaaggagactggcttcacaaagacttagtttttattaattcattacactgcaactgtttccaacaagactcattatttagagtagaaaggtataaatgaagtgtggatgctataatatttgttcatattcctaaatattggatactactgtacatannnnnnnnnnnnnnnnnnnncacggtgataagaacttaattaaatctcttgtccatacctactaaacacagtggcatttttttctttgttttgaccttcttatcatttttatttcatttgacttaaccaagaaaatttgaaataaatttgcaagtcaaatgtcaggcaacatttctcgcaaggcacaatacctactgatcttctcttcatctatttattttgccataaatatttgcctggcaagtgccttcattaactctgcctcctttttcttcttgtttgcatctaaaaggacaaccaaaagtcatagctcaataattttaaataaataggatctagtccaaagtaacatttctgtatcagggcaacagatgaagtacactaaaacaaatagagaatttgggtttgcctgttttattctatctaaaaaatatgtggaaagaacttgagatatttaaacactaacagtaataataatggccaatcctgttttattaaacatacaaagagaatagagtatttccctttttcatctgcaggggatatgttccaaacccagactggatgcttgaaaccacagataataccaaaccatatacatatatatatatatacacacacacacacacacacacacacacagagtatgtgctgtgttttttcaacctgaaccaaaattattgctaagtgactaaagggcagggagtacatacagcatggatatgccggaaaaagggacgatttacatcccaggtgggactgagagggacagagaaagatttcatcatgctactgagaacagtgcacaatttaaaatttatgaattgtttatttctggcatcttccatttcatagtttcagactatggctgactgtgagtaacggaaaccatggaaaatgaaactgtgataagggaggactactataactgaaagaaataaaagaaaggaaagaggcaaggaaggaaggaaggagggagggagggagggaaggagagaaggaaggaaggagggaaaggaaggaaggaaggaaggaaggaaggaaggaaggaaggaaggaaggaaggaaaataaattcagactgtgggataaattacacagataaaagtgaagagttatccagataggcacagtctatctgtttttttttctttaaacttaaagttctgggatacatgtgaagaacgttcaggtttgttgcatagatatacatgtgccatggtggtttgctgcacccatcaacctgtcttctaggttttaagccctgtgtgcattaggtatttgtcctaacactctctctccccttgccccccaccccctgacaggccctggtgtgtgatgtttccctgcctgtgtccatgtgttctcattgttcaaatcccacttatgagtgagaacatgcggtgtttggttttactgttcctgtgttagtttgctcagaaactcattttttgtgaactcattcttttttatggctgcatagtattccatggagtatatgtgccacactttctttaaatagactttttaatttttcatggactgtaagtgtggggtatgcaaggtagttttcattctgagggatcttctctttgcttgtatgtggctgagcccacatgagctcttctttgtgtgcccacagagagaaacagctagcagaaggtctttagtgtctcttcttataaggacactatttctcttggattagagcctcaccattatgaccttatgtaaccttaattacttctgtagaggccccatctccaaatgcaggcaaactgagggttatagcttcaacagaagaattatttacgtatttagttgataacgaatacttccttgtttgctacaagaaaaatgatatgttatattaatgttgtgtgaaagaatatcccttgatttccaactccaaatgcttcaaggacgaaatatcaataatcaaagaagaaatttctccttgactaactataggagataattgttcaatctgtgtgcccctctctgaatataggactaatatatccaatttcacttcagtaaaatagaattctggtatgcacctctttaacatgatggtattctcaatattttaataaaagttggattttttttcctctctaaagcctctttctatctgaacctaagcgccctcagtttattgctcatgtttcatgatatgagtcatgcccagagaaaggcttggaaaccatcaatatttctcttaaattttcatacacaaacccaggatatatatgctttccaatagcctgaaattgaactctccctctctctgatttattttaaaccacatataactatttacaacaaataacatgaagggaaataaatttaagcccacaaaatatagcttatggttacttattcatttatttattcagcaaatatttgctgaaaactcattatgcatctgcaattggttatttgttactcggaagtttctgagtttatttctgtacctctaatgtctgtcttatctccgttactctatcatttctttgtaatagtgttttgataaaaatataaagatttttgtaacatcatgtaactcatttatctggagatattggggacaatttatgaaagaaattatacagaaagaagtgatatttgagcatcgatataaagaatacatacatcttcacaattcaaattatggctaaggggaggtagagagattatcaagcagaataaagagcaaatatgaaagccctgaggagggaagatgtttgactcagaaaaggccaggatatctggaacatacagagaaagaagagtggcagcacatgaagctggagaacaagacagaggctaaaccatgcagaccttgggggaagaaactcaaatctctaatgtgtaatcaagtgcagaaattctaaatgtactctctctcttccttgtttccctccccctcaagacacacatacacacacatatatatagttatacatgtttatctattatccatttctatttgatataatttttccagaataatgtgtttactcaattttggttttgttcggtaacaggaattcttataagattagagagatggatagataggtagttaggtatgtagacagacagatagatattcattgctgtctcattttctaacttttaaaaatatttcttagttctaatgaatcagttaggtgttcagttccttaaaactgaaaccattccaaatagaagtgggttaaacaatggtaccaatgttatgaggattcctgctctatgccaagtcctgtgctacagactgggagtagaactgtgactaaggcaagtcggcctcaaggggcttatattttaatgaaataaaacatatacattttatttaacagtatctatttttttctaaaacttcacaagcagtaatgcataaacattataaaggattaattgtaagatgactgcctttagcattgtctcataacattcagtaaaaacctaacaaattacttgaaaaacacaattacacaaaactaagaataaaactaaatatttttgttcataatcaatctgttatcataatctgaataaaagttcatacatatttacataactgtactctgctgcctgaaactaagcaagtctacgtacttgaaaagagctcttgttcatttggtctcttctttactatttacttggcacataccttgtatttctcagccaaggagaaggaaactcaattctactaccactttaggaatattgtcattggatgcatgactggtgctcttagcccactttaagtccccatgaagatcttttgtacaaaagtcagtcataaacaactgggtatgaagaataaagcaagctcctgaaaattgagtttttcttttttcttggtatattatttatctgtaaagcattacaaaagaatgaggaaacaggaaaatccctaactgggagaaatgatggggaatatgaatacatttgcttattggtatagactggggattggttcctgtggatatcaaaatccatgggtgcacaaagtctcttacataaaatggcatagtatttacacatactctatgtacatcctaccatatacgtctaaccacctctagattacttataatacctaatgcaatatagttactatatatagatatagttgattgtatttttaatttgcattgttttaattattatattgttattctttatttttttaagtattttctatccactagagaattgcaattgatactgatcggcccatttcttaaattgatcttgtcagcatatccttctatcttttggaaactgttgttttaccctcaacttcaagagatttctttttttaaaataatgtagtatgtaactatggattcagtgatcatttcctctcttttttcatatattttttacttctagaaaaatttctctcttgtatctaacatctcattattaggacacactctctgtttactctgctcaaaaagataaaacaaatgcaataaaaacaataagcggaagctataaggggagagggcaggctaagattcagagacaagaagatgatacacaatgaaaacatgaaagactgaaaagaagattgttgaataacgtatgagtaaaattgaagccaagtttagaggtaatgaacagccaagatactatcacttatatgactgttctttccttttacactattgacagcaaataaaacaaacaaacaaattaaccaaaaaaaaaaaaaaaaactaaagtaaaactaaagtaaaaaaaaaaaagagtgcatgtaaacagacaattaaaaaatcttccaagaaacaccattgatcctcttcccaattgttgaaagtcaaaaggctttttcttttttaaaaaaatcagaaacaaagtaaaggtgcctactataacttcttgtactcaaaattgtattagaagttctcattagtgtactaagattttttttaaaaaatgaaaacaataatacttgaaaaggaatgaataaaatcctttatttgcagagaatgtgtgactatatagaaatacccccaatatgatcagatatatttttctattccctattttactaatttgctctttaaatccttatttcctttcttctgattgccttaggcttattttgctcttctttttatatggctgatggtgaaaaattaggttattgatttgagagctttctgcttttttaatacagatatttaaagctataaatttccctctaaggactcacttagttgcaactcacacattttgattcattgtatctttatttatatttgtttcataatttttttaaatttcccttttgctttcttctttgatctattggctatttaagagtgcattatttaatttctacatgtctatgagtgtcccaaatttcttcctattattagtttcattccactgtggtcagacaacctactttggattagttctatcattctatcatgtattgaggtttgttttatggcctagcatatagttcacagtgcagactgttctaagttcacttaacaagaatatttattatacagttgttgagtgttccacagtgttaggtatagtttgtattgtttttcaagtcttctaccttctaccttgatttctgcctcgttgttttatttattattgaaagtgagatattagagtatgccactattactttttaatttctagatattttatgctcaaaaaatagatattttatgctgaaaaacataattgttttatacaattgctttgtaaaacagttaagacaaaaaaggagaaaaactatgcatttatattgtcttttttaagtagatacttattgtctctgatactctttttatttttaatgtggatttgagtcaccatctggggtcatttgctttcagtctgaagacaacttcctttagtatttcttagtaaacatgcctgctggtgacaaattctctcatttttttgtccatccgagaatatctttatttcatatacatatttattttgaaagatagctctgctgaatatgattgttggttgacaatttttttccttgagcattttgaatatgttatcccacgtccgtctggccttcattgtttctatgaaatttttgctgttaagtgatgagtcaattttctcttgtttttaacatgttctacttggttttggctttccgtgttttcactatgatgtgtctatttatgaatatctttgtgtttgtgttcttggagttccctgagctttctggatgtatagactattttttttaattcaggttttcaatgatattttttctgtttctttctccttctcttcccctagtacactcactgcacatttgttggtgcacttaatggtgttatacatttttttgaggctctgcttatttctctttattctttttttctctctattctttagtttgtgtactctttattgttctatctttgagttcactaatcatttcttttgccaattcaagtctactgtttagtcactctagttaattttttattgtccctctcatgggctttttctttttgccagctgtttttctgctgtgggtcatattttcttcattctttgcatgtctcataatcttctgttggaaactaggcattttagataatatagcaaaactgggaactgtcctctgaaggcttattttatttgcttatttgtttaatgactggctgggttgttttagtgaagtctatttccccctctgtggtattaaacccatgatgtttcacttcagggaatctcaagcatgggtatgtccacagtcactttagaattacaattgtttgggcagggctctccttgattgccttttcccctgaccatgtctagctgttgaattccactaatttccaacaggatttctgtattgtttgtaaggctgccttggaacctaaattactctacagaccagtccattcaaatttgatctcctttgaaagaatagtttcctaggtcagagtttcagattagttctgacccaagtgggctccagaggctctctctttccaagattccctgctttccacccccctgggcaaaatcctgagctattggctctggagctggtgtgaagattatggcatgtttctctgagggacagctaaaccttagggcagagcatatgatgctgggggaaaaaatagcctcaagtctttttggcttgcctctcccagtgtacggtgggctagagaaagggcgattgaggctccatattctcagtggcacagtgcccagctagagcctctctcccatgagtagggaccaggaggaagaaaagagtccctgcctcttgaccatactgacttagaacttagcttgaacagtaagtaactaggaacagaatgagaatgtctgacgtcccacctttcccccagaaaatcgtcctccaactgctcgctgcagggagagggacccctgtgttcttggctaaaccagtttggagtaaagtttctacctcactgagctgagacaaggaaggatgggagtgggttcttgttcatgcaccagagtcttaccattcttaccaagctctagtcgattttcttgaataaatggttctttatttgctgcttgcctccagatccatttccagaatctttaaatgtttttccatttataattttcaccagtttcactggaaagcacatctgtagagctccttttctatcatgctgaaatggaattctctaataagattcgcttttataaataaaaagaaagtcttagaagattgctgaagctaaaatcaatgtataagacaattaaattttatataccagcagcagtgagttgaaaatatatttttaaaaaggtaactaaattttaaacaggtttactatcacaataaactatatacagcagcaaaaataaatctaacaaaagatgtggacatttttataagctaaaaacatttcactgacatatattgaagaacattaagaaataactctcttaatatagaaaactgatgataaagatgtaattatttcaaaattggttaatatttcaatataacttctaccaagtttcttataggaatttttataaaactttataatctgattctatatttttccaagaatagcaaatgaacaataatagccaaaatattcttaaagaacacggtatgagaaaatgctgtaaccaacaccaagatttatgataaagttttcatacataagaaacagggtattcatggagggttagagaatcagattattgaaacagaataaagacctcttaaaagaatgaggatgcataaaaatttcatttgtgagaaatgatctttgatgatcagtaggtaagttataagttactccataattaacattgagaaactcaatttttagtatagaaaacaatcgaattaatacaacaaccaaaaaataattttatataattaagaatttttaaaataagtcttgaaaacactaattataagagattggcaaaataaactatattaaattcaaaaatttaaatgaaatgaaaaggcatcatgagtgttacagcagaaaccacaactttgtagaagatatttacaacatttaagatataaaaaattattccaagaacagtaattagagctttgtgaaactgctaatattctatggtttttgatgtgtaaaataatggcaatttcattcagcctaatgaaagaactcaagtaaattgaaaacaaatacaattaccaatccaaaaatagaaacaaaaacaaaaacaaaaatagatgagtaggtaaaaaaggaattgatgttgcctggaactggcaggtaaaatttagcaagaataactcatagattttctttactcagtcaacagtcttctgcgtgtagaaaggagagcaagataggcaaattccaggattagtaaaaaaatatttatagaagtatgaatttagtgttagacccaccaatgcttttctcagtagtaaagaagatagctttgttctgcagcaagcaatattcctgctgcagtttctaaattattataatagtctgttacaaaaggagaatatggaaagattgtttctcatagaaatgtcaaccacaaaaagacaatagcctcatttcagttttattaattgtcccttgaagaacaaattctatcttttgttttgaactatcatgtataaaaccatccagaaatgttctttgtactaattagctgtactcaaacttgtcacatactttctgaaaatataacacaactatatattctatatctgttttgagataatgttccttgcttttagcttactggtatttccatctaggtcatgacaataaagattactggatcatttggtatataactgcttaactccattagaaatctctttttctcagtatattcaaattactatataatgatgtacaaccagaagaagttcagaaaacaattgttaaatcagagtgctttttctatttgactgcttattagaaaagcattataggcctgtttatatcttaaacaaagcaaaattaaatataactatatatccattttggagaatggctatcaatttttggaaatcctagtatagtgctatatggtacagtagttttccaaaacttatttgaagtcatctgaatgggatatctcacttagttaagtattttggaaaccaataggatactgatgatcagaaattggatggcaatggtttggaatcattactattacatgcaatgattaggtagccctgtgttcgggggtctataattggccaatatttgaaaaaaaaaaaacaaataattattttgcccaaataacactaggcacttagtaaccaaaattgtgtttatttgcttttggctgtaatatcagtgagagttaatcagcatttccattttgagtaaatgtatatctttcagtaatcaacatgagaaagcaggttagcaattattatatacaatgtgactgcaattcatgagatgaggatgaatgacaacaaaatatttcaacttgggggtgaaagtttgagaactgtgtatctaatgtgggaccaatcacttctcactgaccagttttactttgaactgaagtatattcttaagtattgcttaactgttgctccagacaaccagtatatatctccatataattaaccgacacctgcaaaatggatcacatgcttttatgacttctcattttgttcttattatgtaaccactatagatcttctctacagaattttaatgtatgtggcatatctcctccgggtagtaaatagggcttttgctgtatcttaatgtgaatgctctaggccatgaatgaccttctttttaggtacttgtgggaatcaacaaagtgcattgttttgcaactgtgttgtcatacagtctatcttttaatacagagcttctcaaacatgtgtttcaaatatgatgacattttattcaatcaaatttgcttaacctattatcaggctaaataaagaaaataaagcttatatatggtatatggagatgagataatatatgtcttcggaagggacacttaaagattatttttgtaaaagaaatattttgcatttttaaggtgatgacggtaaaactccgttggtccgtcagggggtcccattcattcaacctgttatggttgtcctggtccatgctgattgaaaaagcgcaggccgggcgcagtggctcacgcctgtacccccagcactttgggaggcctaggcgggtggatcacgaggtcagcagatggagaccatcctggctaacacggtgaaactccgtctctactaaaaatacaaaaaattagcccggtgtggtggctggcacctgtagtcccagctgctcgggaggctgaggcaggagaatggcgtgaacccgggaggcgaagcttgcagtgagccgagatagcgccactgcactccagcctgggtgacacagcgagactccgtctcaaaaaaaaaaaaaaaaagtgcggagacgagtcagggaaaaagcctgagcagtcctttgaagtcgggattgtcttgaggtttgcaaagggttcatgaactagaaaaacaagtgttatttggagagtcattttgaaatgatgcaaattattgtaatttttacttttttcagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttaggtacgtatttccttcatagcctaccggtcaccctttttctgattcataaatgactgtaaataaggacagaaaactctgatctacacaggcaagagcattccgttggggaagaggaacttcctttccttctccacattttgagatctctaataagtgaagagaaaaagggttgtgatagtaaatgtccaaatgaagaggactttcagtgcctttttcaattccatcaccaataaagcgatgaacaaggcataatggtggtggcagtggagaagggcttttacgtcgttacaacaccatctagtgcataagaagaactctgggtgtgaggcacaccagttcactgcaacagcaggctctactatgtccacaatagtgtttcattgtagtttgggttgctgagtccatcggatcccaaatttggtgatataaaaagaaagcaaatgagcaaactaaaaataagttttcttcaaaataccattgcatttctctgatattttccttcatataaacatcaatttaaaatgatgattgcaaattaagattctataaccttttaattaaaaaagtccaattataacaatgcgattatacagtaggaaaatagaaaaacatgagagtcgtatcttatactacccttgaggaacaaaacaccataaagacggtatcagttactgtctttcttgttccatctgtctttctcacccagtgtcttggatttaagcatcactttgatgacatattttgctccattagcccacatttgatttggcccatctgactagttgggtatgttttccttgcccttttctcacattcaggtttctcttcccagctagaggcattccagccctcccacaagacaagttgcccatgcaaatttgacattcacttttttataaaagaacataatttaattggagagtgccttgaaaaactgtgaaagcccaaggacctagtttactcctttttttttaatagaagggagctttggaaccaaaggatgttaaaggacttgcttgaaacacatatcaagctagtcatactttcagtgctattttctattttgtgccactcactctaatgatcataaaagcataaaatgtaactttcaccatgaatacatgcatgccaattcttttaacccagctctatcaccatttaataagccaataatctggaacagtatttactcaaaatttaatgttcatccttcagaaagatgtttagcttaattttctagtaaatattattaaaggtgtatgctcatacaattttgtaaaaatacccctctctcctaacatatatagtgtgttgcttgtgaaattatatgcttgtttggctgactgttatttaatatttttcctctagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaaggcaagggcttgctccagttccaaatggtgttgatgtcgatgaatttataaatgtaaggctgcatgaggcagataatgatcccacggccccgccatatgactccattcagatatatggctatgaaggccgagggtcagtggctggctccctcagctccttggagtccaccacatcagactcagaccagaattttgactacctcagtgactggggtccccgctttaagagactgggcgaactctactctgttggtgaaagtgacaaagaaacttgacagtggattataaataaatcactggaactgagcattctgtaatattctagggtcactccccttagatacaaccaatgtggctatttgttttagaggcaagtttagcaccagtcatctataaactcaaccacattttaatgttgaaccaaaaaaagataataaaataaaaaagtatatgttaggaggttataaatcttgtggagtgtgaattaagtatgtggagtgtctagaagtccttggatatttgatatttacctgaccaccacagacaaagattgggatcctggctaatccttagataaatggtttaaatagaggaaaaaatcataattaaaaggtgctttcttagaaaaaaaaatacggacctgcaaggaatctgctgctgatatgtgtcttctgcaaggatttttatgaatgcaaatggttttttccccttcaccaataaggatcccgccacaaatgataaagcaatacttggtctgctgtacattataactttttggagttttgagaggcctcctagattatacagtacggtgaccacacattgtacataattgttggccccactcactagagactgaatagcatctttaaatattgtgtcgagccttaaaatattcacatgttcgtaatccattccagggtggggcttgccaattcagtggtgggaggagagaaatcccattcaaacatgcttgttttctagaagcaggattcctcgttccctcctcttcatcttcttccacaaggacacaaagataaactgtatcacacagtggactacataagagacagatggttttattgctagcgcgtgaatttatttgtttaatcctcgaaataaatattttattgatgtccattaatgcttttatttattaaggtcggtaatctatagattaaggggatatatgggaaaaaactaaattatatccattaataatcctttagattgttttatataaatatatatacaatgaatgtttaatacatgtacattttgatgagatgagtatggcaggcaatattatcgaaaggagagctaatagtctctttagagtagaaagtgttattgtaactggagatggcaggaacagcatcttcccagacaaacttttggactgttttctattttgttcataatcctagtatttggtgtttttactacaagcacaaacatcctaaagtatattgattcctgtgaatatttaaactctagacttttagatacctacatcatgccctgcccaataaacatgcttcaatttacccccacagttttagagcaggaactgatttgtacataatttcactgtttacgtttttagcactcctatccctgatcttcatggtgatgcacagaatgtcttagactccaaaaaggaacagcactagaagatgtgagcatatttaatttgtaatgcaaacctgccatttaggagtagaaaatgtatgataaaactcaagtattacatgcagatcattttaattttctactttgctttaatgcaatattgtttattcactccatgtattgtattcagagaaactcctgtattgtttcctactttgtgaaatatatttttataaatacctttgttgtcattaatttttttttcaatcagtggaagatctattaacagaatcatcaactcaaactaaaattctagaatactcaaccaaatcatcccaagggtcacttttgtttgtaagactctttattatagagaaacagagaagagaaatggcttgccagtgatcacacagcaagataccagcagggacataagaggaacatggaacacctaaaggctagtccagctgtgtcatttgggtccttctggaagcagacgcattgggcagggaaaaccttcagacaagtttgcagacctaaaacttgtaacaatagagggattgggagcaggatttggcaagagagtcttagactgcagtgcggacctggcaaaatctctgccagtctgacagggggttctagagtgaaaacacatccattaaagcagtcaggctgtggtcctctgtcatctcagtcattggtgcggggctgctaagaagagaacggtttttgactcaaaagctgaacgcaccaacttctagaggccaccttcactgtgacagaaactgcatgtttaaatactatact

SEQ ID NO: 13295 - DNA, 34629 bp, Human
tttaaaattattaaataataaatacgtttctcagctagtcaaaagatatgtccaggctcttctcacaagttcaatgttaggtgctgtgggtgcaaacagtaatttagtaattgtcactgttattatagtaatcctaataatcccttattcacataattcttcattttttaaaagtattccatattaattttcttatttgagattctgaatattactctccaagtaatactgccccattttacagataaggcaattcaaaaaacgtttaagtgacttgccctaagtcacaggcactagagaaactattacatgcaagataaacctggtcccttcatttatgacactccattcatagtgggacattcagacgagttgtgggcaactgcaacatggttaagtgttgagctacagcatacaacgtacatggcatggagaacagtcttggcgggagaggggtcagggaagtcttcccaaaagaaacaaagtgtcatttcagacttcattgtgttggccctggggaagaacattcacttctactaaattcacttattctgttctcagaatcttccaagttgattttgtacttgatagagcacaacttagaaggtcaattaactttacctctaggccagtgtttcactcaccgtaatttctctagcaacttcatcagtcacctggggtcttgttaaaaatacagaggagggggcggagggagggcaggggccaccctggacttaactttttctaaatctcttgggggtgaggttggggaaaattgctgctttaagcatgaacactttcgggattttgaagtcaaacagcaaattaaaaggggtatttttggtagtggctcttaaattccagcatcaatacagcctttttttttttttaataggggtgtatttggggggtagggatagcaattttatataactgggattgggtgctataaaacaggctgttagcctccagccctcacctgcaaggtggctggcttaaggtaggtacttgataaatgtggatttatttaacagaggaacacttgtattcataacctccaagagtttcgaaagtctttctgctccaatcttccagtgtctagccagcagcattgctgcagagtggaacagctagggtgcgtggagtttgcagaatgagttcaaacctccagacttatcagttagcagtaagaacaagttccttaatctgcctccacctataaagaaggagtacaattgccacttacctcctagagttgttgagagtcttaaatgagattaaatattataaatagattatcaatggaatatattataaatgcaagtgcttagaactgtaccttataaatgagctccacagatgcttattaaaacccgagcggtgccctctccccttaacatccgtaataggcccccttacacctcatacccattacgagtcaaaataataataataataataaataagtgaacaaacgacaaacgagaaaactaggctaccaggcactggggcgatgggccacagcccggcggggtagtgggcccggaaggggcgcgggagtgggctctccccgccgggctcgcggcacgtggtcggcttgggcgggagcttcgcgacagtgggggaggggagcagcgtgggacgccgaggaggggtccagaccgccaaggctacgaggcgccgactgcgcaggctcggggacaggcgcaaccactgcgcgcagacctgagggggagaacgtccacccggctgcacgctccctggatctacttgcgcagcgaaagcttgtcttcttcctcattttaacactgtgtatggcgccgccttgcgcaggttgttcaccctaacagggcctctaacctcgagcccgaaacggcctccttctccagccgtgccccttcctccccgtggaggccgcagtggatgcgctcacctccctgcggcctcctgaggtggtttggtggccccctcctcgcgagttggtgccgctgcaactccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgagcggccgggccggtgtcggggtgggcgcgcggggccgggcgctgggttccgcggctgccgtcgcgagtgggcgccggggctgaggggtgggaaggaggagggaccgacatttggccgcatcttaacccgttcccggcccggcacagttagaacgagaccctcttcctggcgcagcccccgcggttcctgcgggcgggaatcagggggcccgcccgtcttgtctcctgcctctcccccttcggccgtgcagtccgcagcctcgaaggtggccgccgctggggacggcgccggcctaccccgccttggtggtggcggcggcgaagggggcggcccattctctcccttctcccgcccaccattcgtggcaacgcaggtttggggtgccccgcgtcggcctcctaccccctcgacccgtcccccgcgaggcaaaatttctatcccggccttgactctacacaaagccccgcggccgcgagagctccgcccctcccgtccccttccctcctcctcgcctgctcgcctcccctaccctgcgttcggtctggccggagcgtcttctccttcctcggcttaccctttccccggacccctcctcccggtgggcgctggagagtagttactgagggtgggggctcaggtcgcgtgtggctttatcacacccatgttttgcgtgggctccaaccctctcctttgttcgctgggttctttgagcgcgtctttctcaggattcaaatggaagggcttcacttcctcaataatagttcgggttttccagtttcaggcagaaagacttcgtaggaaataagaggtggtagggagatgtggaactgctactgcttgtgttgtagatcagactccatgggtcctggcttgcctcagagaggtggttaccacccacttctttgttgctctttgttcgatcaggaaatagaccctgctttggggatttagagagcattggtatcttgcaaaggctgttcctaggtggtggggaatcctggtatgggaaaactttgagaagtgggagaagtgcagaagtactaaatattctaatgaggtaaatttgaggtcaccgtgtagtgaattataaaagtcagataatttaattatcttaagcattctataatttggagtatgagcagtaacattaaatcttcgaatcctgtttcctgtgttttcttgctcaatggagtagtaacctgttatacagatttcacaaaggcttggtaaatagtttatagtaggttactcttgagagaagggattccaaaatttaacagagaatctatcctaggctccttctcctgaaagtcctgtctgatttgtaggaagcaatacaaattttggaagctgtttcctacatgtggtgtattgtaaatcacaaaattttagagaagtaagaccccagagcaccagctcagaataaatctactttaacttgtaaatgaccgtactgtctctttttagttaaaaaggattaatcttttaatgactgatacatataaaataaccacctgtgtcatttggggaaaatctgaaatcttacagaacaaatctaaattgatctgcgatagctaggacagaataataacagccctacttttaaaaatgatttttcagaggactagatatgcattatataagttgatttgaaattatgccatcgtggaggggtggagatggaaatacattttaatttcaacatgatttacattgcatattttgggttattcttgccctgcattccctgatcaaattggaaaggaagtaaccctgcgtataagttaatttgtaaaattacattgtttctaaagtttagagatttatccttgtcagggcttggagtaaagaggaaaattttggttagggaaagtggtactgaggtccttctcgaagctgtcagttggtgttggtagtgatgggctctgaggaagtaagctgcttgtaatttgttgtcaccacaatggaaccctagaaccaggagggtacacttgagtagcagtttctgaacagcgctcttgtcctgggcccatttatgataaccttcgttgtgggaatgggagcaggcacgggtacccgggaaaggatgcaagcttgataagtggggtggaaatatttgtcttgtgattgtgacttaatatgatactttattgtagcccattcacctgcttacgtgatggccagcaacaagtgaatagctgatagtttggaaatctctggtgggttattttgtcttttgtctgtgactcgtttgttaaagtggagttcctagttgcttatgtttcacatactcttttaatttttgtgggagggaattaaaatattttgcagagattattaatgtttatattatgctaattattaatatgtgatagtgtgctgacctcatccaaaaacttatatttttattaccagagaacattgttttgtcagcttacaaaagtagcaatactaattctttttttattgtgagaagagaatgcaaggaaaggagcttctgtatcaaagaatcgtgactttaaggtatataacatggattggattgggaatgggttatatctgtagtaatagggtctgaattatctgctagcctaggttagatggttttaacttcttggtaaaggaagtagaaggaagaaagtgagtgaaaaagaaaaggacggaagtagcaaattctataaccataggaatcctacctttaggcttcctggggctgttaggcacacggagcctcttggccacacagaatgtctgccactgaggctgtttgcatcttaatgaaagaacttttaaatatatacatattgttctctgcacgttatgtaatcttcaggtaaccctttaggtcactgaaacgttggtcccaagggaaccttcagacattgatggattaggtatccttaaacctttgaagaaaagtaagagaagttattacttctctgactgtagctattgatccatgcctccaaattcccaaaaacatacttctgaatcatgttccttctttatacactagaagatcatcaagaatctgtaaaatgatacagctaattagatagtcactaagatcccttctgggccttaaaacgatgtgatttttctctacttaaatataattagcagctaagctgtgttaggctctagttataccactcacatttttaatactgtatctagacatgtttatgctttgttttgaattaatcttgaggccaaacatatttagtgcttgtttttatggtgtatacagtataatagggtttatatacctaatttatgtaactatacacaaatttctctgtgctctattttttcctcctctgagagggatgcataatcagttttggagacaagtggtccagaaaaaaacactcaaagactgtatacagataaaactatataaatacaaaagttatcaagattaggccaggtgtggtggctcatgcctataatctcagcactttgggagactgaggcaggcaaatcacctgaggtcgggagtttgagaagagcctggccaacatggcgaaaccccgtctctactaaaaatacaaaaattagccaggcgtggtggcaggcaccagtagtcccagttactcgggaggctgaggcaggagaatggcttgaacccaggaggtgcaggttgcagtgagccaagatagtgccatgggcaacaagagcgaaactccgtctcaaaaaaaaaagttaccaagatgatacctcccaacgtactccttcttcagcaaattatagaaattctacttggcagccaacgattgtcagattttcttagacttgcatttatgagtagtaccaaagtcttttgctgaataacctttaatacaactacatgggttcttagctgtggtataaatctttattatccgtgaaataggtaataatttctttggaggcaaataagtgctaaattaattatagcagcagttcataaataccagtaatactaattgcacaataaaacatgactaaataagactgaaattttcctatacttctctttccccagaaatcttttgcctctcttttctttcaaattttacctcatcagagatgctttctcctattacctaagtccctgttattgccttatttttcttccttttggttgtaccatataacttttgtctctctcctcactataacataagcttcattaggacagtctgtctgttttgcttgtgtttgtatcttcgccaactacatttaaaaacgtagcttttttttttaattagtgatgaataaattattaattccttatactttttttttttttttgagatggaattttgctcttattgcccaggctggagtgcagtggcgtgatcccagctcactgcaacctccactaccctcccgggttcaagtgattctcttgcctcagcctcccaagtagttgagattacaggcacgtgccaccacccctggctaatttttgtattttttagtagagatgggggttttaccatgttggccaggctggtctcgaactcctgacctggggtgatccacccacctcagcctccctaagtgctgggattacaggcgtgagccactgtgcctggccaattccttattcttatagatagaacgctttcatataacgttccctctaattcttgaaactactctgaactacatttaggtaggatgggtggcattttggcatttttggtattgtttagatgaaaacagattcacatttgtttggtgcagtctaccacttttccttttccacactgactgtagttttaatgttcaaggagagttcaacatccggaatctttatttttcttttttccttttcaaagtgtttcctctgctaccaaacaaacaaaactccttaacaaaaactttaaatgcttctgttgacaagtccttaaaggaaaacacttgggattggagaaggcatctcttagggaatgttaataaattcaaacttggaagaattcaaatcaagtctaaggatttttttgtactggttattaagccttattcctctgtatttcagtagcagtctgcttattgttacttgttcattaagccagctttgggttcagacatatcaaataggcttaaagttcctactgtgtgccaaatagacaaaagattgctcaagtcctaagaaggaaataaaagactgcaggtataaagtaagagagggggccgggtgcagtggctcacgcctataatcccagcactttgggaagccgaggcgggcagatcacaaggtcaggagtttgagaccagcctggccaacatggcgaaaccctctctctactaaaaatacaaaaaaaagttagccgggcatggtgacgggtgcctgtaatcccagctacttgggaggctgaggcaggagaatcgcttgaacccgggaggcagagaggttgcagtgagccgagatcatgccattgcactccagcctgggtgggtggcaagagcaagactctgtctcaaaaaaaaaaacaaaaaaagtaaaagagaggggacctttgatagtgtaatcagaaaagggaagacctgaaggaagagaatgggccagccttaaaaagagtttactacataagatattacaaatagcaaagccagatagttattaatagaacttggtgcacttaatgggaaggaagacaaggaaaatgtggagtcccatgttaggcagtaaaaagtgggactgcacaaaactgtgtagtaagaaatttgactttacccagaggtggaaagccattgaaagtttctcaaatagaatgcattctctcaaaataattggtaaggagttgtggaatataggctggaagcaagaattgaacacatattggtccatataaaatgtaatggttgcattttagatagaaatagacatatttaagagagatttgggcctcaaaccaatagaactttttgatggattagaaatggagttggagctgaggaatggtgttagagaatgaaggatgactcctaagtttctggattgagcagttaggtggtatgtggtactactcactaagattgggaatacaaataaagagctctgttttgaacatcttatatttgagatccttattgaattcaagtgaaaagactgagaagagagttaacctctgtgagtttataatccagagaggagagtctagacatagaaatttgggatttctcagcttatatcaggtgaagtattgagactgaaaaagatacagcatagacagacgactggtcccaggacttaactcccgagagaagagaatttagggcagaactattgttcactgatgaacccaaacccttagaacagtacctgcttggcacatggtaggctcttgatttattaaatgaatggctgaactgaaaacccttgatgtttaaaggttggtggaggagtggccttggggtacaagtaaaatcccaagaaaatggtattatggaagccaaggctccgaatgtctcaaggaggaataacctccttgaaatatgtattaaagatgtgttaatatgtataaaaaatggatagtgggctaagtagtctggaagatgaaaataataaacttttttcttttctcttgttttttttttcctgagtctctttttgcagtcaacttatctttgtggctaaaggtacatttcacagttctgaaatccaaaatgacctgaaaattgaaaaaaattttggtaactcatttggaatcaaaatcttaacctgaatcaatgtgaggctatttatgatctttattcctctgtgaataccgtgaatattcacacttttttgctgtagaaatattaatgtttgattatatcatgccacccaaactctaggctattacataatatatggcaggtgtaccatattatctctacaaaatctgaaaaagtgtaaaatttgaaacatatctaatttgaaggaatatggataagagattgtggaccttagtagacacttccattctgttagtttcttgaagagtgagcaatttgtaaaattttgcagataaataattctttacagtaatttctttgcattgacaattaaagtttgttgtgttcaaggaaccaccttgagctgatttttctgaatgtttatttcattggtaaagtatttttatgtacaggttgaatatcctttatctgaattcttgggaccagaagtatttcagatttggggaggttttgcaatatttgtaattatttaccagttagcatccctaattcgaaaatcaaaaatttgacatgctccagttagcatttccttgactattaagttggtgctcaaaacagttcagattttggaacattttggatatcaaatttttggattagggataatctgtattttgatgcaaatcagtaacatttaaaatgcccaaattattaatacattactgaccatttaaatgatgaataaaaattgtaggctcttaaaacttcttagcctttttatactttatgaaaaagtgggctgggcacagtggctcacatctgtaatcccagcactttgggaggctgaggcgggcagatcatctgaggtcaggagtttgagacaagcctggcaaatatggagataccccgtcactactaaaaatacaaaaattagccgggtatggtggtgggcgcttgtaatcccagctacttgggaggctgaggcaggagaattgcttgaaccccagaggtggaggttgcagtgagccaagatcacatcaccgcactccagcctgggtgacaagagcgaaactccatctcaaaaagaaaacaaagtggatgcctacaaagtagccatctagagaattgtgagatacagaattagtgggaaaaagttggagatggttattttataacgcctttatattttagaagaattcttttttttttttttttttgatacagagtctcgctctgtcacccaggctggagtgcagtggcacgatctcggctcactgcaacctccgcctcctgggttcaagtgattctcctgcctcagcctcctgagcagctgggactacaggcgcatgccaccacacctggcttttttttttgtatttttagtagagacggggtttcacaatgtttgtcaggaaggtctcgatctcttgacttcgtgatctgcccgcctcggcctcccgaagtactgggattacgggtgtgagcctccacgcccagctagaagaattcttggtaaaccaaaaaattatctgtagcttggctgccctgtatacatgtatcatttaggttctttgtgtattctttgtgggactggggtccctaaatttcaacagagaaacttgttgaaagctatgcgtattcgtatacgatttgaggaccctattagtaaaaagtaaattactctgatatattaggtacagtttcttgtgttcattttctttaaattaaccaagaccctaagcctttatttaaaatatttatatttcatattatgtctttttttcagccttcaccctgccatttctagtgaatctgtaagtgtccttgacattccctgttgttattacttaagaacattagctgtgagctgccctgccagagtttgaatctagctcctccacttgctggctatgtgacttaggcaataatacctgacttgtctgtttctcatccttcattactattatacaataggaataatgtaataatacccacatcataaggttattgacaagattaaaagatatgtgaagtacttaatagtgccttctagtaagcactcaacaagtgttaattactgctttttttttttttcaaacacacttgctcagaaattgctactgtagtctccaattattggggcctggggcttttcactggattttcagtgtgcatcaaataactagagtatttgatgttatgatgtggtagatgttagagacatttcatttgggtaattgttacacagaggcagatagatggaagttattgtttagtttgtgtcttttctgttttaggtgatattggaaattattatgggcagggtcatcccacgaaacctcatagaatctgcatttctagtgaagactagactttcattatttttactttaatgatttctttagtagtgataactaagaaatgccttcccttgtattaatttaattacatgatgctttgtaataacactagtgggttttccatatctaagaaatgatgagaccaggctgctttcaaggaactatatatcccttgtattgtcaccatgtaaggtagagctttatggtagattctttcttaataggtagtttattttctgcaatcatagcctcttaattataattgcagaggaatgttgcaaagggccatggccctgctttgctaaactctatattgtttcttagccttgttggcacctgcattaaaaaggtggctttccctttaaaagactttgtatatgaattgttttcagaagagagctgtgctgaaaatgaagttaactaaaattagaggtgtgataccaacaaaatcaagtatttatgttattagaagcatggattttgtaaaagctgattgtttatcctgtactgttatcaaatatgtaggagagaggacaaaaaagtttttggggttgtttccattaaacaaacaaaaggtgtatttagggaggactttgaaagatttagtggataaatcgcattttttattctagcttttattgtaatatataaacccgtgttgaaatgatagacttcaaaccattaaaatagcttgactgtcctgaccctgtggggaattagttccaagacttccacagatagcaaaattcatgggtgtttaagttccttcaataaactggtatagtatttgcatataacctatgtatatctccccttacactttaagtcatctctagattactcataatacctaatacaatgcaaatgcagtgtaaatagttgttacactgtatgatttaggggaagattacaaggaaaaaaagtctctacgtgtttccagcagacaccaccatctattttttaaaaatattttcagtctgcagttgattgaatccacagatacagagggttgactttatatatttgagaggcttcttgttatttactattataggaaacactggagctttacctaaaagtattaattttattgaaatttagttgatgaaaatctgtgattttgttattttctcttttttaaatcttatgcataagtttaaagacattgtgatataagatgccgtttaaaaagacaggctaggaattacaactttttagtcatgaagaatgagacagtatttttattaccttgaaaaatgtaatgctgtgtcttagtggagcaaaacctcatttaggacctaaatttcagttaccaaaacttccctgatgggctttaatatggacacggtatgttttaacatgcaaaacgccaattatgagatttctgaaatgccagcaaatcatccaaaaagcagtatttgctgaaaaaattttaaatcataccaataaaactcagagaacttaaaagcatgtgaatttgccagagaatacagaaagcaggcatcatttcaaggaacagaaattttaaaaattgggggtagctaaaaatcagaaaagcttgctttccttaatctacaaataaatataatgtgtaataatggagtcttcagctggtaaaagtgtgcgtagcgtcttagtcatctgatacagtttgaaagttgcaaaataaatctaagttgctaaggttttaaataaattttgttaagtagtaaatgccttctaatgatagacatacataaattcaaatagttcatggagggtctcttgtctgtattgtttagtttgtgtcttttctattttaggtgatattggaaattattattatggacagggtcatcccatgaagcctcatagaatccgcatgacccataacttgctgttaaattatggcttatacagaaaaatggaaatatatgtgagtattccttttaatacatattcagcactgatcttttttatttttttttagctactgtgaaactttgtctattattccccttttgagggcatttagcagatgaaaagatctggaagaaaacaaacttcttttttcgtttattcttaggagatgaataagaatgagagctataccctctttttccttttcctttaaccatttaaaaaagttccccctaccctaggctttcatggttctggagaacaactcagtatagcaacaactcagtgtagcatattaagtatttttttttttttttttttttttacaataattgttaatctgcctgtgctgctgaaaagagttgacctgggactgttacaaaataataacacataaaattaatcccacaaatatttgcagggcatataatacatatggaatactgtgttagtgtggccaagcatagtacagataacacaagtgcaacagctgccttaatgtttttgtagataaagatgaggatatgtataaacaaatacagacacgacaattagctatttggggagaaaagaaatatttaaaacaattaatgctaggcaatatatgtgaatatgtgaattattttcagttacatgtagacatttagagaagaggggaagttagaataagactcagtctggaagtcttgtggaagaattgtgtcatacgtgaaattgagctcttcggaacaaggaagattaggatagaaaaaaggacgagaggtcgtgaacaaagatttagaattgaaaactcttgtagtgagtgatttcattgatgaaatcactggatgttttatcatggaaaaggagagaaagtagagtttatgaacatatggatttgactttttactcgaactgtttccactaaaataaggagtgattaaatcatagttgatatgcctgtgtaatgcttttaaaggagtttgaattagttttgagattgattactgttttctaaaacacatataagtttgggttagttttggaatttatatattttgttctggtagacttggttcttttgaggggaccgataggggaatttgtatatttgtttgataatactgatataaccggttgtaattccacagttctgacatttatttctcttcacagaggccccataaagccactgccgaagaaatgacaaaatatcacagtgatgagtatatcaaatttctacggtcaataagaccagataacatgtctgagtatagtaagcagatgcagagatgtacgtttctaagtaaaaagtagttttgcattgataaatgtaaattagtatttttaggagcttagaatgatctaaatctgaatatttttcctgttggtctaatatgttacagttatttactgatttgaaaagtcattttaacactactaaagctacttaagaaaaaagtaaacctatctgaagcttattggtttgcaaaactgctgtttgggtattcttctactcctagtttgctcccctgataactttgggttaatacatattggtagggagacctcactcccttactccctcgcttcaaaaaaacaaaaacaagattacactttgattagccttagcttggcatgtacatatctcttgtcttgtctttgtgtacttcagttaacctggactataatacacatctctttttctttgttaagatattagtgaagcttttgattctacgtaatgttctcttgtacaggttaaaagtattttatttttagagattagtaacaaattggcttgaaggtagaatgcaaaagtcaacctaaaattattggaacagtatcttttaaagcttgataccaaagttcattctcattagtgtttgtattgactgacttcagtgatgattatactaaattagtgtaggtgctagacatctcatatttacaacctcatacacatttctgccatatcttgtttgatttgttataatgctacaatgtaactagaacatgtagtatttaattttttttttttcaatgaagattccaacttagatgcaaaagaggcatgagtagcccttgggcaaacaacataacaggattgatttaaaacccacataataatgagttctattaagcttatgatcctggccaggtgtggtggctcacgcctgtaatcccagcactttgggaggcggaggtgagtggattacctgaggtcaggagttcgaaaccagcctggccaacatggcaaaaccctgtctctattaaaaaagtacagaaaattagctgggtttggtggtgcgcgcctgtaatcccactactctgtaggctgagacaggagaattgcttgcttgagccccagaggtggaggttgcagtgagccaagctcacgccattgcactccagcctgggcgacagagtgagactctgtctccaaaaaaaaaaaaagattatgatctctctgtgcagtaagaaactaaaattcatttcttatagtgcttgtgacttaagggtatacaaagatattaatatacaaaacaaggacccttattcttgaagaggttacaattcaagggcatagggaaagactaagaaagggttacatacatctgccatatcctttcattctctcagtgctaaggaactaaatgtgtgatcgtttatctgtaaatgttttccttgttgtctttagtatcctatgttttggctcccatgaacctagttaattcttagcaactttcaagatcaagattagccatgggaataggcaaccagctgttacatctttttggtttagtaacttactgacatgcatttcaaagttacagatattataggtatttaaggagtttcaaagaaagtaaattataaagcaattgaagttgcttttagaatgttaacttattgtaatattaaggggaaaggcctagaaaatttaagcctgtgttttaattaaataagaattgttgtacttagacaactattgagttcttgttaatagacagaaatattccacagataatcctgataagatttgatgatctttcacagataacactttaattaccttggataaaacaataaatatattttaaagttggaaactttatattatactgtgaagtgtatgtttgatgattgcatcaagcaaaaaagtatttgtgggaaatagtttttgtaagaaaaggctttcattaatttgcagaatgtgttgaaattaatgaaatccatcttccacagttaatgttggagaagattgtccagtgtttgatggactctttgagttttgtcagctctcaactggcggttcagttggtaagtgctaatgcaatcagatttaaaagttgatctgaacttggtgtgttatctttcgggttatttgtgtaaaacagaagttttaatgattgtgaattttgataacaaaaggaaatcagtatgtttatagtaaagtacaatttactttcaaacctctatgttttatgattatgacttaaacgctttttaaacttattttcacttggagacttcattcattccctttgtcttctaggtatcattgttactaccactttccacataaaccattatttaatctcaggttgcagctctaggagaatatttttctaaggagtaactcctatttgtgttatagatgatttctgttaactttcatgattttaagctcttgcttatgcatggcatacacttgtagtgtttttgtctcattctactacttttttatgataaatgtttaaaaggtctatcttgtttctacttcttagctggagctgtgaagttaaaccgacaacagactgatatggctgttaattgggctggaggattacatcatgctaagaaatcagaagcatcaggattctgttacgttaatgatattgtgcttgccatccttgaattactaaagtatgttaatttatattgatactcttttcagtgataaagtgttttcattaaaacacaataaataaagtctatggctttaaaaaatattaggtaaaccataggttgaaatagttaatggtgaattttctatgaattcattacaaaacaatgaagaaatgcaggaaatttgcccaattcttcaattattaagacttagaagtgtggccaggcactatggcccaggcctgtaatccctccactttgggaggctgaggtgggcggatctcttgagcccaggagtttgagaccaggctaggcaacatggcaaaaccccatctctacagaaaaaaaattagccagatgtggtggcatgcatctgtagtcccaactacccaggaggctgaggtgggagtacctgagcccaggaagttgagtctgcaggaagccatgttcctgccactacactctagcctgggcaacagtgtgagaccctgccttaaaaaaagaattagaagtgtataaaaggccagtgccgtggctcatgcctgtaatcccagcactttgggaggacgaggtgggtggattatgaggtcaggggtttgagaccagcctgaccaacatggtgaaaccccatcctactaaaaatagaaaaattagccgggcgtggtggcgtgcgcctgtaatcccagctactcaggaggctgaggtgggagaattgcttgaacctgggaggtggaggttgcagtgagccgagatggcaccactgcagtccagcctgggctacagagtgagactccatctcaaaaaaaaaaaagaattagaagtgtatataaatgtcaaaactcccattaaatacccttttttaaaagtagtttggcaattttcattttagttagtttcaactagtaaaaaatgacaatgaccttggaagtttatattctagtattttggatgttttaaactgaagacaaaaatttgaagccagtgttaaaggaaatttttttacctattgagttagtctaactgcctaacttccatatctgaatgaggctttgttctctactgatggatataaaattatctctgagttgttgaaggagttatttttccttatctgtggctgcagtttgagagagagatctatagaggtacttaggaatttggatgttcgcaatgttagttattttttgccatcagttatgacacatcttagcagattctactttgtattatactgagctagtgttttttgcttgtagttattccatgcatgctatccatagaggctgacttttcagtcaacttaaaattgatactgactcctcaaataaacagtgattgagcagtatcagtgtaacatcttgcctgctcatcaggagcaaaggaaaatcatttgcaatcatttgccttgttttttaattgactgttgatgttggttccagtgtcttcaactctttgagcaagttcttgcccactcagctaatagttttaaacaactttaatttgtctggacacatttttttgggtggtgtaatcaaacatgatttaattaattgacttggtgcacagctttccttgcttatctaacacgtgagccgctcagaaactttattttgatcacagcctcatttctgtttttttaattttgtgaagaaattttgctgtactatggtatgctgtttatagtgttatgagaatattcttatgagtgcttagtctggaaatatcaatttacattgtattgttttatttagcacagttatggcaccattatataataaatacaatgctttgccatctaataatatctcacttcactatacttcaaaaggatgacatgagaagtccattttccccttattttgacatgagtatacactggtaacaaaatgtcatgacatggtgattcatgtgactcctaaactgcgtttgagttacaactgtgtcactaatctgtggtgctccaagcaccagtttgaagtcatgagagtaccacatgtagcctctgtcacagctaatcgattctgcagttcaaatgaagccataggtaataaacaattgagcatggctgtctttcagtaaaactttttttatggacactgaaatttgaattttgtataattatcacacgtcagaaaatactcttgttttggttttgtttttaaaccatttaaaaaataataaaaacttcttagttcaaagctgaaaaaagaggcaattggccaaatttgggccatgggccatagttagccaatccctattttatactattgaagatttactacagaggtgttttaattaacaatcttgagtatggtataatcttcagtttttaatatattagaaatacgtgctatgtttttgaagcatgtagaatagaacagatttcacaaagagtaaatatatattttttaacctacattgggccacaagtgggtatttaaaggcctgaggctcaaacctcagatatttgaataacctcttaggctgaatgtaaaaggtgattaaacattctggaatgcaagagctcaaaaatgggtttcctgaatttgtggtgcttcttcccatcttagaacctttaaaggaaaaaccaaaacttatggatttgttttcaggtatcatcagagagtcttatatattgatatagatattcatcatggtgatggtgttgaagaagctttttatacaacagatcgtgtaatgacggtatcattccataaatatggggaatactttcctggcacaggagacttgagggtaagactaaattctgtctgaaaaaatattgtgagatgaacctaggagatcagtaatcctatacttgaagtagtatttttctcctgagttaataatttgaaacttgtatgcagaattgaattactacgtatgcagtaacatttgctagaattcactgttgctgactataagcaaaaatttagtgaaaacttaaggacagtttttttctcagctgttttctttggttgaataaatgtttttgaatatccacaaagcatgaagcccttctcttgatgttcagtttgaatcttcaaaactacctgatggtagcctacgttgctattgattgtaaagaatggtggaataaaatagactaggtctttttaggttcttctgctcctctcttttgtgattggtcttgatttttagtagatctaattttaatctttttttttctttaagcttctaaaattggtaatgtatttaggtagagaaaggataccatagtgtaaccttgcctgcctgttaacattaagtgtatttctattttatttgttatctttttccatttgatgctcttgtcttttatgactctgaaaaccactggtcaaatcctatttctataagttcattgaaggttttttgcctcactacactttttttgaacctaactatacaaatgtcgaaatttattcaataatttaaacagctgtttttagttcagcctggattatatgggagatttatatggcattgaacaaagttttaaactattttattaagattatttttcacatctgtggtatatcattacagtttagcaaccaaagtttaaagagttgccataaagtattcttaagctgtatggcttttctttattagatcacagtgtgatactttctcagtaaactctttgagtaaaagagttaccttactgaaacttttccatacttacaaatgggtgggaggtcaaatgtttggtttgagtttaaattatttagcttttaaaattgcagatttgtaatttcaattccttgccagtaaactccttcaatttctccctttccccacctggtcttatcttacagaccagtgcttctcaaacagtggcgcctaaactgaggaaagcagatcagcatcacctgggaacttgttagaaatacacattcttagggcccagaaactctgggtgattcttcaccttaaagtttgagaaccactgctgtaaactgatagaatacatttgtcaacaaccattacatcctagtggaagtcaagcaaaagtcttctctgttttaagcttaaagaataagacagtatctttgcagtgtgatcctagtttatctcagaagtggaaaatggaagcttcatttaatttctgacaggtggatgtcactatggtctcatctcagttattattcaaaattcttacagtttgaagtttttgaaaatattagagaatgctgttttagaaggatttgagaatggctttcaacatctctttttctcacttaagattttacaatcgctgggccgggcgcggtgtctcacgcctgtaatcccagcactttgggaggccgaggtgggaggatcacgaggtcaggagatcgagaccatcctggctaacacagtgacaccccgtctccactaaaaatacaaaaaattagccgggcgtggtggtgggcgcttgtagtcccagctactggggaggctgaggcaggagaatggcgtgaacccgggaggcggagcttgctgtgagccgagatcgctccactgcactccagcctgggcgacacagcaagactcagccaaaaaaaaaaaaaaaaagattttacagttgctgatgttttcaggataacatttgaatattttaagcatgtccccataacttcgtaagagaattaaaatcagtcattacattatatgtacagctgtttttggactttctgtgtaattcacgtgtatctttggatgttaatttaataaacactcctttttctgcctgctaattcattctcatgctgaaaagaaggctactctgagtttagctcattgttgaaactgtttgctttaattcaagtagtctagtggaagaaagaaaggtggcatagtagcagttgcagaatgaaacctggaagagagaaagctatgtctaacaagggcagcagctctgagttgccagctagttagtagcagttaggatgagaagtgctgaccaacttttctgtattctgaaatcttagggtcaaaatatatttcatctgtgttttaactgtgcagtaggactgtaaagttttcacaatactttggcttttccatatttgtatggtttgtatttagttaatcttaataaaaatttagacttcaagaaaaattgggagaggaggtgtgtaattttgcttgctttctcctcgttggatgttgggtctcataactctaatattgagggtaaattttgcttttgtaaaattggactgaagctaagatcattccatgagaggttcagaagaacttgcacaagtgctagtaatcctgaaaattcatggatcttcagacattatcattcaacgcacataagaattaggcaccccccccccaccccactcaggcgcagtggctcatgcctgtaatcccagcactttgggaggctgaggcgagtggattacctgaggtcgagagttcgagaccagcctgaccaatatggtgaaaccccgtctctacttaaaatgcaaaaaaaattagctgggtgtggtggcgtgcacctgtagtcccagcaactcaggaggccgagacaggagaattgtttgaacctaggaggctgtcttggctcactggagtgcagtgagccgagatcatgccactgcactccatcctgggcgacagagcaggacttgatctcaaaaaacaaaaaaaaacaacaaagaggcacaccccaatcctttggtattgcagttaaaatactattttgtagtaatgtctgtactatacagtatcttctaggaatacgtatacacacacagaaatgcatatgcacacctacaaatgcataacatatacaaataagtaagtatatataatatatgtatatatcatttaagagtatatgtagctggaacctttgcgtcttttgagagagattaatgcctggagtggtactcattcaacaagtaggaacaaaatttgtttgaagtccaagtccaattaagaacaaatctgaggctgggcaccatagctcacgcctgtaatcccagcaccttggggggccgaggtgggtggatcacctaggttgggagtttgagaccagcctgttgaacatggaggaaaccctgtctctactaaagatacaaaattagcctggcatggtggcacatgcctgtaatcccagccactcggtaggctgaggcaggagaattgcttgaacctgggaggcggaggttgcagtgagctgagatcacgccattgcgcctccagcctgggcaacgagcaaaactctgtctcaaaaaaaaaaaaagaacaaatctggtgctttagtcggtagctgttaaatcttcgagaaagtgtgggtcgttctttcatcataagtaaactcataccaacagattgtgaaccacaagaaggattctgcagatgattgtccggcagggctttttggcttaatttattttccacaggtttactcataaagttgccttgtcatcttaaatattctatttatgatggattttctggtttaatgtaatgtaatttcattgcctttaacttcttgtgttaaatttcttttctgtcaaaaataatcactacagattaattgaaaatggttcttgtatgctttacaagcagtctataaatattggagcatatacttatttgttgtttattatttcctttctcagtttgattgttccggtctcaacttctaagatgaattcaaaattggatccttaatacttagtctttcagtcttttcaaaatgtagtaaacaaatgccaaactttttattatagaatattctctaagatcagtttaattatgtattttaggatattggtgctggaaaaggcaaatactatgctgtcaattttccaatgagagatggtatagatgatgagtcatatgggcagatatttaagcctgtaagtattattgttttcacaattggaatggaatttcagaatgttattggagatgctaacatttgttatcttgtgtgtagattatctcaaaggtgatggagatgtatcaacctagtgctgtggtattacagtgtggtgcagactcattatctggtgatagactgggttgtttcaatctaacagtcaaaggtaagcaattcaaagggtggtatttccagaaaaaaatggtttttcttccacccaagaactccccgtaaaagttctcattgtagtttcttgcctgctgttttaacactgtactctgcatttttcatggggttttgtctgttgtatgtatgactagagttattcttgtttcattatggcagatttatatatacatttatacaagactagttttttaaggtttattgtagtttgaacccaaggcagctatttttgaatggttgttgactcagtgtaaataaaacatgcatacttttttacttaattggattatttatttctcattaaggaagaagagggtttagctctcctcaccattttgcccacaacatacttgtacccttcccatacctctatttttacaaatcagaatttgattgtgatacttagtgtttacggcagcatctttaaacacttttcagcttatccagttgttctttgctgcataattgttcctaagtttctcatttgcttagttttctctccacttattgctgaactactggtgtctcagtatcttcatgtgttcagattcattgaatattctgtcactttcaccttcttgaaaaacagccttctcatctgttcatgtttggatgactatctttggtagacctggcaggacacatagctgttctctgctttttttctgttgtattggttctccctggtggctctgttctctgtccttaatttttttctcatgttttggtggagtgccttctgaagtagcttcctgataaaaagtgtgtgggggattaggagtgctgcagtacatactaaattttgatcatgtgttgaaatcagcatatgattgaaggctaggccaaagcaaaatatcaccattctggaatgaacttctagggtgtaagaataaatctgaaattttatttaataagatattataatgtatatgtagattagaaatgatttttatcatgagtgtttgtgtatgattttagaggtttttttccacgtgaacttttaggtagcaagttgacagtgtgctttgtattctctaagatgtggagaattctcaaatagaactttctccagaacaattgctggtcttaatggaattggataactaaatacagatattaaaagcttctttatttaatgttatgattgctactataccagctatattagaattatggtataatctgttattctatgttaagtggaatgatattaaattaattgtccctttgtaggtcaacagtggttgaaccgcagtttcatattgtaacttaatgtgttaataaccatcttttgcctcaaaatgtttataaactttctaaaatgatctacctaatgtactcttaaaagtgtatattaactatcagttttcctctttgacttgaaagtccttaatgtttttgtacttaatattttttataatcataaactgcagcagttcactcttagaaaaaaatttactttgtatttcagctaatagagtttcagttgcataaagcgtgtaaggatatttgtaattccaagtcttaaacttcattctgagtttctctgctgccagctttgattcagctttttcagatctgctgaagttagttatctcttttccatctccttgctgccatcagctatgttcttcctcttgtattgtctcccattcttcatttttacaaattttggcctttaaaaaaatccctttcgagtcatttttgtcaagttttgggatgaaggaaaagtaaacatctttgtttagccagctatctttacttggaagcctgtaagttaacttttagtatgtttgttttttctttaaaaatatccaaatggtttttatctgttaaaagaaacttttctagtagcaataataaaaattgagtgctagaattatgtaaatcacatgttgcaactattgaagaatgcttaatgaaaattcccacagtatacagttacatgaagagaacagataaactttgtaaaattaactctgaaatggaaggaaatatagaaaaacgatttttgaataatgtcatttttaggtggttagttttttcattgtccctttttaattttttcccaaatactcttcagtatgcacaaatgtcttttgtaattgaaggattttcttttcttctttaaagattgagttatgtgcctaactggtaatattccgagaagggaacttactggaaacttataaatgtttattgaattatgacatttatccacataaaatatttacttttatgttaggtttactattaatattaaatttctacacgtagaagttgaagtttttgaaaattaatagatgtttttaactcttaagttaggaaaactactcagtaccactacctaaagttaactcagggttaaactatgttgtttagctttccataattattttacacatgtccatagggaaagaaaagtcaataaaaattaatttagatgatacataatgttttattgtaacatgatgaatttcaccatgtaaccctacatgaacatctttctgtgttaataaaataggtgtatattcatattataatcttaatatagttgtgtacttgacttttccatcagggacacctgctaaaatagctagttatatcttaattttttaatatgtattattgtataacgtgtttggaaaggagttttagacttgacattttttacatttttatttgtttttaaaatatttagaaaacccattttggttgagtaacatttgcacttattatctttttaaaatttatttttcgaactgttgcagtatgcagattttgttgttacccaaatcttcttgtcttaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatggtaagtgttctcattacaatatctttattgtatgaactgtcaatacagatgctcctctaattatgttgcaattaggtcctgataaacccatcataagttgaaagtatgataagtagaaaatggatataatacacttaacctaccaaacatgacttagcccagcctactttaaacgtgctcagaacagttaggttaggcttcagttggacaaaataatctaatactgagcctgttttataaaaataaaacgttgaatatttcatgtaatgtactgaatacaagacattgaagttggtacaaaaaagccagaaaactgtaagtcaagccattgaaagtcagagactgtctgtatatagaaatagatggatgaatgattagagtaagtgccattctttataaataggagaacattcactttgtgttcacttttaaacattttcttaggaaatatttcaccacctaaatctggattctgtgcatggttttttgtgaaaactgagcttgtaatatgtaactttattttattgttttcattagagttgccatataatgattactttgagtattttggaccagacttcaaactgcatattagtccttcaaacatgacaaaccagaacactccagaatatatggaaaagataaagtaagaaatcattgaattgttttgataaacattttatcttgacaaagatttagtatgctttaaagggccaagtatgatgggtctttttaactttattagatattttgtttttttctaaaggatttgaaacattaagttactgattattcttttttttttttttaatttttaatttttttgtcaggatgggatattgcttggttgcccaggctggtctcgaactcctggcttcaagtgatcctgtcacctctgcctctcagaagtgctgagcttacaggcatgagccaccgtattcagccatttaatttcttcagttaatggaaataattttttttattagttgaaatgtattttaaaattgcaaggtgcactataagttattttcattgtctggaacattttgttaaggctttgtctccacaagcaaagtagagacattatagtacatagcatgggtttgagtcacctctgtaccacaaacaagctgtatgatgtttgataagttcacttgcctttgtgcttatgttttctcatcattgaaatggcaggctaaaataatgcctccttggccagtcaaggtggcttatgcttgtaatcctaatgctttggaagtccgaggtgggaggatagctttagaccagtagtttgtgaccagcctgggccatatagtgagaccttgtctgcaaaaaatttaaaaattagccgggcatggtggcatacacttgtagtcctaacgcgcagaggctgaggcaggaggattgccaggagttcgaggctgcagtgagctatgatcttgccactgcactctagtctgggcaacaaagagagaccttttaatatataggtttagctagaccaaagatgaaattttttgctaaatattttctcttgcatgtaagaactgcaaagaaatttaattttgtctaataaactttgcatgtgtaatttagacagcgtttgtttgaaaatttgcgcatgttacctcatgcacctggtgtccagatgcaagctattccagaagatgctgttcatgaagacagtggagatgaagatggagaagatccagacaagagaatttctagtaagataatgcctttatttttccaatttgtcaaaatgataattgaaatggaaggttttagtggcctaagaacttcactataaagtcatgttcacgagcacactgttaatattgtcatttttgccactttcagagatttagcttcctgatgtctcagaacctgatttgggtgtcagcagtttcagtttgtatggctggatatacatatatgattgaaagttttcaaaaattagcaactttagtatatttggaaattaataagacatctcatttatctaaagtagggtgaactaaataactaaacatctgtttgattttacaacttctcattacacttaatgtgatggttagattgtagcataacagtatgtgtaatggtatagactgtctaacatatttggtattggtactttttttttggtctacttcacctctcagctctgaaataaaatgctactttttaagtaatgacattattcccatcccctattagaaaaacacacttttttcctttagagtttcagcatttttaaagaaaaagagattcccccaatttttattatgtgtttttgagccatttcttcatacatgaaagcaaagttttcaatattaaataaaccattcattccattcaaattttaaaatcattaggcatgttaccctttacgtttaaatgtggtaactaactgcttagtgcatttgtatgagtatgctgtaatgattataaaacctgtgactgtttttgtcaaaatttattaaaatattctgtgcagttcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacaggtcagatttgtttcttggtaattgtgttttaattgtaaattttaaaaattgggctgcattataatgtttatgctatcgagaagtcagttgcacaggtatcaggaggaagtatgctaggtaggtgactcttttttcttacatataagtggtacttagctcttaaagcttttatataaatgttattgttcctatttgctttagtaatacaggaaaccttattttcttgataacataggtttaaaatagtgaacattgcattgtgatatagattggttaagaaagaggacaaagtaattatgaatctattggtagtgcatggtcagaactgaacttctaaggtaatttttagctacctaaagcttatttaatgggagaaaacacaaagaagagttacatatccttagaccagttttgccattttgaaaaaggtcaaataatggattttgttcagaaattgaagaaaacattaaaaactctgaggaaagctaggaggggatttgggacctgggttagggaggaaaaaatactttgatacattgccttactttaaaacgctgtgttagctttaggcaattgaatttgctaccggaatctgttacctttcatctgacttcccagaacacttacacatgcctctgccattttatttaacacatcatattatagcacctcacaggattttgtctccctactagactgagctgctcatggctagggaacacagtatcttaaatatttgtattctcagcacttgatgcatttcctaatgcaagtaatggtgatgagcacacgttttagttaacctgttaattttgatcctgtagtatgtgaaaaactgatttagagataatgatccaatttttcctatgtctatcaaattgaagttatgtgaataagccagctttttttttttttttttaaactagagagttagtaatctataacatctgacacatttagttctgttcttttacttgtggattcactcctcaataggctacatacagaaatttataattttaacttcccaatgtattacaatgatggcttcagtctatatttgtaactgattgacatccaaaaattcaagccatgactgaattaaggacgacttaactttagctgtaggattttcctaactttttttcttttctttcattttcactatgttttcttgtctgtctgtttttggtgttctcatttttaaaagctttatcttttctgtgcttaaaaaataaactctctatttggtgatgaggctctttcgatagggccttgcagttgttaaaattcttcagcctactgaaaaatgaaatactaccacagaaagctttttttaaatctataggtcaaaacctagagttagggccaccttttctccctctgcaccccaatccagtgactattcatagcttgtactgccatcgtttaggaaacacccaacacaaagcttatttagaccgaattcattaataataagattgcataactttttatattttaaaaataaagtatattttgaaataatatatatacattttatatttcaaaataggttttaatcttttcccaatctttatttttagacgttaaggaagaagataaatccaaggacaacagtggtgaaaaaacagataccaaagggtaaatgatgttccttatcaagtactttttacatactataaaaatactaaacatgtttattggtgtgtgtttgtgtacacacttcagaaatactagactgaaccttagaacatcattatgaggtgctctgaattttagtttgtattggtacataagacaacatatgccatcttacctattggtttatcagtataactatatcagtcagtttgtattcttgtacgtagtttatctgagacccttttttgctgttatcttttatatatgcacttaatggttttcatggtgttcttatttctgtgtacatgatttttttagtgttgtgagataggtaaatttaagaaacaattttaagtaaaaacagttgaggattttagtgtcagaaagcatgtaaatgtttgggcacacataattttgtgccagcctttacaggataacttggaatagtttattaaatcactagaaaaattaaggcattaattactccagaaacacttaagacattatcaattaatgtgtttcttagcatgagcctacaggacctgatcaatataataggtcagtgcatttaaaccaagattgtgccatttttaatatttcacattgcctcttttaacagaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttggattatcttttgtctgtttattactacaatatgaagtcttgtttcagtggctaatgacatcatttctgtagacttacaatacactctaggtgaaagataatgattacagcttgaaagataactatttgctgtttctttgggaagagtatttatagtaattattacttatctttgcaatagaaattctaccaccttgccctctatagcttagccagttagtatcagtgaagattaacatcccattacaatttatgaaataatacagactctgcaattgagatgtaggagttctttgagttgacccaaagattctcaaaattgaaatggaaattctgaattgaaagaagaaactgaccagaacttgtattgaccagacttgcctatagtatattgctggtttaaaatggaacctgcagacaaaacctgtttcttttactgcatttacatggcatccaggttccattattatttacgtgacatccaggtttctaactcaaggaaataaacacaactgatttatcattcagcaactacttattgtgtgtctgcccattttaagactgtaggagtgtaactgaatataatggaaaaatgctttcactcagagcttacactcagagcttacattctagtagcaggaagcagacaaatgggggtaactcctgctactaagatgtgcaaagaagacaaaacattttaggaacttgccaaaatcagtgaaatctccctttttgtcaggcccacattgattcttttgagattaaaaattacagaatgccagaagataattcagtcaaaagtatttctcttcagtgcagtaaaatattaaaagaaaaaatatttctctacaagcctcttaaatgtttcagacattcacaatagcacctagacttttgtaatgaacagctgtgcacccaccccgacttaacaaatattttacttttgctatatttgcttcggtgtttttttcttaaaatacaccgaaattgaagctctctttgtgtactttgtcgtttgtaatcctccctccctcccagccttaagaagtaatcaccattgtgattattttatccatgtttttgtgaatattttacccatgtttttgtacttttgctacatatttgttatcaatctgtaaacctttatgacattaggaactaagaaacttagtcccttcgttagggggataatgaaatgtatttagtgtttgtgaaacatagatggtatgtatttggacaattctgtaactttgctttttttatttttatttttccatagcttattggggaacaggtggtgtttggttacatgattaagttctttagtggtgatttgtgggattttggtggacccatcacccaagcagtgtacactgcaccctatttgtaatcttttatccctcgcccccctcccaccatgcctcccgtctaccatgatgatcctgttttaaataagaaaataccatttcgcaggctccagatgttctggcatcctccctgtggatttcccagtgcctgcagctcacaggacaacaggggctgtggtagagtcacctatgagatcctggagtagtggatggaggagatggaacagtgaagacggaaactgagctcagtatccgggtgccaggagacaaaggccctttgctttttttcatttaatattctgatctacccctgttgacacatgttaagtatagttcattttgactgctatgtattatgttccattgtgtgaacatactgaaattgtacacttcaatactatactggatctccttgggtgtatttaagaggttttgtttttctaagtagttggttatatacaactaaaacctcaagagaactatctaaagcaatttcagcaaggtgatttggtacagcattaataaacagaaatcagtaacacttagtgaccaagtctgttggaagaacaaagacccccatttgtaataacaaaatttttagaaataatatgtaaagaagctatggttcttgtgtctagtaaggtcaatgtaacatagtaagatgtcagaataccctaatactttaaaaaattcatataggataaaaatgatatttgaaattggcaaggaaagacattattttgtaagtggaattgggacaacaactggtaaccaaatggaaaacccagttttctgccctccactagaagatttaaataggaaaagataaaactaccaaaaacctaaactcttaaagcaaatggatt

SEQ ID NO: 13296 - DNA, 105168 bp, Human
  misc_feature (1)...(105168): n = A,T,C or G
attttgtctgctgtattaagtgtattttctctaaaacccaaagcaggatcaagctgtaaacaagacgctttactttggtgattctcattgtttgtataaataggggatttgttttaaattaagcaaagctacatttttgttccagaaagttcaattgataacaaatacccagacaaactctgcaaatatttactcttaccttttaccttactgacatttagttgaattttacaaatagataaagcttaataagcatgtagtaggctgatagttggcaatagactgtggtgaggaatagtctattggttattcaaccaaatccttgattcactaactgaaggaaacttactgcaaacaaaacatcagaaaatgttctatttctataattttagcagaatgactctggttctgctgctttgcatcaaaacaaaattttatagtaactgaaaattccctatttctctaagaccaaatggaagtagctcctttacctggctggtgctatccagttttcaaagagtaaagcttaagggctaggattttatctccagttcagctctacccaagtaataaataagtagaacattaagccattctgacagctgtgtacttactttgtgtgaaggttataggatgtaacaagccttgctcttggatccctcatgagcaattatcttttcgaggagtcccactgtccttgggtggttcctggtgtccagagccacacataggaggggcacagtgggagaaaaggaggctcttggctctgctctctcctccctctcatcttctgccctcccctctgctatgtggggaacatgaagatgaagggcctcctgagtgagtccggctgtggaagagggtgagcatgattgcctcctgcctgggcggtggtggtagagaagaggtgccctcaggatgggttctcctagggaaggggctgtgtctgtcccacccaccacttccccagcactcagcactgtgcctggcacctaaatgcccagtaactccttattaagcatacagtgattgggcgtcagggcacatataatgcacggtggagtttcttcccttacctctactagttatttccttgaaacacacacatttgagcatcaaaccaaatcccaagaccacacacctggggaaatctcttgatttactctacagaagggctctctttgtcttggaagcctcaacccagttaaaacatcacttgtgcatgagaaagaaaacacaggaattcttttggacacaaagcaataatatctttctaataagagcagctacttaaatctgtttgtcccatcttcccattggctaacatttaagcacatcaccttggctaactgtgccctgcatgaattggctcctgattttcttgccctccagttccttgaacaaaccaggccctttgctgtctgctgggcttctgcctaggatgcgcttctacagctcttcaggagcctccatcttcccgatcctgtaaagatacacttaagtggtccttcttcaccaggctttccttgccctctctagcattccctctgtcccactgttttaaacctaggcattttgcgttttcctatgtgtttgctttcttgcttattagctatctgctcaacttaattgaatgattcacaagagcaagactgttttgtgattttttttttcagcatctagcccagtgccaggctctgtgtaagtgctcagtaaatatttgtttgaatgaatgaatgagtctcaacctacccttcatttaaaaagtggttcaatttaaatttttttaaaatctcagattctcaacatacagtgcacatatacacaatgcatgtgtggtttatgctgtaaaaattccctgctcttggtaatgaactgccttaaagaacagggttggtgacttagtgcctatggcctagctactaatgtttgcgattttttattcctaaacatctaatgtgttttttccacctttttcttccctttgtctttcttttttagcaagggaagccatatgtcttcgacagagtgctacctcccaacacgacccaagagcaggtttacaatgcatgtgcgaagcaaattgtcaaaggtaagtgctatttctttatttcctcctgggccattcagagtaattgaaagcattaagtgatatttgcagcctaggaatcaatgtgccttgactgtaagcagaggcctgctaattggaaacactgaattctatagcctcggttctagccctgatttgctatgttgtcaggcaaattatttaatctctctattctcccttttcaaggacatgtctttatttcttttgccaccttttttattttgtcacccaaaagcttaaaagcaaggtaagctgtgttcacactatttctgtaataattttaaaacactgggctgcaggtatggaacctcctttttcctttgaaggagaaaatatatattcctgatgctccagttgtacatctttggttgatttattctgtgtgtctgtctcccttttactaatatctctcagcaagaagccttaaatatggaaaatttttgccatttagaaattttctacagtgtcataaaatcacattaccgtgttggttattgagctggtcttgccattcagcattccttaattatgctttctcctaacccattttcaaccatcccacccagatcctgacatttattcctccaaacaggtagcctcaagcctacatttacatcttagagatcagtccttttctctaggactggcattggccctggaggattcatgtcaaaatagcagcagggagatgaagcaatttgcacattgctctaccttgtcctttcaaatcaggggcaggttgaagcttgcattggcaggcttgccatctggacagagctggggggcatctcctgctactttgcttttcatcatcaaatcatttccttcaaatgtgaatgctgtggcaattgtgctttcaaatgtcttgatgctgccccctgtataggcagctctggatttaataagcaagaagtaaaaacaaaactaaaaaaacctaccatgtcactttggatctgcttgtttttagaagctgactaacctaagtatttgaaattcatgaaaatcagctctgggtacatctgttcgtttaattctgaccctggacacctgtgtgggagatgcatgtcagcatgtaatgttccttgctgaggtggatggttattcacattcttgctgcagacatcaattaattttgaaggtcttcacagtgagatttttatagaaacccaatgagaaaaaaaatatgactgaattcgagctctttctgaattaatagtatggacctatatcgggtggtaatttttatcttctctctgcttttactcttctgcttctctttctatctaaacatgttttctctgtttttgcagtatatctttcttggtttgctcctactcagccctgctccctattattcgactcattcatatattttttattaaagtaagattaatcacatatgtgccaaaatttctttttctctcccccttcattatcacaaacaaatagtatttaccacatgctgtgctaaacatgagggccatttaaatacatcctgtcctctctaagctgacataattagaaatggatgcactctgttaaaaaaaaatcctgtgattaacaacctgtagtaatactctttgagtctttattcactaaagaagtttgggcctctttcaatgttcggatttctctacagtatgaaatgtcagaaatgggcaggtcttgtgaagatatggcctaactctggataacttgagacccaatatgtagtgagctataaagaaaaccatctagcagaataaaatcaggcgctgacatgatatgactaacagacatttctagggtaccataaatatgtatgatcatacatacatgccttattctcccttaaaaaggaattgatgaaggtctgattggatttcacaaatatccactgaggctagtgtgagaagtggccatgtatttcagaatcagtaagctaaaacatagaggtacaagaaagaactccttggaacagatgatcaagtatagctgaggtatctcttgccatgagtaaccctatttaaatcaagattgggaggcggtgctgtggagccctttttttctagaggctaataattaaatcagatgatttccgaagagcaccatagtccccgtgattcctgataatgggtggaccaaggagcattcctttcaagtccatctaaactcttaatgatttggagcatctgggaggctccatttaactcgatggctttattctctctctggtttttcattccctaccacttcactgggttaaaaaaaatatattttaaatgtttgtttgtggagtcctggcatctctcatgctcccatctttgtctggtgtttgtttttcaaaattttgcttgaaaaagcatgtagaattctcctccatttcttctcaaagaggttgtagggtttctgactaccagcacagtaaatgggaaggctcctttggacgcctaggaattaaacaccatggtaactggatgctattattgaagtactgtaactatgtcccagcctacagaagccacaccaatcatttgccttccaaattaactagatacagatgatccagatgctagagaaggggaaatttcttgttttccagttctgattcctttaaaattcattcattcagttgtttcttttaatcattcatttctgtaagtagtaataagtacttaccgtggggtaagcagtgctgggactggagtcgccatgctatgtaagactgtctgcaaggagctttgagtacagggaaagagacagatgtgtacataatcatcacacacataggcattatgtactttagaaagggtgtatgcaaaatgccacgggaacacagaagaatgtcacttgtattgattttgattgggagagggagtggagaattaaagaaggtttctctgaaaggttgggtcctgaggactatagaatataggagggttgtacaagcagaggggatttcaaaagtaaaagcataaacacacaaattctgcttggacaacttggagcggcacagggtgcagagtggcattatgggagatgaggctgggacatttaggctggagcaatttgatggcaatggatggactttatcctgcagacaatgtggacccaatgaagagtgttaagcttaggatgacattatcagatctgttttgttattatcttatatatgactctgaagaaaaaaaatatttttagctgtgacttatcaggcactgtctatatacttgacatatgttgttgcattttaaatcataacaactttctgaagggtgagcattattttcctcattgtacagaagaggaatttgaggctcagagaagtgaagtaacttggccaggttggttcgggggccatggactgggactcaagcctgggcttgtcagactgactgactgatattcttctgtactcccctgcccccctttcctggtgggcacacagctagcatttgatgacaattattttatgagtggtccctgttctgtcaggccatatggactattatctaagcattgcaaaagacagggctaggaatggtgtgggaggagggtagagaagaggggacagggatggtggctcctacaccttgtgatggccctggtggcctgccagtgatgaggtgcgtttccattctgaagatgcagcatgcccttgcctgggcacagggactgccctttaggctggccagccggcatgcgggctggcctcaggtagtcagcaggaccgcctcatcatcctctgattatggcctacctgagtggtttggtgactggtgaggatggcctgtcagccaccatcaccagaaaccctacaggcccccatttcccctggagagtcggtaggaagccccatgcctccgtaggactactgatgggtaggtatgatcacatcctcccccaattctaatctgaagatggcactaactcttttgctttagcaagacctggattcagaactgagcaaatgggaggcaaggagcattttaagtatctactgctatccttcctcctcccctgggagatgagaaggctctgggcacctgcagtggaagctccttctggggttcatgcggctgcgggatggaagagtgctgtggccccggggtgcggcgggctatgctgtaccagtggaggtcacatcacaccaggcactaacacaaagaaactttctgtctgcggagcgtggctggcatgtggaaacattgtttctgcagagactctaaaacaaatgcattccgtgggcccaggagcgggcactggacgtgatgaaagtgccttttgtgggcgcttctgtgggagtcggatggaggttggcgtggcccccgcagtgcggagcgcggcctggcctttcctgctacggctccccctctgcctgtggtcgcggtggccatagaaacgcgctgggctcctgctccacttcctctctctgccttccctcaccagcaaatcaaaacatagactgagcaaacaaacaacaaacagaaaagaagcccccaaaacctggagtttcgaagaaaatagagaacactggcttcaaagggccttttcgtttaaattaccttctagtgcagcagggagccgatagagggcgacgtcggctcccttcgaccttgatcgctggagagaggttctgcagcagtgaatgaactgtaacgtgattgtaaatactttcagtactttcagggccgtgattgtaaatactttcagggccgagtggagtttgttctggtggggttttatgtgttctccttttcttacaaaaaaagaaggagaaaaaaaatagtgttcagtgacgaaatggcagcaagaaacagattctccaagtacagtcttgcacgctcctcagctccttagtccaaaacaagtgaagccacggacgagctctggttttcaggtgcttgacccagtccttactggcaggagtttcatgagcagcgatggagtaagagttagtgggattgtgccttctgtttagtgatggacccagaggcgtggatgagacccgggaggcctcgggtgtggcctaattcaggaggaagttgagctctgagctgtttccttgggtgtggccggttgctcagtaccacctccctggggcctcctgcgtgggaacatcggcccttgcagggtggctagcagaggtcaggatggctggacccctggccctggcaacttcggtgctgttctaacacctaggccggtgggttccagagtgtttcatacacagaggcttaagacaaggaaagccctttcagggtgtgtgtgtgtgtgtgtgtgtgtgtataggggggatggttaatttctaataaatggtaatttcgaataaatggaaactgtgatattgtgatgtagccagcattccaataggctggagttttttgtgttatgaatatggcatttttaaagtttgacctaagggtgggacctttttcctttgggtccctcaaagcatatcatattcatgttagtgtagaggtgctctgtctgctctggcctaaggaatcttttcttggagtaagttggcatttttgtggaaactgaagcttgaacctccaaaccttacactgactacttcaagtttttgcttcccactgttagcaggggagccattagccgaaatctgatatgtatgaacattctctctccctcctcttgctccccctcctctctctccctgtccctcctctcccaccaacccccaatatagcttgatacaaactcttgagggctgctagaattaaaaaaaaatcctgccacttaatttttcttttcttaccttcctaaaataacatattgcttttttgttcttatcccagttcacacttcaacaacctcagatcagtcaaatgtttattaaaatttttttaaaaaacataacaaatcagaattgatatagaaaaaaaattcaaaaaagcaaacctatcaaagcaaaacaaaaacaaaccagcatcataaaattcagagaaccccctctaccatgctcccaaaagaaaaactctatttagagcctgaagtagatggagctgattgcctggcttggttttttacatgaccctgaataggacacctcagtgtggggtccttctccctgcctctacagcttgtgcaaatgaagacttcctccccttattcggaatggaggatcaaggatattaatgatgcattgttcctcttccagtgatatttgtgaggatgaaggaggaaagcaggagagaaatgagtgctaaatatattttaatcacctctgctgctttgaaagaattcccacagataatcttcagctcttcagcaaaaagcagcctccaccctcgagcctccccttgtccctgtgtgatgtggcaccgacctgcagtgtggaggggtttgcacagtgctctcattgtgtaattaaaagaaatttcctgatgctgatgggcctgggctggcttgttagcactatcagtgcaaacacagagacattaaatttaagtgagggcccggctagtttctgggctgattggattgtcatcctgaggctctgtttatagagtggggcccttttcctcccccacctctggactcaaggagctcttgtggggctttcaggagaaacctccccaaggagctagcctgggccagcgtttaaactgacccagattaaatcttcaggaaagaaattctgttcttcatctcactccagaaacagggcataagaataatgttttctttttcccccaactgatctcaagagatcaacttatagaagaaaactcaaatatccttctactaaaaaaaagttttctgctcgatgtctctatcttccttttgatgtcattgggagaaagtgtgtctgcctccttcttcattaatgtattctgtgaaatgtgagtccatttctttccatttgtagaacaacagaattttctacttaaaattcacatggagttgaaatatatcatttgtatgaaaaatgagatgggccatttggaaaatgtaattttaaaatatgcaacctacaccagcatatgatcaaagtaatgagttaattttaatttctttttcttgttcacagatgtccttgaaggttataacgggacgatttttgcgtatgggcagacttcatcaggaaaaacccacaccatggaggtaagattacaatgtgctctaatgcgaatctctgagatgactgaatggaactgacgtttccagcaaaacttgaggtgcatgtggctttctttactgggaaatagagacggttatgtttggccaattaattatgtctttgagaagttttaaaatagcagcaaaaaataaagtctcaggaattcagtattttaaaaagtactttattgataactttgtgacagtaacaatacattctattcagaaacaatcattgattagctaagcagtagtgtgaacatcattctggacttcagcctcattctaactgggaaagcctgttgggaaaatcatttaccctgatgaaggcccccggggaggttcgtctcttagaataaataaaaaactgtaggtcagagatttttaaaagttggcttgtgggccacgttcagcccacagacatatttttgtttggactgcacggtatttttttttttaatagtaagcaatgttaaaaattggatgatttcacacaattcaaattttccatcttaggttgaatattctgaagatctggcagcactgggtgaatttcaccataatataaaattcaagcttcactgttcacttcattgtcctgttcacctttttgttaacatttctagtgcagggaacagctgctgtcacctaggagaagtttggtaaaatatttgttagtatttgtgaaaatggtacctgtggtactggctctggccaccccacgtacatggggctggactctccattgtactcacacccagcccacttcatgcacactggggtgaagacgaacttatatttggcatccttccttattgacttacatacctgctccctgaaggcacttcagggtatgaccccagctccagttgttggctgtggaattttgtggcttcagtctgttttccaaacaaggcaggtctgcagacaaaattgaacctctttgcctcctcttttccttttttttttttctttaaatcaccaaatcctatagggccttcagagcctgataattcttctaaaggtgaggcccacttgataggtaaggagaggtggtaagcgtggttattataagaaactgcacagaggaagtttggggaattcagcagcagggtaagatgaatccttaatccttccagcttagtgtttttcatttacgatgccctcctgggaatagcactgagacggctgctgcagaatcggtttagcttatgaatcattcctattgaagaggagatttcaaaggcacgaggctaaaatcctcagggctctgatgttctgctcatactgatttcaagtgtggggtacagtgccggggatctcatttctgcggtgttgactctctttcacctgttttgctgaagacaaagtggttcagagactgcacagattaaaggaagcatgaggtttatttatcacttctttctgactaagcaggtctttcccctgacacctgagtggcatcagcccatcttctcctcctctcacactctactgcagaacgtcttggaaacgccaccctgctatcctcacgctcctgtcccggcccctcgcctttccctctcttactaggcccccgactcttgaccttgagactatagaaaagttgcagttctacatttcctgtgtcccacctagtccagtacctgtagacaaaaactccctcctaggtcagatgacacttgaaagagagatacggtgtctagtgaggaattcaatcagtctagaggtttttttgtttgtttgttttgttttattaccaaactatatataatgccaaacaacaacaacaacaacaacaaaaacaaaagcaacctgcattatttaaaatcccccaaaatctcttggaatgcttacaatagtgaccttttaagctttgggattagaaaatataaggtacttgctaaatgccagaaatttaagctgtaagacatcaagagagagaatgctccccagtgtaaaatcttatttccggagaagagatggatgtagggtgatggcaaagagctatgcccgccctttaaaactaatatgggaggccaggcgtggtggcttacacctgtaatcccagcacataggtcaggagttcgagaccagcctggctaacatggcgaaaccccatctctactaaaaatacaaaaaaattagccaggcgtggtggcgcacatttgtagtctcagctacccaggaggctgatgcaggagaattgtttgaactgtggaggcgaaggttgcagtgagccaagattacaccactgcgctccagcctgggtgacagaacaagactccgtctcaaaaaaaatagtaataataaataataaaattaaaaaccaaaaccaaaaacaaaaactaatagaagagatattttgctagaggctctcaagccctctgtgtcttacagtgtaaacttcacaatgcctgaccagtgaggactcatgggggacctgaaaggaactgggttctggacaggtttcacctccggttgcctcttcatctttgtcagttttaaaaggtcagttgtaatgagttgctttcctttattgtgacttttgcagatcacatacttgtgcctacagttagaaatagttgatgtggatgggagttttttcctagtgccacccaccccctcacttaatcgagttctttctgtagggtaattatagattggagaaaaggtaggggatattttcagaggaagacagagggaaggaggagccctaagctgaagtcatagatactgcgagagaccaagaaatccaggatcctggaatgcaattaagtcaaaaaagccctacagggtctgcattctctgaaaggaggattttatgtattcaaattacacattgtgatcttccaaaggctttcggaaggggatgttaactccctgagtgtccctgagtggaaagagaggtcacattttaaagatgtttttcactttaatccccctatttttggtctgacatccagtggtgattccattaccttgtattgaggggaacaaacagacaagcctacataaaattggaaatattagcttctcaagatggagcatttaaggtaggttttcagtaaatatatgactcactggacagtgttaatgctaagctcggtggacaccaccacacagaaggtcctgggcttgtgcagcccatacccagggttggcgctggggaggacacagggggttccagctccagctgaggaaaaagagactgttcttttgttactgtgagtgatgctgggaagggnnnnnnnnnnnnnnnnnnnnttgtgtgttgctttcaatacttctggaagtcttcattaggagttgctgtcagatcctaaggcatcttttctaaaatcttcaggggtggcaaattctggaccttaaaaatggatttggtaatatccaaatagcagaagaatttacctatccctatccccacccacttaggtgaaatgagtaaagtagaaaagcggggaaagaagaatataagacgatcttaaacatggatttaggtattagaaacagctaaaaattatttggaacaatttggcctgggaaccacagatttttaaaagaagttgatgaaatgtattttcttgattgatctgttaaatgatactgaaagtgttgccagaataaggttcttagaaattttggaaaattttggaaatcagttctagaggtgatttcattaaacaagattgccttacttggaactccaggctcaggtcagtttgtaaatactcaaaacccaaacccatatattctcgttccttctcctgctcccttttcctcctcctcctcaccccacactagccacatagactctgattttgtttccttgagtggcagctggaggcaataatgtggggcctcagaacttggcagaacaagtgctcccctgctggataaacaggccaacacaatgagtttttccaccaacttctggtctgttggcaagtcaggtagatgcccaagggagctggcaggcacacgtgggtgcttcctgctccaccgggttctgtctgaggaacccagagatggttctccctctctctcatgtgtctcccagcatgctttaactgcccgtgtttgtattttcgcccactaggggaagctgcatgacccccagctcatggggatcatcccacgaattgcccatgatatctttgaccatatctactccatggatgagaacctggagtttcacataaaggtacgtattactgattggtccccagagaagacactgggccccagataacgtttcttatacctcctcctttcaagaagatataaaagatgatcctactaatttaaatgacattcttgtggtaagcagagccctctttattagtgacctaggctaacaggtgtctggagggtttgcttgaaatatccacataatgaaagcaaaagccttctttaggaggaaatcatcttgattgttgcccaaattctaccctttatcctctggatttctgtgggtatgactgaaatgtgtttgtgtttgggttagggcagcattttccaaagtgtgttctgtggaacacagtcccttgtgttattaatggtgggctagcagggaaaagggctgtaaggccaaatgagctgggaaaatgctttcttgaacagtgttaagtttatcacaggtttcaatatgctctgcaaaggggacatgcattagattacatttcccagcttatttgaatgtagacacatttctcctcctaagagtatcacagacttgtgttttgagcagagtgtcacagagcagaactctgagaaatgttgggaagaggaattctcttcctttttatcttcccccttgtattttgtttttgttttaaaccaaaacttgttatatgacttaaattggcattaaaagagagatttctactctcttactgtagctgttaaataatcaaatttgatagtagggtatattcattggaacacctcttttgcaagtggctgaaaggcacttgtttaagcaaatagaggatattgtttataagatacagaatctgacagtgggcattttgtggaggatgaagtgtggagggcaggaaatctaagccctgtttttctttttaaactttttaaacaattgagatattgttcacataccgcaaaattcatccttttaaagtgtatagtttgatggtttttaatatattcccaaaagtgtacaatgatgatccttatcctaattcttgagcatatcgtcacctccaaaagaaaccccaaacctgttacagtccctgcttttctgcccccttgcttgacttctttctcttgttctggagcatctttctctctttttggtgggagaaggggttggcaacatggcagctgctgctccaccattcccttatttccaactctaaattcccttgggcagggactcattggcccagcctacataggtgccccccttgcccgatgagctgtgtccaggatgcacatgctgtctgggggcccccactgtggctggggagggtgaaggggcagttctaagaagcctcgctaagcagatctgctaagagatttcccttcaggctgggatcttagtgcaccaggcccatctgttcagagatgaggaaacggaagtttaaagatgcagggttaggctgggcacagtggctcagacctgtaatcccagcactttgggaggttgaggcgggcagattgcctgaggtcaggagttcacgaccagcctggccaacatggtgaaaccctgtctcaactaaaaaaaaaaaatacaaaaaaagtagccaggcatggtggtgtgtgcctataatcccagctactcaggaggctgaggcacgagaatcacttgaacctgggaggcagaggttgcagtgagctgagatcactccaccacactctagcctgggcgacagagagagattctgtcttaaaaaaaaaaaaaaaaaagacgcagagttacaaggcccaacttaaacaccaagttattgataaaactaagaatagaccctaggtctgaccaaccgcacatgcgataccttttcaattatattaaacttctccccttactactgtatacctttcgtaaatgacataaaaagaaggcaccaactgtttgcccaactataaattacatctagcaaatcacttttccttaggattccttttgttggctaaagcctgcttctccttcttgccaaggttctttatatctaaggatacagaagcttgttgctttgatgggatcaagatttagaagcttagtgcttctttagggctgtttgcatttaaatagcttaaactactgcagggttcttatgtgataatcctggaataagatgttaaaccaattactgccctcaaaatagggtcttgtgttagaatcttattaagataaaaacagccctagcatgaagttaggggaggagaggaacaacactcttaagtctctagggctgaattttacagtctggatttctgtgttgcatttgtacttatgcttacttgttttataaataataagtgggcaaattagttgctgactactttgtattctgaaccggatagtgagaggctaaatcaagaaaaagaggactgactaaggcaatatcgaaaatctgctccttaaatgagtcccacagaggttttaaactttatttctgaacgtcctatttcttaatgccaaacaatgcctatttatttttcttccgcctagtctcacaaagtattttaaatgacaaaacaacaaaatcaccaccctcgcacacacaccaaaagcagaaattaatgaaatcagaatcctgtttctacttacattaaatgtgaatatgattctaattgccagatttgccagtatctagtttgtgacttttttttagatgtaattaattttctctgtaatctatggaaataaggccatatgtttaagatctcaaaaataatagacaagtcttaatgaacatcagacaattctgaaataaatagaatgcgctgaaccagggtggagttggctgcaggaaggactgggttagagatgtccaggattggaggtcagacagacccataaggatgtggggagtgtggcagcatgaaagattagagaaagctgtaggcgtgagtctttcaaatgtcacataagtgtgtccatgagagatgggcctcagggacagggaagtctgacaggtgttcaagtaggcagatgttgctagggatacaggcagccaggagagatgcccagcagtggattccagggctcaagctaggaccccacatctcagagtagctgggatggttccagtcaggtagttccagaccgaggcacattaaggataatggatcagggctgagtcagagctgggaccagtgctgggttagagtctttgcttccccttgactggtccagagctgggatgtagggatgaggttttacctgagtagtcacatcccagctttacaactttacaactgttttcctttctgcccactcccttgtttagatttcaaaagcacttatgaacatagggcagataagtttattgggtaggcagacagcagatgtaaacagagtacagaatcctagagggggatttttgacatcgtaaagccctatggctttcatgtgacagatggtacaattgaggcctagggtcttggttatgtgtgaattgagtccctaagaccacatatttagttaaagcaggtctcagacatcagccagcataagaatcgcctgggcaactgagaaccagattcctagttccttttatctgggattcggattcagcaggactgtagtagggttcagggttctgcagttcaaacaggttcttaggtgatgctgatgaaggtggtgctgtggctgagccttgagactaatgggaaggcctccttttcttctcacagtctaaccatcttttatcaagtcccattttgttcagatctttcctggatgcaccagagctggccaccattaccagctcttgctcagttacctttctgagctcttgtagttctaaacacactgcccttgccctctcctggcttcttgcatgtgaacatttgggctaagtctccttcatgatactgtcagtatcatgcaataaggtgaggcctactgagtgttttctaagcgtgcttggtgctcatctaacttaaagcctagagtcctcctgtaagtgtctagcacatgatgttaagaacacttgaatgacaaccaaagggagctgtgatgtgtgtaggtggagagtggtccacacttagggaagcgtagagcaagcgggaagtaggggaatcccagtagagctggccagattttaagtcttcactttgaacccctcttcttactcttcttagccatgcatgatgaaagctttcataagtactaataatggcatttttgaaatacactgcggcatgtctattccaagctcaatttgtttttaactaggtttcctattttgagatctacttggacaaaataagggacttacttgatggtaagtaacctcagtgcttgtcctttatttgttctgtaacgaaagtccggggaggttgaaatggtttatcacacttctgcttaaggaattaatgaaaatttatagagatactctgttgccttcagggtatatgtttattctcagccaaggcttaaacttgcatattgcaaagagattagatttgactgtctttgtaacaaacttccatttttcctccaatatagagtctttaacttttattttcttctttgcctgctgtcattctcatctttttagtatccaagaccaacttggctgttcatgaagataaaaacagagtcccgtatgtaaaggtatgaggaagatttgattggtgatgcaattaatttctctccagtctctgtcataataattattacataagatgtgcagaatattatctgtaaagagcatataggcatttattcaggctccttatatttaatattcatctggttttaaaaattgacatttactttcttcaattgtatctttcctttatgacattattatttaatattgttcacatttaaagagattttgatattgagtgcaactgtttttactttgcagtaacgcctattatagcattatctgtggaacatcaaagtagctaatattggtggccatgatcataaataaataaagatagaaggcaaagcaaaacttcatccatttcttcttctctcattgattttcttctttgattttctgtcttcttaaagtgttgctgttcagtatgaatatgtactcaaaaacctaggaaaatttgacagttctttttttggtttacgtctatatttcctagggcttgctcagacttctctttaatgtagaattcaagccctgggcaaggaggaaaagttgttggatcgatatttcagcctttctatttatctgcacctctagaagataaacaggaaaatgtttcagcctttcaaaatattgttgcttttcaactctttcagtggtgaacctgaactgattctcttccaggggtgcactgagcggtttgtgtcgagccctgaggaagtcatggatgtaatagatgaaggcaaagcaaaccgacacgtggctgtgacaagtaagcatggtgggggtgtttcctcccctgcagcttgggagacagatatctgcccaccaaccgaggggggtggggaattaggtacaaatgaaagaatgcatgggaaggtgattaaagagcagtgctcggacacagacgccagggtatgtgtgctatgagtatgtctaggcagtcatgggaaagggtgccttctgctgtccacaggactctgaggtcttggagatattgggtgagacttactggaccctgataacagcctaagcctgaacattaggaaaaataaacaaccagccaaccaaagggagggaaagagtaagctcatcagtttatttattttgatcatgttattgttcaggttaaaaaaaagttccaaaccaacaaattctataatatgttgcagtcacacacatggaaataaaccatgttggatttctgccttctgtaaaaaagaaaaagaaagggaagaaggaagtcagaaagcagagccaggagctttagggaaagccttccgatatgttactagcagacacattcagatcggctcattggctctgcagttccttcctcagtatgttcattgcatctcagggaagcagtgcatatgggatttgggcagcagaggatccgtgaaaaaagacagttgtctatcttattaagagggatgtggacaaatgacagtgagttcatatgaacagaagctgagagaactaagggtttatagcttgcatgagggaaaaaaatctggaggagggtgtgtggacaatgtaatatatcttaccgtgttgaaggtgctgacactaagaaagagggtcagcttgttctgttccatctcaatacttagaatacccatgattgttggagctctagggaggcagatttcgacccctgtgaggagaactctccaacccttatagctgccccaagtgctgcctgctacctagagaggtagtgagttcactgttatgttgtaaaagagattcaggcattggtttcctgactggtctaggctctttaagtctcttctacccaagactctctgattctgtggtccagaactgtaattctcaacattttctctatctgagcaatgtatcagatgatatacatgtatatagcaactttcataggtgagcctattcctggatgaaatgttggtcaagctccacttctttttctcttgcttaaaacatgcacacatacctgaaagaatgtaagacagatattcttatagtagtagcatctctcatttacgttattcactctgtttctgaagctgtttttaatcacaaattatttatggcatacctgataatccattttgatgccttggtttggaactgctaatctaaaaaaaaattgctattattcttatcattctggtaaggtttttctttattattgcaataaaatatacttaatatgaaatttgccatcttaaccattttaaagtgtgcatttatgtgatgttaagtaccttcacaatgtgtgcaatgtcaccaccttccatctctagaactttatcttctccaaccaaaactctgtacccaataaacaccaattctttattctcctcttgctcaacctactttatctctatgaatttgactgctctaggtacctcatgtaagtggaatcataaagtgtttgtccttttgtgacttatttcacttagcataatgtcttcaagtttcatccatgtggtagcaagtgtccttcctttttaaggctgaacaatattccattgtatgtatatacaacatttaaaaaattcgtttaaccattaatggacgcttgggtggcttccacattttggcagttgtgaataatgctgttatgaacataggtgtgcaaacatctatttgagtccttgatttcaattcttttgagtatatatgcagaagtggaattttcggatctcatggtaattctactttcaatttcttgaggaaccgctactatttgctattattacgattttctatagcagctgtaccattttctattcctaacagcagtacatcagagtttccatttctctatatccttgccacttgttattgttattatttttataatagccatccaaatggtgtgaagtgctgtttcattgtggttttgatttgcatttccctaatgattagtgatgttcagcatcttttcatgtgcttataggccatttgtatatcttctttgaggaatgtctattcaaggtctgtatttattttttaatcaggttaatttgttgttgttgacttggagttctctatgtattctggacatcaatcccttattagatatatgatttataaaattttcttctattccatggattgcttttttacactattgatagtgtcttttgatataaaagtttttaattttgatgaagtgtctatttttattttgttgcttgtgctttgggtgtcatatccaagaaattattgccaagtccaatgtcatgaagcttttctcctgtgttttcttctaagagttttatagttttagtttttatatgtaggtatttgatccttttggagtaaatttttgcatgtactctaaggtaagggcccaacattaatatattttttgcatgtagctatccagtttttccaacactatttgttgaaaagactgttctttccacattaaatggtcttgacactcttgttgaaaattattcaaccatatatgtgaggatttatttctgggccctttattctcttctgttgatttatatgtctgtctttatgtcaataccacactgttttgattcctgtagctttgtagtaacttttattttttatttttccataggctattggggtacaggtggtatttggttacatgagtaagttctttagtgctaatttgtgaggttttggtgcacctatcacccgaactgtatgcactgcaccctatttgtagtctcttatccctcaccctactcccacccttcccctcaagtccccaaagtccattatattgttgaagtgtgagaccttcaactctgttcttatttttcaagattgtttaggctatttggtatcccttgagatttcatataaattttaggatggatttttctgcttctataaaatatgtcattgaaattttgatagagattgccatgaatctgtagattgctttgggtaatactgacagcttaatgatattaagtctttcaatcaatccctttatttgtgtcttctttcatatctttcagtcatgttttgtagtttccagtgtacaagtctttctcttctttggttaagtttattcctaagtagtttattctttttttgctattataaataaggttgttttcttaattttttgggttgttcattgttagtatatagaaatgcaactgattttttacatgttgattttgtatcctacagctttgctgaattaattattagttctaacagttttttaaaaatgaatctttagggctttttacatataatctggtaagatggttttgagaaatgattgctggtgaaggctgaatgggatggttgctggggtctctgtctgcttggcagacaaagacgaggatttgcaaggatttttatttccagtaccccatcttaatgaagcatatttaatttttgaaaccttctttgctgttagcataggttgtagaagtgtatgtcttaatccttccttaggaaagtcttaatccttgcttaagaaagcttatgatattactgataaggcaaggcttatgcacatgactaagatagactacatcatgtattaatcatgatgaagtctgaggaatttaaagtgaggcaggggaggaggtagtgaattcttcaaggggaaagtcatgctggagtaggaatttagaggatggggcttcaggtagagctagaaaatctgatatcttaaactgttgactaagatttttagattaacttctttgctccttgaagacatttaaaatcttgtatttctagaatgagcattgtttttcagaagaaacaggggtctcagataatttttagaattgactggacttacttcaatgaaatggatctattaggcatgacttgttatgctttttaaatgagaggattgctacctaaacctacatgttctttgtagagcagtaaactattttccttttcagacatgaatgaacacagctctagaagtcacagtatcttcctgataaatattaaacaagagaatgtagagactgaaaaaaaactcagtgggaaactttatttggttgatttggctgggagcgaaaaggtaatttgttctttatttgtattatctataattttccccttttatttgcttcattgtgcaatggtataatttttatgcttttctattttcctgctttaaagagcttttaaagtttctgaggctctgccaaggtgttattacatttaaccctttgtccctgctttcttttctggtcctgaggtctcctattggtgtcacaggcaggtgctttgcatgccaactctgatttatccctgatgggcccttatgatgatatgaggcaacagttggtttgacttagcctgtggcagaggcagctgcacacatgtgggagggatatgaacttctgagaaaagagaaaatcccatgttgtacccgactctaataggccaggaacgagctttgccattggaatgtggcagtcctgcctctgcaggtttgttttgctgatagaaggtctggaacctggggcgctccctgcattccctggttctcccagcagtaggcatgggctgacggtgtcccatgtggaaggccttggctctctcatgaagtgtggcctgtaatcagcctcagcggcaagcctttactgttctctggttttgtccggattctcttttgtcgtctacaccctgacccatgccctcccaggccctggctggggctgtactccagagcaataggcttcccagaatctccagtctcacttccatagcaccagtggaggcttctgctgccacaccctgtctggaggcactgacctccctcgagcaacatcatagagcaaggccatgtgcacaatgccctctggcctccatcatcactgacatcatgctgattgtccccatgaaggccagccttgaagcttggtcagtctccctaactgtatgattgatccccacttattgcactacatcactgagttcccgtatgccaagttatggccacttacatccacgtgagtaatggttacttggattgtcctctagtatgcatttgtaaaacctgagcagaaagtcatccgggtatttctagttgggaatctaaaattttactagtatggggccgggtgcagtggctcacgcctgtaatcccagcactttgggaggccgaggtgggcggatcatgaggtcaggagatcgagaccatcctggctaacatggtgaaaccgtgtctcaactaaaaattaaaaaaaaaaaaaaaaattagccaggcatggtggcgggcacctgtagtcccagctactcgggaggctgaggcaggagaatggcgtgaacccgggaggcggagcttgcagtgagccgagatcgtgccactgcactccagcctgggtgacagagggagactctgtctcaaaaaaaaaaaaaaaaatttactagtacgggcttgtaactttagttaaacagacgtacaacagatggaaataatggaggattattgttatttagagcctaaatacacctgaaaactgcttaatactgacagactggagtggaggcctgcctctgcacagtgtcagtggttattgctaatgatatttatgaggtgtttgaaatcatgtccttcacgtagtttcttttgctcacacacacctgttttcctttgccctagatgtgtccatatgactgtgtcagtgtgatcttgtagaaaagaactctgggctttagttcccgtctcccctgaatggtgttcttcccttaggctggcagtttgacatttctggggctcagtttcctgtctgtcgaaggagggtgatagatggtacctgccttgtatatttcatggagttaagatgctcaaataagaaagcatcttaaaataacagtgcttaaaataacatagactgctactatttgtgacccatcagctacatgatttctctatgtgtaagcaggggtaccacacaaacaagtccaagggagttgagaatctattctatttggaaagaaacctccccctggacatgaattcatttctgtcatcaggagtttctcctttatatgtgattcgaatttgcgtagttgaacattgcttccccacttcctttcttgagagagcagctgctccccctgcatcgtttgtccagtcagcagagacatgaatcatgttgagttcccttttttctagcatctgtaaactgccctctacctagaataaatgctgtcaagatgaaattaccagcaataacgcagcaaaggagaaactatgcatggtccctctggctgcagaggaaaaaagacaaatttacgatgcagtatacatttgacttttcatttctctcccaagttttttgctttttggatatttttcattttttccttgctatgagaataagtagggaaggaacggactctagataaccaaccctaccgcctctagtcatctgcctgaacttggagcccgtaacttacatttttccaatatgcccattcattgtggctcaggacaatattttctcttcatgcttccctctgggctcccttcggcatggggactgcggctcagtctcccagggcccgagctacccatggtgacagcacttctggagcctggtttccctggatggatggcccctggggaagcatctgcagctccaccatttgaggtatttcagctattccactaaaacccaattgagaggaaaatgatggcaggagagaccaaatccccagcctcatacacgaaggatggttttttatcactgtgggtcttctctacttttatttttccttgctttccaggaggctgtccccctttgccctcgtgtgaatttgaaatttctactttgtgcttctgccgtcctgtgctgctcactgctttcttttctctctggtaggtcagcaaaactggtgccgagggagctgttcttgacgaagctaaaaatatcaataagtctttgtctgctcttggaaatgtgatctctgctttggcagaagggacagtaagtgatcctgcccccatctattaagtaatattatgagaaaccaccttttggggcctcatagtccctttgccacacaccccaaaggctggtttgtttttctgtttggaagaggacagagggaatcctggctatggatgcctgcttgctgggagttcccatctactaaaaagtatgaatggtgatgctaatttcctatgacataggtcaaagaatgggcattctaaactttggcaagatccaaagacccagccacaaattcttgttttactcggtttctaagctcagtgtcttcatccctgacttgcttgcctctgtgtttttctcagaatgggctgtcaaaaccaatactttttcttttcctaaatagaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagaggtacgtgtggtctctcaggacccatcctctgtgctaggtcttgggtcttaagagtgaatggcaaggctgggtgcaatggctcacacctgtaatcccagcactttgggaggccaaggcgggtggattgcctgaggtcaggagtttgagaccagcctggcccacatggtgaaaccctgtctctactaaaaatacaaaaattagccggccgtggtggcatgcgcctgtggtcccagctacttgggaggctgagtcaggagaattgcttgaactcaggaggtggaggttgcagtgagccaagatcataccactgcactccagcctgggcgacagagcgagactgtctcaaaaaaaaaaaaaaagaatagtgagtggcaaggggctattgtcagagaatcacaaagtaagggacaaacagccttttactaaattacatctagcaggtgatatgtaaacttgaggcatcacttattgaagccaaagcaataattatattttaaaataatgggcaagaacatgccagtcaaatgtatggtgtttaaaacaaaacggaacaaccaaactcatttcagatgtgaattggaaatgcattggggtgttacttttgttcttcatggcactggagtctaccttttaggttcatattatttcaagtgtgtaaatctcaagattgataactgcctttagctccggtatttgcgatccattgcacagttgctgataaaacacccagaaaattaggtgaatgcagaagagaggtataaaaggaaaagaaggggaaggaatctttaccagcactggaggtaggaggtctggactgtatgctgagaagagatgcagatgacagcttcctacttttaaaaattcccacatgagacttcctagatccctgggaggtgtccataggtgggcagcaggtacgactccataatcgtaaagcaagagttacatgtgtgggtttggttcatatctttttttcttgtcactttcttttttacctaccccctcccactgtccaaggcctgacctccttcaggcatgtttcctcagttccagtgtttaggttctatccttcagccctcgtgcctcagtgttcattcccagagtgcttgcggttctgtggattgggcgatctgaacatcttcagtgctcagcgagctctgatgttggatgagggctcagagggctgaggttggatgtggattctgctgccttcggtttgtttaattctgaacaatcatgtgatctttagacaagtcaccagtgctctgtgggctttaactagctcatttgtacatggatgcacagagcacttccctgccttctccctgggagtgtgtgttgtgtggttatgcctaaggaatagtttaagatgagagaaaggacagatgggggtgggcattctgtctgggaaattgttatggcttgtttaaactgcattaagccccagtcatttcctgagccctcaacagaacatagaattacacagccgtggcacctgtgggatgtctaaataaataataattatattgaaatgttgtagacctaatatatcttttaaactggatttgggtcctttacttcctcccaaatcgcttccttgattagttaaatgcttaggccaagggggttgcagtaggataacacctactttcctcaagggtctcagaaacccacaaaccagcatctgcttatggaaaacaagatcgcatcctgcccagtgtcttaaacttgagctttaacaatttcctctgaagacatgtttgagcaaaccagctctaagtgcatttataaaggaaacatctcttcaaaaaaaatccttaccagcaaagcaaaaatattctggctcttctcaagccagagtcaccgtggggcattggctatctttgcaaggcccagtcaccttggggcattgctgttatcaggaggtatttgcagctgtctacaggaagcattttgaatatcagttagtgtctaatatatgtcaggtgtgtcaaaattatagcacttctgacagcaattatctcacctttgtacagggtatgaaatcaaggcttaggtgcaaagccattggataccatacctgagaccacacagccagtaagtgactaaacatgtaggatgtcctaggatgcagtgtctgagcacagccctttgggtcagtaagcccagtgttgaagctaattctgctattgacccattctcttgtttacctctcccctctgagccccagtcttctctcccacagagagatatataataatgcctactttcaagaatattgggaggattatatgagttgcttcagtttttacctagcacaagggctggcatgagtccaggtaaaaaagtccgtgaccgatggcaggctatcggtgattgcaagttctgcttttccttcgtcttaaataatctcacagtattgcggcttgaaaaggtcatagtagtagatgggactagactgaatataatgcactgtaagggacagcactgtcatataagggagaggattaaataaagtagaattagaattacattttgggaatgaacaaataaaaaatgctgcaggtaatttgggcttccaggaagtaaaaagtaatataaattatgttttcaaatgaaataggtcggtctacattcttttatcagagtcatctagattctgctctctgtgacagcagggactgagtttgtcacagacattagtttctcatcaaccactgcacaactagttcacagtaggtggtcaataaataaatgcttatcaaatgaatgaacagatgaatctaaagcttattgtgtaaggttacttggaaagttagggcagttgctgaacattgatgccattacgtccagaagtttggttgggtttggatctggtttgctttccaaactattattggaaatgtgtgaggtttcgttcctttccctttatccccaagttagttaatggattatttaaggatgctgagctattctatggggccaatacctgctgtattgttaaatatactcattgaacccaattatacagcagacacaagactgaacatcggattagacatggtatgtgatagctaatgagattaagcactttgaactcagaaaagactgccgggcacatcccaaattcattgtaatgagtgttcattatattcttactgcagaggtggccaaaccttagggcagcatgaggttcctccgttattcctttgtggttctttcaaggacgtgaagagagtacacgtttgttctgcttgactgtactgatgttctgaataacacagtgtagtatgtgtttcgaagcagttcaatctgcagatccctgaaggcactctaccaagagtcctgttagcattcttcaggattataggttagatactggaatttaaagggaaaaatttaccatgtctatttctatttttgttttttaaattatacttttaagttctgggatacatgggcagaacatgcaggtttgttatataggtatacatgtgctatggtggtttgctgcacccatcaacccgtcacctacattaggtatttctcctaatgctatccctcccctagccccccaccccccgacaggccccgatatgtgatccatccatgtgttctcattgtttaactcccacttatgagtgagaacatgcggtgtttggttttctgttcctgtgttagtttactgagaatgatggtttccagcattctggttcttccattcagtcggggttgtttcctttagtttcctgaatgcccagcatcgtgccattaaagaagtaagtgctgtctcctgtgttctcaaagagcttttaatctagctgaggaggcagcacttgaattacgaggcagtagaaagtcaaaaagccagactcaaattagagcacttttattgattcttttcttctggcttccagaattctattttgtagtctttaattactcttctcaactacttttacagcgctatttgaaaaagatatttatgttttagaagtgtgaactcaaatcacccaattgtgttggaagcctatttaatgtaccttgatttggggtggtaataaagggaaagaggccctctgagggggcagaccaatgtggttaggaagacctgaatcggcacatctttggcactgggagttttgattgatccagcatgaataatttgaggctttgtttgtatgttgaatgtggaaggagaattgatatcttagggaaagtaataatcttttttcttttcctgatgtgcacttaaaaaagtcgtgtcatcattttaattgtgtcatctgccagtttagtggtagctagattaggcagagcctgaatagtgtgcatatgaaatttatgtcaccagaacatgagaacacattacctacgagagtagaatgagcattttggccaaggcagacacttggctacactttgacatgaaagaaaaaaaggcttaaatcattcctgttggggggcctgttgctgaaacaccagtagggttaatttttgcccttggagggaagaaatactgtgggtgacatacatttaactagatgccaagtccttatccatgtcatttctgaatgtttctcaggagactagaactttttaaagacacaaaattttcatttctccctcctgccctccctccttccctcacaagcagggaaatggcctcaccagaagctgggaaggtgctttggagcagtggtcctttcagaagaaggtttgggtgttttagatgggaactaggtctcagagcagattggaaggttagtttctgattagttttatatgtcagcttggctaggccatagtgcccagttacttaatcaaatacaaatcgaggcgttgctgtgaaggtactttgtagaatatgcttagcacttacaatcagctgactttaagcaaggcagattactctcaataataagggcgagcatcatccactcagttaaaggccttaagagctaaaatggaggtttcatggagaagacaaaaattgtgcttcaggatggtaacatcaactccagcctcagtttgcagctgtcagcctgccttatggctttcaaacttgccagcccccatagtcatgtgagtcagtttcttaagtaaataaaagagtgaggtatatcatatatatgtatgtatgtatatatagtaggattttatatatacaataggatatataatatattatctatatttatctatcatctgtctttatctttctcctattggttctgtttctctggagagctctgatagtgaagaatgctatactctctatcctctcctgctcccacagtgggagaatctccgtttctgtctctcacacaccattcacagtgcagaatcacacatgacagatttattctgtgtgctgaaggtgtgaggttgtctagagctccttattcaaatgccagcactatcctgaacacctggtgagaaaagaaggatgctgaaataaaaggtatgaaggtaccaagaacaaatatctttgtggttattccagggaagccaaagtaaacagaagaaacgccaaaggtaggcactcctcgtgtcatttagaactgactgtggccaggaaatatgagtgtaggaaaccactgggaaagcaggtggggatgagactcatcagaatgcagtggttctaggtcttctccccactcaaggagggcttcgttcaagtgccaacttacgagggtgccttcagtgtcatcacatgtgggtgcttaacctcggtggtggagatgggtagcatcagcagtcttggaagctggccatgtgcttctgaaatgtaaactgcaaattcagtgatggaaggattgagtggtgctgggaagaaaataacagaatgctcgacaatggggaggtagtttcctctttccattctttagtagaatatatctaagagaatctttactgacttaactgtctctgtagcagtatctagatggaagatgtactgtggcctctgatctttgtccactaggcttggtctgcctttcctaagggtggttaacattcattagctttgaggtctttaaaaaatttggtcctggttccctccctgtggggagaagagattttatacctggggcatgccctagatcatatatcattaaagtagtgcttgacttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggattaatcaaatagtatcacagccagtttcacctttaaagaggatgagtgagcagtcagtaagtggctagaataaggcttctatgggtcattgacttgtttctctatatcaaagagataatgtcctggaaccataaggctggttggtatcacaattgctgtatatagcttctgctagacaaaatcacaaaacctgccttaagagcacttcttaatttctgctgtcttcttgattttgtgtctccctgtaagctacctgaagttcttttggaaacaaggctgaacaataaatgcacacgtgtgggcctgtgcccaagttccggatcatgttcactggcagcctcacgccctagatccaaaccacaacaagacagcagaacactgtgtaaccgcattgatggcaactagctagatattaacaaaggaggaaactgatttttttttctttttttcctctgaaatcagttaaagctaattaagggaaagtgaattttgaatgtccaaatagaaagaagctagtgatcattaggctccttcattctctaaatttgccaaagttgatggtaaaaagaaaaagaaattgtagatattctatatccttttactcttagtctcttgggagaatgagagactgagaccctctttatttcactttgcaagattgtttttaacatcctagataggagaatgtttgttctagtaaaaaaaaaaacaaaaaaaaaaaaaacaataaacctcagggcacaaaaattcagtatctctcttagtaaccctagtttattctgcatctggaaattcttgtatctgacttgatttctttctccatcagtttgtttttcttaactcaatttttattgaatataatatagtaaaatacataaacttaagtgcataactaatttttttttataaatatatatacacatgtgaccaccacccaggatcttggaagcctctctctttgaccctctcagtcaacaccgaactctcaagggtaattgtcaccctaacttccatcaacatagattgttattgcctgtctttgaattatttgaaaatgaaatcacccagtactgttttgtatctggcttctttcatacagcgttttatctgtgaacttcatctacattgttaggtgtagtagtagttcatttttcacagttatatagtattctattgtatgaatatggcttataggtatccattctattgttgatggatatttggattattttcatgttggggtgattataaataaagttactatgacattggttgtcatgcctttgggtgaatatatgtcctcatttctgttaggtgggagcaggtcataaggtgtgaaatattctactttagtagatactactaaagatttttccaaaacgacagtaataattcacactctctccagtagtagttgactgttatagtcattgctcattctcagcaacagttggcattatcagttttaaattttttagccattctattgggtgtgggaaggtatctcattgtagttttaatttgcattccctgaaggctaatgatgttaaacaccttttcaggaggtgttttattggcacttcttttataaagtgcctgttccaagtctttgcccagttttttcttattgatttaaagcagttattttgggtaagtcctttgtcaggtatatgtattttatatatcttctcccaccttgtaacttgccttttaactgtcttaatggtggcttctaatgaagacaagtttttaattttaatgaagtcaaatttattttttcttttatgttctatttaagaaatctttggccaggcatggtggctcatgcctgcaatcccagcactttgggaggttgaggtaggcggatcaccagaggtcaggattttgagaccagcctggccaacatggtgaaaccctgtctctactaaaaatacaaaaaaattagctgggcgtggtggcgggcgcctgtagtcccagctactcgggaggctgaggcaggagaatcacttgaacccgggaggcagaggttgcagtgagccgagattgtgccactgcactccagcctgggcaacagagtgagactctgtctcaaaaaaaaaaaaactttgcctaccccaaggtcttgaagatactgtcctatattttctgtggaagctttattgttttacttttcacatttatgtctgggatctctctggaacagaattttttacatggtattgggggtgaggaataaagttccacttcccctcagtgccatgtattgaaaggactgccctttccactcttctctatggacacttttgtcataagtcagatgactgtcatctgagtgcctgtttctggacaatttattctgtttttattccaagatttctgacaatttgatcagttttactttataagaaagtgatgatgttcaatcctctaactttgatcttcagaactgtccttgctattcttttttttttcatttctattataaatttcagaatcagcttgccaatttctatacacatacacaaaccccttagggtttttttgggggaaggtggggattactttaattctctagagcaattttaggagaattaacatctttctctctcagtgtaagctgattttttcatattctacctttagtggatgtgaaggccccgcttgccccatttgggctgaatgaagtctcgggctccagtgtgagacacagattcccactgttatttgagttccaaatggaagttgggttgcgcatctttagctactcctctggatcttttctgcaccatctctgtcctgctttgtgacttaggagggtgactggtttgggctcatgcaatgggctccttttcctctggcttccagttatgttacacccgtggggaaggaacacaggcaggcgatcagaaggagagaagagcgtgaggtccgggtatttatttcctggcttcttccctgccagatcattttgggttggctgtgtccctaccaatggctgtgacaattcatacctaccaggcaatcttttccttctagccttctctctctggctccccttcagcttaagggtagtaatggctccccagtccctaatgtgggtaccacattaacccttgttatttcccaacacctttccaaacctttgttaagcactcttcaaatcatgcaatttgagcaggtggtctgtttccttccaggaccccgattactacagaagtggggatttcctaggcaattgttaaaagtattttgagaatgaggaccagttacaccaatggtgataaccttgctgagtctgctcacaaaatatgcctctggctaaacctgcctgagtatagcatagaggctttagctttctctttctggtatcatgtgaagttatcaagggactctttatgatttaaaaagtaagattagtagccttgaagtgtgcccttaagtgtccataagcattttagccatgagttatttttcactttttgccttactaagttgataatggatgcttgtaatgtttgtgcttgcatctgagaagcatccacagtactgcctgaggatgtcaggaggagaggtgagagtgtcaaacaggaccagactttaaagtagtaataaaattgctgttatttgaaaaattagactcaaagcacttctagggattgcagcctcaagctacagtgaacaagagagagttatcctaattcttaaatggagtcttacattgaagttgttaaactcctcttttgacagttgggttatttagttgtctgctttagcaatgaatttttggaatgacatctgtagtgctggtgaggactgctgaatttcttgcactgaaatagaaatcaggatgtcatttgctgacaacggtaattaacccgaatcacaaatcagattgtgctggcaaatatgacggtgtaagaactgttggaagttcaaaatgaaaaagtcaatagcaaataaaacaggatatcacatattttttaatgaagctttaccttcttgaaagtaagcctaagtggagtttcctttttaattggacaaggccacttaggtgttcgtttctgtgcatgctgagctgagtcatggcttttgtttttggtatcacttggtgcagctactgatttgctctccacagttgcccctttgggttactctccaggtacatccctgtggcatctcaaccccccaggccatgtgccccagagatcgcatcatctcttatactggaagtggcaaaatggtggccattaggcatgtttgtttgtcccacacattgtttttataaatagtttaaaactgggagacacaaattaaagaaaaaacagtttctgatttttcttggaaaataggatgatctgaatactgtggggcctcctcaccgcatggtgatgacgggctgtgatggggggggcgggtgtgtgctcagcagggagccatggtgtcctctggccagccttactcagctgtgggacccacctgacctatgaggcatgtgttgatgtgataaatacatcaggggtggttttgggtaccacaggtgaggaagagaaataattgattctattatttctgtctgtgtatcattggtataagaaactgcagtctccaagaggacagagacctcgtctatctgtcttggtgtaccccaaattcataaatgttaattgaactgaaaagaacctcaacttaggcaggtaaatctggtgatggtatgcagggggcttaaaggagggtactgaacatttgaaaaaggctgtaaccataaggatggctgagaacacagactaagacagtggcagagggaagagagaaagaggaaaccctgagacaattcgaataaatgttcattagatttagagaccagtgggatgtgaaggagaaaaggaaaggatgagcttgaggcctcaagggttagtggtgccgttagtccaattaggaggatggttggtgaaagccacaggatcccttctgcttccctatttccagtcttttgacatgaggaatcttgggcttaatcatattggtttagctaatggtaataattagctgaattgtccccttatgtttttaatcccagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggtaaggaaaagtaaggaggaagagtgaggcatgagtgtgtgctttttttatttttattttttttgagacagagtctctctctgtcactcaggctggagtgcagtggcgtgatcttggctcaccgcaacctctgcctccagggttcaagccattctcctggctcagcctcccgagtagctgggattacaggcgtgcaccaccacacctggctaatttttgtaatttttttttttttttttagtagagatgaggttttaccatgttggccaggctggtcttgaactcctgacctcaagtgatccacccaccttggcctcccaaagtgctgggattataaacgtgagccaccgtgcctggccgtgtgtgtgctttctttttcttgtgactgttggcatcctgggagacacttgggaaagttggggcaatggtgcagcttgattcctcctggcaacaacctgtatgaacaagcagatgttttcttagtccctaacacaggcaccatccccatcccatcacttggctagcatgcattgttagtgtggaccagtgattatctgcaaggctgccttaatctgcttccaatgagatgcactctatctaatattgtaataacttgctggtacccctatttgtaggttagaggaaagtgcctgagacttagtggctcagactgcttttgacttaaatgaaaaatgtcattctctcctatgtgagttttattactggtttggggttaaaagtctacctctggcaaatacttgcattttttggctgaactcatcttcatgccagaaatatagggctctcaaaggagccctgtgctaaaatggagtcttaaaggcttggttcgtgactcgttttccttcttccccaaaacattttctttggtttgttctactgggagaaaatatctcagagagctgacatgcagtgggtgggtgggttgtgggtgaggtgttaagaggggtttccagatctaagtgcagacagattattttagtgattttagcattgtgacgtaggttagaaggtagaaggctttttttttttttctttttaactaaaataaggcaggttggtgtgtgtgtaggggaatggcggatagttggaagttgttcttcaggtcctctgctgctgtgttcagtattttaggtgctgcagctgtacctcagctttgggtaagggtaggagcccgggggctgttgtgcaggattgggaggtaatgctgactgtaactgcagcagattgtcttgtgattacacgtttgccactgctttttgctagtaagggtggggtgtcaatgagctattgtttaatagaaaaacaattacgtggcaaacgagaattcaagacaggtttcaaaaatgacctagtagtctaaataacatgattcttttatttttgaaagattttctagcagcacacgtgtttggaaagctactagaataattgaataattcagcacctgaggctggtggatgattctttgcaatttggcaggaatgggagagtcgggagcagtagttggcaaggtggggagtagccatatgaagttttatttcgggaatcctccaggtcagttctctgttgggtgaccaggacattcagtaaagccttttggtaaaggattgggggtgctggctttagaaacattacagggtgggcaatgaaccttttttcccccatcattttgcatctcttgccaaactttaaccttgcagttctccatccctcatcaaatgccatcctctgggatctgcccattgccttgtttgcctgactcaccatcatgcttagcatcttttgggcactcagtcctgtttttggcctctttacttggacatcattttaactgtcactcttcgaacaccttgcgaatctccttagaaatgtactgttttctcccagctctttgggtggccgaggtgggcagatcacctgaggtcgggagttcgagacccgcctggccaacatggagaaaccctgtctctactaaaaatacaaaattagctaggtgtggtggcgcatgcctgtaatcccagctactcagtaggctgaggcaggagaatcgcttgaaccctggaggcggaggttgcagtgagccgagaacccaccattgtactccagcctgggcaaaaagagcaaaactccatctcaaaaaaaaaaaaaagagaaagaaatgtgctgttttctgtgccctcttgggtgagatcctacatgagcctttaagttacataatttggggaaaataatgtatgatgatatactctggcacagagtagacctccaataaatgtatgggaagcaaacatatgcttaatgcaggtgctggagattaaagggtgggcagtcagatgtggtctcttccctcaggacggtctgagcggggaggaaggtaaatgccagtcctcaccaataaatgtatgatggtagtccacgctgcataccaagaagtgaaagcacaggtgccaagagttatacaacagggggccctgaccttgactgagaagccagtgaagggttccttgaatatgcaatgtagagattagtatctgtgagaagcgcagttagccaggcaaaatagggggcatgaggtgaggtgggggctccgagaatggaggacataggccagcagggagcactggcctgagatgggctcgagggataggcggggctctcctgtcttcaggattttggtcaagggtgttaagctgcaagtcataccttcgcatttttgaagatccattggctgtattggagagtggactgcaggtcggagaggagggctgggagctggggtggtcttccagggatgagatgatggtattgaagtgacagggtagtaggaagggagagaaatggatgaacctgagagatatttaggaggagaaattagccgggtgtggtgaggggttggctatgggagagggaggtttcaatgacaactgtgttttctggcttgccgagttggatggagggtgagaccattctctaagactggggatgctggaggagaaccaggggtgagggaggagggagtttagggtccccgtggaacatccaggggaacattattcagataagaagttaggtctgagggtctggagctcagaggatctgcttgagttggagtcatcagtcttttggtagtaattgaaggcataggtaggtgtgagggccctttggactacagagaaagaagagaagacagagagagtctgagaggcccccagcaaccccattgccacgtcaccactggttgtgatgggagaagggaattggagggattccgcagaactctcctttcctccccagctaacatttgtatttaaaggtgatttttctaggggcaaagttcttaaaggtagagaactgactttagtgatgtaagtttcaggcgagaaggagagtagtgaggggcagtgaggaggtggggagaggtcctttgtcccatggagggggcagagctacctcaaacagtaactctgtgtctcatgctatgtgccagtggacgttacagggacaacagaccaggccaggctttttgttacattctgaggctgggcatttaatcctcaagtagctcttgtgaccatgaatgacaggtctgaaaacgtccccaagtggatcagtctctggtaaagctgcgatctgaactgagtgggcctgactctaaagttcattctctttctactgtctgcacagcctgctcatcaagttagcagaatgatttgtgggcagggccagttagatgagtgtaataaatatcacgccaaaaaaaggggcactggaagcccttccatggtctccccacgtgtcagtcctaattcttcagagcagaagataatgagggcatagctggtgataatgagggcatggctggtgtgtgtaaacgtgagagctgggcttttgagatgtggactgaaaaagcagaagtgcccttcactaaaaccagagtggcaggatattgccaactttcctttgaaacttgacacgcacattggttctaaacttacagaaggtggctacttagctcccctcaacatttcctgggtattgatatttccacatgggcagtctccacgagttaaagaggccttgtcaattgtgtgcagtctcctgggaaaaagatttctttctttgcatggtatttataatttaagagtttggctgctatacttcagctgctggagagcaaggaaggggtatnnnnnnnnnnnnnnnnnnnntgggctgatgtatttgaagagagcaaggagcagaatggtacaatggggtgatgggggaagagccaggcagagcccagtgctgcaaagcccggtagcacatacatgtgtaacgtaccttgaagcaaatgaatggcctgatctggtttctgttttggctgctctgtggtgatgtggtgcctgggaggcaaagaagctgggaaagaagcggtttttctcttctaggtactttaaagctctataatatatgctcaggtgaaatttggctggtattttcagggacttcactgcttttgtgccatactggcctcatcatgtagataacatcacggattcattccatcttattattctgtaagagtgatgtctaatttttttaaaaaagaatcagctttaaaaaatgcaaagtctcatagaaagtaactcttttctattttaagcaagcattcagaatacacacacatgcttgtgctttttcctacttgctgttacatagaatgaagtaacaatacaaaggagtaggaaatcaactacagatcaggtgcaggcagataatggagataactgaaaagaggtaagtttgatccagctggcagtgttgggactgtgccacaggacagggcatgccctgccttatgtcattcaaaattggtgaaatactgcactattacatgcctagaggttgctctcgccctcccccacacctccacctgtaccaattttcaaccctttgtagcttgatgcatgctatagattgaatgttttgtgcccatccaaattcatatgttgaaatcttaacccctaaggtggtgatagtaggaggtggggcctttgggaggtgattgggttctgaggatggactctcatgaatggcattagtgtcctgtgagttctgagagagcttccttccctctggtctccactatgtaagactataatgagatgccatctgcaaaccccgaagagggcccttaccaagtgccaagatcatgttggcactctgatacttggacttctagcctccagaactgtaagtaataaattctttataagccacccagtctatggtactttcttatagcagctccaggtaagacaggggccacttcagaatgcaggcctagcagttttctcctctgggcactgttgaaccttgattctcagaaggcggcttgtggctcatatcacatatactacactaagctttaattcctttctgacattgccatggaggcaggataactccgggcatgtgcatgtggctaaggagagccacccactggcctggttccgttccccagggtgctagttaggatccttggattgcaaacgacaggaattgacactgcctggctaaagcaaaaagagaatgtgttagaaggatacgaatgattcgcagactccaaagcagaggcaacaggctccgacaagtgtaggctggggctgcttcagggatacaggcagcagagacaggcaggtctcttaagtggccacacctggaattaatgctttttcccttctgtatgtgattatgttggagaagcagaggcccaggatagaagtgggaatactgtgcttgctggtgtgccttggctggggaagggcagggcactttgatacattgtctgatgaagactgcatgcagtttagggggctaattccttaaaaggaagttgaggtgctattttctaagaatgggtgtcgagtggctgaaaagcaacaaatgttcaccacaatctactagtgacatcttgtgggccgatatcgatggctggtctttcttcgaatctggaggctctgttggctctttagcctcacggagatttgttcagcctgcttgcttaaggaacagataggatggagtggggcagttgccagaaaatggaattttttttaaagctctattgctttgttgctcatatgtgcgggagagactcgaacaatcctatatatggagatagagttaaatagttggattcagagtgaattacagctccagctcatgctaacctcctcccaatccatcaggaaaactcttgacaggaggatggggagggcggggtgaagtctggatgcatggcttcctgttgctgccaggtcagtcttcacacatgctgtcttctgatactttgaattttgcacttgaaaaataattttttacagtgatttaagtcagaaaaaggaggacctgaaaatccaggtgtcagaacaaggaaatgacctgacaaactggtgtatctgcagattttcttctcttgaataattgcctataagattaaaaaacagtggatatagatttaccttatctgctgaagtcatgcaaagaaatgatttcatcacaggctgagaaagtgtggaaaaatcggcagtctctaacgcagatttgttcatccagttcaaaacctgtgaggccagcagacatggttcagtaactagctaaatctgtagcctctagtctgatttggggctttgtggaactttgggaccaccacaattggaacacaatttgctcttttagcattaaatcttcgaagatgctggctcccttcttagatccatgattataatggactctcagaaattagcatttcattggagcgatctaatttactaggccctctgcttgcttttgagaacacaaccaaactctgtaatagaaataccgtctgtctactaagagaatgttgtggcctgttcaggtggtcatgaatgtaaggaggatgcagagtcccaggtgaccagtttattagaaaatcgctctagaagggattagaggatgttttaagctgcttacagtgtttttaggaatgagggtgaaagatgctatttgcatgcaaaataatctcataaaagaatgattttttttttttaacatcacatttatataatgacatcttgtagccagctgctctcacccatctggcaacttaaagatttccttttagtttctttgatacagaaattacctaccattaggtctgccactgggcctatttaattggaattaaaagaaagcacctcgtttgccagatctgctgtggttcctggcggaagctgtgagtaaccagcaaatctctgctctggagttactgagagaatgcaattacctttctgtgttctcctgaggctttaggaactcaacttatgaaaaggataactagcttgttgctatttcatgtgtgaagttttaatgaattactggcagtctaatggttttctttctttaaaaaaaaacccaaaaacctattttagaaattttaatagccctaatgagaatttttgattagtgtgtcattctcatctgttgccgttgatggatttctattttttgtagaaatgttatttacgccctctgggagtttttattttataattagaatgctctgtaagccttataggtatgcttcagtgaatgctcctatgtaaacacaaatctttttagtccttaaaggtaattacatctgacgatagtaaatgccaggatgcttatttaaagaaggggaaggtttccagtgtgtgtgtgtgtgtgtgtgtgtgtgtgtgtgtgtgtgtatgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcaggtcttgcctagtgttgggaaatttacaatcccccagacgtgtttgtgagctggacagtgtagttaccaggacgctttctggaagtcattttctcggtcctttgaagagtagtggtgttggaaaacctgcccttggttcctctctgggcaggagctgggctgctttagttcctgcgtgttgcggctttgttcttctccgttgaaatggctgctgtaaaaaataatccttactgcctgacctttagaatataaactgaaaagagctggttgtttagatgtagctttgtaggagacatgttaatgctttgattgagagaattgttcaagagaaaccacaaagtctgctgtaggtttcaaatactgttttaataataataaaaataaacctgaaatggacttgcatggctataccatgttttatttttggaactgagctccagccataaaattatcgtaaagatctcagaaacacaaatcacagaataagtaaaaataataatttatctgccaagcctacaaagttgcaaatttgtcagggagaggaggggataagaggtggactttgaacaatattgccttttgtgctttttacatatactatcttcatttatctttagaacaaccctgtgataaaggcattgttatttcttctcccttacagaaaggaaaccaagagggtaagcaggagatgggcttgtgattaatgagacctgttaaaaggtacaatgtggctttagcatcctgccatagcactggagatgagagagtcccttgactactttcacagtgccttacagcagcattggctagcttgttgaatctctgccatctgggacaacccttctacttggtgacgctatcattccttaatgggagaagagggcagctttaggggaagtcaggcctgtgactttggttagaacaggtcacttgctgctaaggttatagaagtctatccccggcccctgcccactcagctgaatcaaaacacacactgggcagctccttagcttaccctagcctcatgataccattgcctctttggccatttgaaaccaaagaacacagggaatatatctcttccagatgtttttgtatcttacctctttacttggagtgagttggcctgtggataatatgaccatgttctggttggtgtctggtctggtacagctaagaatttcatctttgtcatgcgtaagctgaaagattaaattcatactgtactggattgccctgttcccaaatttcagaagctagagctcaaaaattagagatacagtcacaatccaagaagaggaaggatatttaccaaagtgttagtggtgaatttctctggggaaggaacagaattagaagggaggggtgaaggaggactttcaagttttagttgtatactccacattgcttgagttgtttatgttaagaatgtatcctgaattattgtgtgattagaaaatctgtctgtctgtctgtctgtctgtctatctatctatctatctatctatctatctatctatctatctatgtctatctatctctaatatgtttaagaaaaaaaaagaacatggtacagcttttatagcccatggatttagcagactgtagagaatatagatcctttaattggatgaaatccagtctgcacactaaggttgttgatggatattttaagccaggaattggaactgaatgaaatattgatttggttcaggttctgttcaaaggctactctgatattctggttttgtttaaggtcaataattttagaaaaaacgcttaagtatagcagtcttgttggaaaaggaaaaagggttggctcaattttgtattcagcaaggtaatagtttattctatgttttgcttcaagttgctgcttcaaacggaactgtgatacaaaagtgaaagcattgggtgttaattttacttaacacggaggccccatgtagtattttgtggttatgcagtgagataatggagtcataagcagcagaactaaactatcacagtgttttgtttatattgagataaatgtgtacagtgttcaggtgggttccttgaagcatgatatatattgttaatgaagccacagattgaaatctcagttactctattatttatttttatttatttatttatttattgagacaaagtcttgctcttggcacccaggctggagtgcaatggcgcgatctcggctcattgcaaccttcgcctctcgggttcaagcgactcttgttcctcagcctcccaaatagctgggattacaggtgtgcaccaccacacccagccaatttttgtacaaatactaagttttgtatttttagtagagatggtatttcaccatgttagccaggctggtctcgaattcctggcctcaagttatctgctcgtcttggcctgagccactgtgccctgccttctatcatgtatttttgaaaaactctctgactcaaggcagttttcctgggcaatttttacaaaatggattttgtgggctgggaactggggtgaggcttggaatactgcagacactcttactactgactgtagcaagatgattgtggtgttgatggtaaacattgtgatggaaaagtatgttgggtttggttttgctttccaggaagatatttgggagactcagtggggccagtagttttcttagaatcctttttatgcactttatgtctttgatgttcttgttggagatagccattggccagcttgcaagctgtaccatttctatcaatttgattgacaaatttggcaattcttcctttgaaggccccaacaaatgctactctgcaaactgagaagttgtaggtaggatctctgcaagatagtctagattggctgcttttctttcctaagactacctgatatcacagtaggttattctatttgaactttccagcagagccaattaattctggcttcctggaggagacagtggtattgaaatgtgagcttttgcagctctagtcttggatccagggctaccctgtcttctgacctcagatttggagattcttgaattcagaggatctgagccttagagtgttctatcaaacaatgccagtgtgtttctttatttggctgtttctattaatgaaacagtgacataattaattcataattaggatgccttagaggtctgtttcctttttaatcaatcactagagagaatatgactctagtaaagccccaggatattcctcaactaaagcaaaatgaatgtaaagaatttaggcatctctgcaagttggagtagcttggaaccagtttacttcagggatgcatcttgagaggggaggttttacatagttctcttttttcttagactagttttggccaattaactaagacctttcttgtcaaatagaaggaacacaaactctacccacactacagccctttattgtgtcttctgtgtatttttcaccaggactgattatttttggtactcttcctggagggttgcatactcaatttctttaatccccaactctgctcggctatgttttgcaggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggtctgtggccagagattcatagttctcattctgctacaaagatgaaagatggcaggtcccagctccctatggggctgatgtagggctacagcccgatctttgtttctggtttcctaatacctaccctagcactttgatggtgcagattcagggagtttgattcatgtggaatagaaatgttaaagggaacttgactgaaaaagcagtgtgttggcctagatagacaggcgggtgctatttagagtcttgtcttctagaaattggactgggctgattactgcatgaaaggtggggtgtgtgagtgtctatgatctttaagtctccctttcttctctgggcctatccttcacctcttggaaactccagcagtagcctcagctaggggcaagggttgtgactcccagaattcaagcatgtactttaatcatataaccataaggccctgggatgagaaatcgatagcagtgtggtctgatggcttcacctaattggtgaagctcttttcacgggtatattcttgaatgaagtagtttgtacatgctaattggggatgtccaattttatgacaagcttttgggactcaaatagtcatgtaaatgcacaagttggcatagaggaaaagaggccttggagaacactgggagaatcaattaaaggttgggttaggaatcccagaggcatgagaattgaattgatgttttatatgatcttggcatgttgcccttggaatattctaaatcctttcagttgatttcatcagggttgctgatatttttagcctgatttaatcttttctattgtggttcagctcagagtgcttagggacacctctggcttgtatgaagcagctttgttatgttaaccttgccattaatcttacaggcttctctctttgaggtaaagctcagagactggtatgacctttgcaagctgaatgtgactggttgccttaaggaagctagttctgcttgtttgtgattccaagagcttgcactataaccaaagctttattctggggtcatcctactcttctgaaaacacatttaataaaatattcgcacccacgagatgggttacttgccctttaggctccacgcataccgttatcttccatttctatctatgtattttatgcaaaacaaagagaaaaaggagatcaatagtaagttaacagtatatgcaatttcttgatttctccaaggaattgctattgtttaaacagtaaagaagattagaccatatgcattttttttcctcattttagaaccaatgggctcatttttagtaatcgcagagaatcctgggtgagagggtgagaagctgtttctgtgctcagttctctatgaatagacgcctgcatggcggaatcgggatcatttaccttggcagcacagggaactttcattgatccaagagagagactttagagtctcaaatcagacatacgaaatgtagtgattaggacagagagatgaaaatgccatgtccaaagcattcagttggtagctgaagagctggcttgagagtctccgtctcctgatggtcagcctaggccattttgttatgtcattttcctacagcatgtgctttgaagattctgtaaggcccgctgttggaggctagtatttgtggtccctcacatgatgatgctgagagacgtgggagaggactgagcctagaagcctcagccttagggggcaccagagctaatggtttgccctcagtgacccttcccaaagactgcctgattatgtcttaccaactgtcattcttaggggtcctcctctgaaatgttctaggaggcacttccatgtttctgttgatgtaggtggtttgacgcttgaagaatacatgaggtgggatatggcaccttcttagtctactgaaaggtagaacaggaggtatttaggtttgggtgaggcactagcccagggtggttatgtgacttacccaagtgtatatcacatataggtggcagagctaggatgaagttacatatcttctgactcccaccccagtgctcatctcattttgccctcagccctttaaatgaggacctggtcaacctcagtgaatctatttagggtgtggagggagaaagaccacacggtttcctcccagctgtcccttctgttcctccgtgctgccccgccagggctccaagcacaggtactctcccaaggctatgctgtgtgatgggagagcatgcactgtggactcagacctgtaacaatgacactgagacctgggcagacctgtgacaataatgctgagtcctgggctggcgcctggccctgctgaaggtgctttttctcatctgtatcatggggcttatatctgttaattcaaaaggctgtggtgaggattaaaagtttctagtacattgcaggtgcccagtaaatattagcttccttctttctcctgggctgggctgggctctgcttacttccctgtgtggtgtggaaggggtggtgccaagggggccaccagcagagacacaatgtgaacaagttggcgctggcactccttgtctcttagtctctgtccctctacagtactgctctgctcttggagatcctgacacgaaccaagcttaagtagaaatgaaagttgattatttttatgcagattaccattgcaataaaaacatttttatacttaaaggtgaacagtgacctgttgacaactgaggttgaccagtttctcatttataagggtgtgcatattattttgttttatttatttatttatttatttatttatttatttattttttgagatggagtctcgctctgtcactcaggctggagtccagtggtgcgacctcagtgcactgcaacctctgcctcctgggttcaagcaattctcctgcctcagcctcctgagtagctgggactacaggcgcacaccaccacgcctggctaatttttgtatttttagtagagatggggcttcaccatcttggccaggatggtcttgatttcctgacctcgtgatccacctgcctcggcctcccaaagtgctgggatttcaggcctgagccaccacgcctggccgcatgttattttttttttaatttttgagatggggtcttgttctgttgcgcagactagagtgcagtggtgaaatcacaactcactgcagcttcaaccttccaggctcaagccatccacctgcctcagcctcctgagtagctggtactacaggcacataccaccacactcagctaatttttttttttgtatgttttgtagagacggagatttgccatgttgctcaggctggtctcggactcctgggctcaagtgatcaagctgccttggcctcccaaagtgctgggattataggcgtgagccactgtaactggccttatgttatttcatgtataagaaaattcaagtataaaatactttctgaaaagtgctttaaaatctgttatccatggacaagatctttagaaccggcatcagagtgagcgtgcttatgcatgttctaagagatgcagttgaatgtgtagatataagcacaccttattattctggaggttttgaaagactttaaaaaaaatcacagtagagctcattaattccttagataagttgccttaataaagggtaaatatagtttgggaaatgtctctgatacaagtgatccacgtcttctgtagtatcatccttgttcttcatccttcccaggtggggccaggggcccttggtttttcactgtaccttaaaaatcactgcatcccagcttgtcatctgttgggaggaagcctgcatcttcaggctttgaaatgagcacagcgtaaggacagagttcactccatttctctcctcttgtggtttatatcacttgtagtgcttgtccatttgtcccaggagaagagatggtggctctccgatggtaaattctttgaatcctttatgctaagttgtctaatatttaagtgctcaggaacataaacacaaaatcgttactggtaactgacgtgctaagtttataaagtagaagagaaaatatatctacaaaatagtcttctagttgtagaagtgccagtttttggaggtttcattctggtataatttccctaatatgatttgtgcaggaaaatagaaccattaaagaaacattggtgtaaagggttcagtagaaacaggatctctttaagtagaaaagcaaagccaaatgatggtctacataaaggacaaggagattcagatcctgtatggctgattttagaattttctttctccatggaaagcattagtttgtgacattaaattaacatgattcaaatgtatgcatagatatcaccaaacaggctggggaatatcccgtggaacattgaggttctgtgacccaggcccttaagtttgggttagatttcacccctggaaaaggcaaaaggcacagtacagggtgtgtttttctgggctgctgatgaaaacacctagacaggacctggcacgaagaagtgcccaaggatgctcaattgaatctgactctgtttggtgtttagaccctagaagccaggttgtcatcttcacaggctatgtttcaaattttatttgaagtcgtgaaaataatgcagtgaagactgtgttttttatgtagttaggcatcatctgcctgctgctttgcctgcactgggggtggactgagtctaaggggaggtggggagaggtgggcagcgaatacccttgcttttgtggcagcaacacctagtggcagaaaaagagtgagaagagcgaatttgcctttcccacttcagtgacagcccagaaagtaagcatgaatgcttctgtccctcagctgccctgaggtttttttttttttttttttttttttttttaactgttaagaaaattaacttccaatcgagagggaggtcttccaatgccaaatctccagttcatttttctctggtctgagaggtttgaagtggaaacattggctctccctgccgatctggtggcagcactcctgcttactgatgcatttgacaagatttgggataataacatatgacagtgcagctaggtagaaattcactcctttattttttgaattaggaatttcactgttagcatctttgaattgggagggatatctctaacgtccctttcagttcccaaaccgtagatctctgatttctcaatgagcaggaattgggttgaatgtgcaggatattatatttccagaatagtcagctgtttcatctgctgagaaaggtgggtgaggaggtattttaactgaatgagatctcggaatctgtctgttttctgtgcagtaacaccacactattccttccttcttatcagcaagcttatggtagctgcctgtcactgggagactgggatatcaaaaatgacataactaaccaaaaaaacaaacatgatgtttcgtttcaggatgatgaaattaaccagcagagccagctggctgaaaagctgaagcaacagatgttggatcaggatgaggtaaagaatgcaatatatttttttttccacaaagttcttctattactctttgttgttgatgtttgttccaggaatttaattggcatagaagcttttcataattacagaatcatgtggaaatttcttggtagatgtcccttcactgcctcttacaagctgattatcactgaatttagaaaataaatgtctgactttcaaaaacccctgatgttttgagattgagtagccagtggctacagttcgttctggaagggcagagacctttggttgggtgatcaagcaaggatgatccttttttatttttatttttttgagacagggtctctctgttgtccaggctggaatgcagtggtgcaatcatggctcactgcaacctccagagctcaaatgatcttcccgcctaagactctcaagtagctaagactacaagaatgtgccaccatacctagctaattttttaatattttgagacagagtttctctatgttggtcagggtgatcttgaactcccggcctctggcttggctcctgccttggctcccaaagcactgggattacaggtgtgagccactgcacctggccttgggcaaggatgattctgcctcctaatacccagcaatgctgtgacctgttgtttgagtcctacttcagttttgcaatcagcttgctcagatctttgatatacaccatgttctcctgctgtcctgtagggatacacaaacaaaaacaaaactagaaggtagaggaggggaaggcaaagagaacggggcccgagtactgcgtcagcatgtttgatacactaaaaaggaggcaaattgttttcagtctctccccaaaggcattcagttcttcagcaagtgtttttactacattgtgtgttgccaagtattttacaaacaagaacctaagcaaaggatagccagccaacttatcaaacatgcacaattaataattcccttgctgaggaccgtttaagtgttgttttcttttgtgctttaagttgctttctgcttcgttgctgaaatgctatggattggatcccactgtgcaatgacagcaggtgcctgggtttctgtcctcaatcccaggcctctgtaggcataaaggactctgtaaccatttccttcctctttgttccctttcatctctttaggacaatgattacctcccctgcccaaacacttcccttggtagggagataatctacacttttgtaatcaggtgaaccatatttcgttgatctctctctcttagctatagtcgaggccttccatttgcttgagtttcctgccctctacctcccattctactccagtttcacccacattggcacagctgcctgggataaactttacttcttgttactgttaaaactccttaacatttttctttttctatactatcaaggcagtatctgttcaatataggaaaatcaacttaggaacaaagataatgagagcgtcggcaagcccagacattcgcttttaactaaagatactgtttggggtacatccttctatatcttcatgatggatgttaaaaaaaaggtgactgaccactgttgtatactgttttagttgattgtgaagtcaaccagtttacaatgtgaaatcctgataacacttaaaaattatgtaagtgttattccttgtcatttccttggaaacgactctcagatcctttgcttatttatttatttatttatttatttatttatttatttattatttagacgaagtcttgctctgctgcccaggctggagtgcagtggcatcatctcggctcactacaacctctgcctcccaggttcaagctattctcctgcctcagcttcccaagtagctgggattataggtgtgcaccaccacacccagctattttttttttgtatttttagtagagatggggttttgccatattggccaggctgtttgtgaactcttgacctcaggtaatccacctgcctcggcctctcaaagtgctgagattacaggcatgagccactgcgcctggccccatcctttgcttaaaatatggaatagctataaaatgcagtgattttttgatgtgtaattctttctttgagttaagggtatacagctttaaactaacaacaacaacaacaaaacatacaaaacaaaacacatgcacacaaaacagatttttgcaataagaacatatctgtctttttcttttatttttttatcgtctggaccatacagtggggtttcccatcatcctgaactttttcaacttgttttcttatatctggtttttaaattacttacttttggatacagcatagaacataaacatttgaacattagattcacaagttccatgccatctcatttccccagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacggttggagcatttgtgtctagggggtgggacttccttggctgccgttcctgtactcatattgatattcattgacagacatggtataaggaggcagtggctgaatagttattcagtgttagatgcattctctgaggtccctccaacaattgaaatacttcgtgcaagtgacttttgttcactcttcctggaactgcatatcatgactgttttatatccagagaattaataacattagtggggatgctttgtgggaatagtcaaaagagtgcagactttggagccagaaaagtcttagttacaagtctgacttcataactcttagaccttagctgagacagttaagctttgtgagtattcattcccttatctgtaaaaatggtgacgatcatatgctgcttgcatggtgtgaggattagtgacagtttatgtaaagcacttagcacagatctgtgcatatgctacgatatcaatacatacatctcaaagcattgctactggcaagagcagggtcccatagaaggtatggacttcactcttcttgcttataccctcctgaatgaattccattccctcccgtcagctttttgtcctagctgttaccttcaggagcctggaactaagctgcccttgtttgtttgtttgctgttctaagccagtgcttcagcctgcacattcccttatttccagattctccaaatgaaagatgccataggttctgcagtgagctagcggtagcaggagcagtgaatgtttggcatggcggggtgggatgtgtccttttctacctggaaaatgggtggtggagaagctgactggctctaacctgctatccttagcacctctgcccaatggcctggtgtcctgggcttgtgcccagcctgctttgtggaaagcatccagtttaaaaagaagtagcagatggcgcaggagagtgctggtctgctgactgtgaggctgacaggaaatgctcctcgcggcatacattcagctccatggaggaagacttttctagcagcttcccaagatggggactactgcctctgaggattttaaaaacaagatgacataagcagttggcaatgccaaacaaaataaaacaaactcattcagaagtcacttaggaaagggggcgacttagattttctctgcttagtgttttctatgagattcttttaattagtccttcatgttacttgcttcttaaaacaatgaaacatttttcataatacagtttttaatttgccatgaaaccaaagtattactagattggtttagaagactattattagacagattgtttaaaaatgctctagctgcatatgggagaattgtataaatagataactgttttactgatgttaaacgttagttaagaatacataccttttggcaagatacatgaggatgaaaaagagatgggtttattaaagtttgacaagaaaatagagcttctgctatatagtaagaaaccaactattgaacgtaacctaattttgaaaaaaggtgaagggtgtttaattcagcttcactctgaaaattggaagacttttttttttgaagttgttttctaaacttattaatgttcttctgggccatctattctagacccatctgtctttatcaatttaggtgggaatatggaggtggcccagggagcaggtttgtttaggagtgaaggtggggacccttgcaggtaagtttagaccctgaaatgaaacagataggactgacatagaatatctggtaagtaggaagatgcaattacatgttataaatttaaggacttcctttttggcttaacttatttccctgacttggaaattgtcatctgatatgtagacatataatgtatcaggccatgtgatacaacttgttgataaagagttccccttcttatccaagaatgcagtgctatgcgagagtttgccttaaaaggattcttaggttgaagtcatgtaaaagaaatccattctacatgatggtgttattctttgtaatgtggagtgtatgaaattgatgggcaaccctttgaatttgttgttgaaatttgtttttcagactacattgacaaccacacagagagagctgagccagctacaagagcttagcaaccaccagaagaaaagggcaactgagatcctgaatttgctgttgaaagatctgggggagataggtggaattattggcaccaatgatgtgaaaactgtaagccagcccttcttttatcctctctacctgctcctgtcaagttagtagggtctgtgctttactcttttaagcattcaatgcttagcactgtgctttgcatctgccatgtgctggttagtgtttgaatgaatgaaaaaagggctaattgaatgactgagtgaattgtttgttggggtgaggaggaggagaaaaaaaattatctttcaaatctaggcagtgtcttcaaatgttggttggctttgtgtaaattggtttatttctcaaattggtttatttctcaacttatttcctaatgttgcagaagtttggaattaaatagcttaagcaacagttctagtctcagaattgtgtttttccttttctgaaagaacccagtgaagtgaaaattctccaagtcagtgtgaaagtgataggattctaacagtggcttaagaaataaaaccacatttaattattcacaatatgagaagtctaaaatcttgccactcagggtgtgatctgcctcacctgggagcttattggaactacagcctttcaggccccacctcagacctattgaatcaaaatctgcactttaacaagattctccaggtgattctttatgcttattaaagtttgagaagcaaattttgttttggtgccatggctcaacaatgtcaagttctcaggctttttctctgtttcctttctcctgtcctcagcttgtttccttttcataatccagaggattatgcctcatggtagcaaaatagctgctgtagtaccaatcatcacatcctcactcaaccacatccaaggcaggatgggctgaaaaggccaacttctttaatccaggagggaaacatatcccagaagtccccaggagacatatccttacacttcattggccagaactggatcacatgaccactccacatttctgggaaagcaaaggggactgggattactataattggcatagaccaatcatgatgaatcccttggggttgtacatattggtgctcttggttatttgtttatttatttatttatttattttgagacaaacttttgctttgtcacccaggctggagtgcagtggcgcaatctcagctcactgcaacctctgcctcctgggttcaaccaattcatgtgcctcagtctgccgagtagctgggattacaggcatgtgccaccaggccctgctaatttttttattattattatttttttaagtggagatggggtttctccatattggccaggctggtctcgaattcctggcctcaagtgattcgcctgcctctgcctcccaaagtgctgggaatacaggcgtgagccaccacacctggccattggtgctgttgacagcgagaaagtaagagatgtggggataataggggtggtataaagttgtccagaaactaggaatagaaggaagagatagagttaaaaatggtatcagcccagaacaggtaacaatttgctggaatatagaaaggctattgttgttattaaccaaaaagacagggtagagacatttttaaaacaaaacaaaaagctttattgaggtataatttacataaagctgcacatatttaaagtatacagtctgagaaattttgacgtatgtgtacagtcatgaaaccatcagcaccgttaagataatgaatgtccccatctcccccaaaagtatgtgggggcagtttctggtctctctattttgtttcatggatcaaatcttcctgccaataccacaatgttttgatcaccatagctttataataatacagcatcttatacaaaggagtcattgatgaatatatgttgattttgttgagctggggaatggtattacattgcttaccttacatgtcacaattccctgaaaccaaattctttgaatttagccattttatctttaaaaggctgaattctacatcagtctgcttagtggggacactcaggtcgtgagctgggattgttaaatactggaaaatgctcccaagatcaggcttccttttgtagactatttctgggaaatgttgaaagccgtttttggatggtgtaacaggtcccagcttagagtacatgaccgctcgtaaatgtaaccattctttcatggaacctttattgtaactgattatttcataaatccttgtgaatgaatctaattctagcacagacttctcagatactatagagttaatcttattaagcttcaatttggtgattttatatttgaagatttaattttttgaaccatacattggtgttgagcaataaaattcgatgtgaggtgattaaatggcctcacaatatgaaggtggagttgatatatgggaagttgatgcttgctgctgataacgataaaggaagaaggtatttttatgctaagttctaaaatagagctgatgaaaatgctaatgaaatcaggagtgtctgggtgcttcagtattgaaaaaagagtctttacctttgggaatctgaactatgattgagattgagattgtttttaaatactcaattggatatttttgagattatttttggattccagacattggatgtcctagttaatttcattgatagccatcatttctatcattctggtttttttcatataattatgagttcatcattagggtgataagagctaagggagtagttgtatgactttggatgagtgactgtacttctttgggcttcatttttctaatttataaaatgacaagataagctcagacagtatcaaaaattgtcggctcagaaattacttgacttctgcacatttgttttagatttatccttataggtacaggtacttttcttattggtcatgactatgaattgatatagtaattcttttgatataggaaaatgaacagatcaagggaatttgtttcagtggttttgtatttttattcctaaaatgccatttaattttcacaaggtccctcctggtagggctctgggatgggggaaaaatatgactattggagccttccccagtccacagttctagaatatgacagctctgaaaagccagaaaacagaaaaacccatatatccccagctcaatcatgtcttgaaacatttccagagtccagtcattttgtttcatcaacaaaacaagatgagtccagcatataacaagatgagcccaatgttaactttatcgaagtttatgagtgagccttctcttcctttcatgtactggtggcactgaactgtcaacagaagtatgatgaggtccatacatttggaaaggagagctttatttttcataatgggttgcagcctgcagggtggccactcttacaggttgggaagtgtagcctttggccagaagccagaaagaagcactttgaggatgggaagaatgacagggacttatgtttttcacagggtggccaaataaacttattcaacaggttacaggaggagctatgaagattcatgaaaggagtggcatgtgcatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttggttggtggttgtgttgaaattgcaaaagagaggggcaggggcaggctgtggttatcagcagtgaagcagtggagtgaatatttcaaaagggctggcttctgtttaacccttggggaagaaagcctaatgctgattggcgagggagggtgtatgaccaggcgtttccaacttcccaatctgtcctgggctggaactcggtatttaacatttctctggggtctccttggccacgagggggtctgttcagtcattcggggggttaggattttatttgtatttcttggggcctaccttaccttgctaccttcaaaggaatttagccagaacctgaatagaagttgaggtagagtaaatgaactgaattggactggctgccttattttcttttggcccacactgacttctttttgtcccattctaacttttatgactttaaatgtgaacatgcaccttacttaccttgggtgtggcctaggaatggcagtagttcatcatcgtgcacagccactccatgcttgagagatgggggtagggaggtggagaggtagggatgactccctgtataggcaggtagaagcagcaggccacatcttccatagatttcatgacggtgtggtcttttctcctgggttggtcattgatactggatcccatggtctagtatgtactactgggggcattatcagactctgggacagttataaataaaatttcagcagcaaactgattttttttttttttaaataacagtgtcctgaaattactggaaacttttgaacatgaaaccactaaatatatgaactttgtagtggtaagaaacctcacagttaaaacccctttgttaggggtattgtttttatccatcaggcacaaactcaaaatctccttttagatctccaaggacaggaactggcttcagaagttatagctctggtttgggagaagaaatgtctagctcttattttggaggaagcccatctttatacatatctatatttttactcttcctcaatttacatgggatctaggcataaaagacaaagtgtcctactttgacagacctggaaaagaagaggaattcattctcttcccagggtgccagagcttctggctcagcagcgttttcctaccaggagctggtgtaggctgtgaattccatgtggaagagatgggttttactttgtctttctgcagaggctggacaagatgtaagatacacctggtcaggctcaggaaggtgtttctcatccttctcctacactggactaaagacagtggcagaacacactcaacttaaagattgcatgcttttctcacccagtgtctccatgccattagaatagaaaaggaatatagtgaggagtggttttggtaggcagatctttggcagtcggaagtaaaatgggtttaacaaggacctccatgaaggtagagtcagaaatagatacttgtcaattttcttgctgttgacatacattctgcagtattgttgacactggagtcacttgacatgtactattgttgaacttttttaatttttaatttttatttcagtaggtttttggaggacaggtggtgtttggttacatggataagttctttagtggtgatttctgagattttggtgcacccatcacctaagcagtgtacactgtacccagtgtgtgctcttttatccctcaccccacttcccaccctttcttccaagtccccaaagtccattgtatcattcgtatgcctttgtgtcctcatagctagctcccacttatgagtgagaatatacgatgtttggttttccattcttgagttattaatacttcacttagaataatagtctccaattccacccaggttgctccgaatgccactattccattcctttttatggctgggtagtattccatgattttacacacacacacacacacacacacacacacaccacattttctttatctactcattgactgatgggcatttgggctggttccatatttttgcaattgcaaattgtgctgccgtaaacatgcacgtctttttcatgtaatgacatcttttctttgggtagatacccagtagtgggattgctggattgagtggcatatctacttttagttctttaaagaatctccacactgttttccatagtggttgtactagtttacgttcccaccagcagtgtaaaagcattccctgttcatcacttccatgccaacatctatttttttttattttttttattatggccattcttgcagaagcaaggtggtttcacattgtggttttgatttgcatttcactgataattaatgatgttgagccttttctatatgtgtgttggctatttatattgttgttgaattcttatggtaaggttgatgccaaactacaggcactcagcagtttctagtgtacttcatatttgctaccaaatttcagggctgatacctggttccatttttttagccctcaaatgtttactgaacagatagtgatatgatgagtgaatgacatcaataacgacataggtgggcactcagagtgtactgtggaacatcaaaaaaccacggttggagtcattgtctttcaaccagtggaagcctgtgtttctgcgctggattctggacagggctctttgttttctcttaaggtgctaggctgcactctggtggctaaacaaaatatgcacacagttacttgctcatttggtcaattgctcttaaagaccatgtttgcatttcagcggatgggtttctatcccaagtagcttgcttcaacttttgtttcaagtagagctttgaaacttagaaactaaatatagatcatgcgggaatgctggctgtcagaatcttcttttctaaggtggatttagactgttgttctcagatgatcttaaataatgagctagattactgtctgtttggaaggaacaggtgtgaaaaggcaaaggaaaatagactggtagtagtaatgaaaagttatgctgagaaaccttcatcaagaagccctttggtaattcatagtacattcttatttattcgattttctgtttaattgaggactacatagaaacacctttttatttcaatccttgtttatagaaacatattcaaggcattacactacttgtctacctgaataagcacactatagagaacattaatgaagttttgatttgagtttttataggaattcagcatcacctttcggagcattgggtgtcgctgctgttacagagatgtaaggtgtaagacattgaatggaatacctttttgaagttatctccttttaaaaatcttcagtgtttcttcttatgctgtcatttctctttctaaaaattgatggtaatgaaaaacctagttaattgaggattatatttagtagggggtttcaactgaaagtttcacctgaggtgtaggagaacttggggttgaatgtttagtactttccgcttgtcctttaattaggattctgaaccagaaatccatggacaccttggggatccaggggcaggtttccagggagtccgtgaacctatggaaattgtgggcaacatttgagtgtgtccccttctttgctcagttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccaggtgggcccttcccttccccatcattgcactcttgttgtcttgagatctgctccctccatgcccttgctggtgctgatggtgcaccttaggcttagttgagggactgctttgtgtaagcttggcctccccaggtgatggcagcccaggtctattcctagggctacattttgttgtgtgaaatagatgaattctgttgagtccgttccctttttcgaggatatatctatctacccatccatagatggatggctagctagctaatgaatgtaaaagattgggtggaatctctaaaactcctgtaagtaaggcaatattccctcatcttttaatctctaccataggtccactttaatatggaaaaacagaaactactactaatagtagtagtagcaggtggcattttattgagtgtttactatgtaccatacactgtgctaagtacttcacatgcattttctcacttaatctgaaaaaaattcctggtaggcaggttttattattattcctcagataggcagctgagatttagactaaatgtctgtccaaacacctacagcccgtgaatgacagagctaggactcaaaaaaatgtgtgtgaacccaaaacccatgtcttcaagggcttttcaagcccgagggtacatttcacttgcctattgagtaaggctgctcttcttcctattggagtggcattttcagtttaataaggtagcttcagaaaacagcaacccagtttctgggctaccactgatatctgagcttggtatttgggtctgacgtttccaggaggggtctagttgtatactacttgctgctttatgccaggcattaaaataggctgtcatttggagtaaacaggaaacagataccaacatggattggtgtgtcaaataatactgaggcggacaaaagcacactttattctggtatgcttttaaccataataatgtgtaatcatagaaacatctccaacctctctgtctaaaatggatccacaaggttccattttataaccagcataataagcagaaatgtattgaaaagattattcagtgctaatatgtgatagtaaaattgatatattcatacattgttgataaaagtataatttggtcagtccttttgggaagcaccgtggaaatcagaaaccataaaaatgtaagtataatttagtccagtaatttcactgacagtatttttcattgttaatgaaaatgaaaaaaatttatttcatatggtattctcatttcctgattaaaaatattaaaagcttttatgcaaggtattgaagacagtgttattttgcattataataaaataaattgcccaaatatccattgatagactaataagataaagttacatggaataatattatgcagctcttataaaaaatgtaaaaacctagccattgggaaagtctaatggtataaagttaagtgaaaatgaaaatgctgagttggatttatattgtgctttgcattcctgcagctaagaccaggaatatcagggggaaatagtccatagattggtttatggtttacaccactttttctggatttgctttagaactttatttttttatgattatatagttgttatttataaaaaattaaaataaaaatgatatgcattaggcaacagtgtacctcatctgtgatttctaggtcatctatgataccaaaagcatgtgttttggccagcctgcctctaacatttcggggccaaggcaagggtactcatggagaccccatggcctgcagcccaccctcttctctttcaagctggacataccagctccatgtccaactcccttttgcacccggtgtgaactgatggaactgttagatgccggctgccatttgtttaaatgggtgaggaagaggtagtgccagccctggccttcagacctggagtaggaagtttctaggtccccagtactctgagggtggtctataggggacataggttcagatggacatgttcctttggcctgtgaactctttgcttagtggagtagggtgtagccagaggagggcccagtggggtgctctgaatcgtccaggtctcagactgacactgactttgctgtatgagatcagagtcgagaatattatgatgtgttgagtttaaagagtacctgttctaaagttctctttctgcatcagcaacaaacacagcttccattaggtggaggtttgcactctgctacaattcatgcatagcaaagattcgaccattatttcctgaggttcaaaagtaacagaaaccatggctgtttatattctgatgtgatctaaggaatctgacacagtctttccagctgaaatgctatcttctttgtttacattcatcctcgtcaccaaaaactgtgcttataagatgactgttccaacggaggagttgtgttttctggagaggttatttcattagattaaagctcagtctccagggtcttcctgcctaaagctgagctccccagatctggagaggggagtgttctgtatatattttccatctgcctagaagttaccactgtccctgttcagccaacaagctctcattcatccattcatttcacgaatatttattaagcacttaccctcatggagctagcaagtaaaaaagacaagacaaatgatgtagacattaggtgctgtaagaaagtgttggggcctgagtgataaggagctagccaaggtagtgtgtgtgtgtggcatgtggtggggtggtgatggtggggagggaaagcttccagggagaggaaaatgcaaaggccctgagatgggaattggtgtgtctgaaggacagaaaaagggaagacctaataattgaatggtgaagatggaatccagaggtgcatgttcaatgaatgaggccttcagccctgcacttttcccagcccctttctctcatgcatgcttttctctgagnnnnnnnnnnnnnnnnnnnnnnnnnnnnnnnnnnnnnnnnnnnnnnnnnnnnnnggagaagcagaggtctgtcttggtatgattctgaacaccaaggcaagggtaaaatgggcaccatttggttgtggcactcagaaaagggactcaggaacccctcctctctcgcattttcctaccagacaattccaggccagcctggatgaccacttgctagtcattcactcttcctttttgcttgtttaaagcacgaagccaagatcaagtctctgacagactacatgcagaacatggaacagaagaggaggcagctagaagagtcccaggactcgctcagcgaagagctggcaaagctccgagcccagggtaaatatttgactaacgtgcaggtgtcaaacacctggcctgagtcagacagcctctggttggctggaatcatgatgtttagtttcgttcagttaaagcatttctaggtctactgcaaacaaaaccataactagaaaaaaaggagcgatttcttttctttctttctttctttttttttttttaagatggagtctcgctctgttgcccaggctgaagtgcggtggcataatctcagttcactgcaacctccgcttcccggttccagcgattctcctgcctcagcctcctgagtagctgggactatagatgcgtgtcaccacacctggctaatttttgtattttttagtagagatggggtttcaccatattggccaggctggtcttgaactcctgacctcgtgatctgtctacctcagcctcccaaaagtacaagagtcagccaccgtgcccagcctaaaaggagagatttctgagagaccatccccacactgaatctgctcatcttcccatttcctcacagtccacccagttacccaaatcagaatcccctgctccccacctcctgactctagttggtcaccagagccggtccatttcacctgccagaggcccctctggttcactgtccaggttaactaaggactgtggctacatccatctacccatgcccaccctcagtctgctctgggccagccactgtgtggcatcctgagggatgattctaaaattcacattctctctctgtccaaacggacacttctaacccttccatggcatcctgttgctcttaatataaagtttgaactgccgtggcttccctggcacccccttgaacaagctctaccctttgccagccagccttgtgatctcctgagcttagggaagtgcctcgcacataggaagcacttcataaatattaatgaatataagcagaaattcaagagaagggtctagaaatgcagaaagtagaacaggattaagaatgtatgtgccatgcaatgtgaaactagaacatatatattatgggttgcaatgaaaattgttagaattttctcagaaagccatttgaaaatacatattaataactgtaacatttttcataccttttgatcatcacacctcagatattcattgcagaattttagatcagcaaaaaagaggaagccatctaaatgtctaatagttaatacactatggcgtgttatttaatagaactttttcttcacatgaaatacatgaaggtgtgcagcaatgtttatgatgcaatgttaggtgaaaatcacaatatatcattgtattcttactatggttataactattaaaaatgaatggatgcagctgggcacggtggctcacgcctgtaatcccagcactttgcgaggctgaggcgggcggatcacgaggtcaggagttcgagaccagcctggccaacatggtgaaaccctgtctctactaaaaatacaaaaattagcagggtgtggtggcacacgcctgtaatcccagctactcaggaggctgaggaaggagaattgcttgaatccaggaggcggaggttgtaatgagccgatatcgtggcactgcactccagcctgggcgacagaacaagactccatcttgaaaaaaaagtgaatggatgcttgtgttcctaaaaattcatatttaagataaaagtggttgtgatagggtagttgggattggtgatgctgttatcagtatttatatcctttattgttgttttacagtttgctcagtaaatgcaatttgtgtcagacgccaaggcaaatttaaaaagaaagaacatacccactctctgctctaaccttgtaacatgttctttgtgtggtaacacatggcatgttaggagtaggtgcaccatcaaaactgcacatggaaaatcatgtttctctcttgcatccggtggttcctgcagtggggccactgagttgaaataaaatagaggcaagaaaacctgaagtggaacagactagagagaaataatgaattgaatgtcactgtcgtaaagcactctgccccctggcaccccagctccccagctggggctgcccattgcacctggctggcatttagggagcaccatcgaccaagcatatgctgagacaggagtgccacactgcagccctgccccaaacatggggccttctggtttaatctcaaaaatgttatgctatctttctgtttcccgtgttcccatcctggaaacagagtatgttttcctgccccagattcttagagaataaacgcctacccatgggaggtaaattaggtcttcctagaactcccatcatggcatgggtccacaggccacctaacagtcacagagggctttatcatctgtaaggcccgttcatgcacatgaccttgggctgctcacagagaccaggtgggaaacaagccctcccaggtgtgcggtgacataaagccagagtgcagtcctaggagggccgcccccagtgagcattgtcccccagtaagcattgtcccctgcagttgtcgcgctcccccgtggaaggaatgcttcaggagggggcagccttggctttagccagaagtccttgcctgttcctttatgccatggttgtaattgctgatataagctgatgtttcactctgttgccatttttcttgctttttgttttttaatttttgcttttgggtgtgagtcccaccagttaagtcttaaatcatcatttaaaattcaaaacagaaaaaatgcacgaagtcagcttccaggataaggagaaggaacatctgacgcggttgcaggatgctgaagaaatgaaggtgtgtgtggctgccccttccatcaagcccagtgtgcatttgatgcatttggattggaaatgcttgttctaggaaaatctgtcaccttcagatccgtatatggcaagggacaggggaggggctgttgttgggcattcagagtcgatctcagagtatagcctggcttagaaatgaacaagtccagaaaccccaagatgtctgtagagaatggttaagttgcgttaatacctttgtcttcaccattcctgatgaagagggaaagggtagcacccccaatcactgcatgggctcttttgtcggagttaacttctaaggatttcttcctccaacctttacgcagaacacaccaaatttgagtttctatctcaaacatagagatttttcttttggtcacattttaaactgtaaaggaaaattgattgtggagtaagacttttaggtgaataaaatgagacaggagaagatgtaggattttgattagttgtaggcaaactatgagcctcattgagtcaaggtccacagttaaagacgtccacggcatgcccttgctccagccagcagaataaaatcatgcgtcgtgggagtccctttcctgttttcagagtgctgttgccaaaaggtctcctttggacatcatcataaatctgtgcagtgggcagggcaggggcttttatctcagttttacatgtgagggagtgcagctcacacaggttacaggcttatctggaggttacgtggatagggagaggttggtgccctctgactgacctggctggagaagctcaggctgggctgtaaaaggtcaagggaacactttttatttagttggtgggctaattggcttctagggccaacttggtttgataacagatcttgggttttgttatcccaataaagcaaggccgggtcctgggggcaaaacagccagaaatgcccccagttttgggatctgacatctgagggacacagggaaggaggtaggtccagatccagggcttgtcacagagtgggctgagtgccaacgagtagatgacatgtttctcttggcctgggatgcagaaggcgctggagcagcagatggagagccaccgggaagctcaccagaagcagctgtccagactccgagacgaaattgaggagaagcagaaaatcattgatgagattcgggagtgagtcggcccagggcaccaggggtgtgggggtggtcatgcctcggtcctcttggggaagcctggaaggatgtggctcttagtcgagggccctgctcaccttgccctgtgggcactgccctggtgacacagcaggctgggcgggctgcttccaaggtctgttctccgatctggagctgagcctcctggagccctggcatggcaggtggcaggcgggcccagctgcctctcctagtccccgagggccagggtcacataggtgattccgctggatggacgcatgccccagtagatgggggggagcatctgtaatgaaagcaccaaaaaaaaaaaaaaaaaagaaaagaaaagaaaagaaaaaaaaaaaatttggtcctgactacaggattctagtaggttaataaacactcgagagaagacagcaccaccgcctccccttctccccctacacatacacgctcactgggcaacccagccacctggttccatgtgctcacttcttagggccccacactgtcatgtgtctgtgcaggtagaggtgccagtgacctgtggcactgccaccaggatggcatcattgcagtttctctcaggtgacaccccctcatgttgtgctcctgccttgtcgcagcctctgacatgccctctgctccttcagaataatgttttcaaatgctctgcataaaagacctgggattacaaagaaaaccaattatattgaaatgctgacctccccacccccaccccacccagggtctacactgttccctcccctcccgctttctgtagatgaagaaacagatttctatatgggaagcaaggcgaaatgatttacttaaggtcacattgctaaataggaatcagattggagttagactttaattctccagactactgatccaagtcccttttcaatgtgtgtgagccgctcgaaaggtgcatttgcattttaaaagaggagaatggtaacccaagcaaaagtctaaatggtgtgacccaggctcggtgcccagttcctgaaggaaggcacttagcctcctccctctttttctcctcttcggccatcccctgctgttgccatgttgtgcttttccccttcagggatatctcacattcgttattctgattaatcaccctcacagattcgactggaagggagggggaggttggagggaaggaagagggagaaagagggttggttggtgagtgagttaggtggagggggaagcttccctggcttgtgcctttcaaatggactctgggttttccttctggtagtgcatagctgttcctttacaggcgcttaggcgtggctctaggaaaggttttatgagtcctgggctgatgtaaatgttgaccaaacaccctcaaccagatggcgagtttctgtttgcagcagagcccaggctgtcttttcttcataattctctctgtgcccactcctcgagggcaggaactgtccctgtatcagtgaggcattcggacttgggagatgtttttagaacatcagaccagaaatgagggaaggtggaaatggccaaatcaggttccccaagtgactgcatgccatccgaggggccgaggaagcagagttcttctgacatgggctctctgttttaaaatatcagcccttctcccatctcattatttttcccctgaagctcttgcacaagcaaactataaatacatcctcaaagccttatgtttcatgactcttagatgcaccccagaaattagttttcacttgggcacggaggaagctgtgaggctgttctgtgatccctccaaatcctgcagaattactgcctttattgtacagagctaatagggttggaacagaaccacggttttagcctgatgactcagaatttcagactgatgtggaatatattgctttttcctctcaatttcagtttgaatcagaaactgcaactggaacaggagaagcttagttctgattataacaagctgaaaatagaggaccaagagagagaaatgaagctggaaaagctcttgtgagtgcactctaaatatttcctctattttctctcatccccatgatattctggttagattgggctaatttaaaaacagacaatggctatttgtgtgcttgttggtgggttttgttgatttatctgtggatgcaaatagtatctgctgaaatctctgagtcccctgtggtggtctatggttcctttttgtttttcagattgctcaacgataaaagggaacaagccagagaagacctcaaagggctggaggagacagtggtatgtcaagatatttcccgatttatgtttgtctccaagaccggattcatttgtgatttgtcggattatttcaaaattttatccatgcacacctttctgtgtaatgttttagataagacattctatggaaaagtaggatttgtagaatttagtcctcaacttttcacagaatcagtcaaccaatccatctatccttagagcagtaacctggagcccctgagtgaggattaagctgaattgcaacttagcaattttacagccctgcactttgtgacatacttccactcaacattcaacagatatttattgagcatctcctaacggctggcattcttcaaggtgcttgaatatatccataaacaacagagataagatccctgtcctcatgaagcttacctttagctgtgggagacgataaacagtaaggaaacaaatcttgcactctatcagattgctatagaatgtgcataggttggtgcctgggggaggctccatgaggatgtgacctttgagcagggactcgaagaaggagaagaactgagcacagagatgtgttggggagagcattccaggcagaggcaacagctcatgccaaggccctgagataagcccgggactgtcctgttgggggccagcagggaggtttgtgtggctgcagctgagggaaggacagggatataaggtgagcacagagaggtaaaggcttcagtgattcaggccaggtaaaaccttgagacctgcagggctttgggtggaggagtgatgggcccaacctacctttggaagggcttgttatttgaaaccctggttggttttctctgtcgtgtgtctgggtttgttggcatcatctcctctggtcggcttccatttcagctgctctgtgggatagctgcctggctccgtgccccacagcctgcgctttaagacagaccattctaacatagcctctccatttggtgaaaacacgttcaggcatttcacatgattcaatgacagagagaaaccgttggttagatacagtcatccattttggctccgttcatgggtcatgtggatctgtgtgggactgatccatcttcaaggacctggtgaccccacattggtgggaactggttgcttgggtctggccctgagattgtgctctggcccatggactagtcatatttgttggacctcaaagccagggagaggaaatgagggcaccagccattggagacagaagatgcctgtgtccaaagggagctgggcctttggagcatggaggaggagcctgtggagggggctgctgccggggaacccgaaatgaagccatgaaattgcttcatctacatctgttttaccagagaagtgataatcctaattatagataattatagaaattcagaaaaatattgaacattaaaatttcactatatttctaccagccagagatcagtgatatcaatgaaatattttgggatgttttcttcctttatatccgtgagctctcaggcactctcaccctactgtccctagccatccacgctctctttcagtctcactcacacctacaactcaagcatgtgagcacatcatcacacactcacaccggggctcacaagtcccttgcccacacacgcagtcagctgctcactctcctgttctcatgcctctgcgcagccgcactcactcctgcatgctcctccatacacaagtacttacaacacacactcttgctcacacacagaacatgcacacttgcattcacacacacaacttgcatgcacactaatgatcgtccacactttctcactcgcacattcacacaatcactctcgtgcagttctcaccctcactccccttgcttgccttcactcacacccacacgcatgttcacactcccttgtacacttacacagatgctgtctcaggacactccccctcacacgcacgcaggcgcattcacacccgtcactcatacactcattcactgtcacaaccacctccgttcacaggcacactcatttccatgctcacggactcacatgctttctcctctcatacactcaggagtgtgatatttaaagaatgtttcatcagctcttttgccttttttgaagttcgagtggtcttttgcgtcttttgaatgacgtattttcctcactagctcctcccgtctccctgctcgtccgttctctctcccacgctgggcgcggttccatgcgcaccctcccaggctgctccccgctctcaccctcgcccagcccatgcacgcggacagacacactggcttcgtggcacccacattctctccctcactctcaccacccacacgcatcaaatgcacactttaaaaatccaagagtggagccctgcagtgtatgccgttttagactcggatgttttcactcagccttggaatcctccccgagccgtaaatgttcttcagaaatagacgcactgtccttggctgactgttctgccgccctcctcagcgcagggcccgttctgcctcctggagtgtttgggtgaggtgggcggagcatggagcctgctggccagggggtgaatgcccgggaagcccgctgcaggagacagtggtggaaaaggccaactggccgtcggggcatccctggccccgggcagctgactggctggaacaggacactgtctgggctttggggcgggagccctcctctgggtgcgttgatgagacttgtattccctccttgctggtcccacccttgctgtccactgtgacaggaagctgagccttgagctttggcatggagagtcacaacctgtgatgtgaagagggacatgtgtggggaggcagagggatgataatgaatgtgatggaggagaaagcattgccacaggaggctgaatgatagttgcctaagcacagtgtgcataaataaaagggacaagtgattttaaatgatttatactacccttcccaaactgtttattgttgaatctccctaaaaacaaacaaaatgagagaaagttgccaaactcaggactctatatttagtatttacaccccaggagatgcctgggccttggacaaagaactgttctcattcccctttggtgtggtggtgtttttatgaaaaatgtaaactgtgattacggttcaatcagtaatgaaaccactgacaagaaacagagagagtgcatgcagggtgggcgcaggtgttaaggagcagggtatctgggctgagctccctccggcagggcctgggacagtgtgtctgtaacagagtgagtgctgcacccctgcccctgggctggaaggcagcacagcctcaaacaggtcctgtgtgcacattattcataatcacagatccatttggtttcctgcagaaagtaatttacctcatccgaggacacaattgacttcaggtgcttcttatttcaacacagaattggacccagtaataagaccttaaattaacagagaacctttattgcaagaaacttagtgtttccgtagctttatagtctgtttcttccttttagatgtgagcgtgtgtgagttgcatcccttgaaattctgtgttaaagtaggtcaatttagacaaagtttgcatgcagaatttagctctctcctcttcctctataggaaaatattttgcaaggaactgatcatatttcctatggtaaatacatggagacttgagcagacagaaatgtttgatcttctgatcttgttaacaaagatcaccagatttggctcaggctcttgtctcagtaatctaattcctaaggtttcatttgtagaaaataatccaaaatgaagggaaaaaatgcccccaagatgacagtgaaagttttaacaacaacaataaaaggaagcaatacaatcctaatgaaaaaatggcttttatgttatgaaatatgcatcaataaattcatactagtcatctttattgggcacttaatatgtgccagaaaatgttctaagaacattataaggttcatctcatttgatcttgacagcaatgataaggcaaccactgtttttattctcatgttaccaataagaaaactgaggcacagaaaggttagataacttgcccagggccacccaggaggaaagtccatgaaatgcctcatccgtaagctcagtgacttaaaacaagcaagtgtgtggacttgcgtctgaagcaggtgtggagacaggaaaaatgtgagtcagttacggtgagatattgtggctaacttttcatttcagcttgttggtattacattgtaacatttacataataaaaaaaagaaaaaaggaattcaccctgatacaacatagcccagtaggaatttttgtgaggaaacctttgaatttttgtgggtgaggaaatgtgtggttccactgtgagcagatgggcaggctttgttctggtttacaatttgtggtctgggttctcaggctctgcacctcaaggtgctccagtaatgacactaggtccaggggtgggcatggtcagggtgggggtgtcacagggaagggggtgcaccagcggcgtccatggcaggcttgggaagtgtcgggggaatgatcatggtgccaaatgtgtcataaattcagtgaattgctgcacttaagtggcctttaaaaatctcttccagtctagagaattgcagacactgcacaaccttcggaaactctttgtccaggatctgaccacccgagttaaaaaagtgagttctctttgtctgaatgggactgagaagaaaatcaaagatggcagggaagaatcattttcagttgaaatatcacttgcttaagtcggggctggttatgcttaaaaattaattactgcacaccagagaatgttattaaaagaatgtgctggaggcaaaaaatacttggtaacattttcccatctgatttttccttcttggtaaaaggaagtcagaatactttctctggccttcatttcaaatgaacgcatatttttctggcccccactgtgtgagggcaactgctcttgacacagaaacatttagagcagtcatttcagaaagcattgcccagaagcctggagaagtcggacagagagagcctcttatttgtttgttaaaaggccattaggggctaggtcagagtttataaagcacgtcaacatccagtattttatttgcttttcccagcaaccatgtaagtggtgcttagtgttcctgtttctgcagatgtggagataggctcagatgttaaataacttacccaatattgcactggtgggaagagccagagataggtctggaacccaggcctgcggggtctctggatctgagcttcttccatcctcgtgctacagcagcagtctggagacactccataatggtgactcccccaaacagcttgcagaggtttaaggaaggagtctgtttaagaaaagtgggtgcatatgtgtgtaaatgtgtgtgcatatttgagtgtgtgtacgtgtgtgtgtgaatgtgtgtcagtgtgaaggagccaagggaaagaggtcaaatgtcttacaaagatagagtcgggtctgagagggagagggttaatagtgtagatggatgtattagataggcttgctaaggaggagggacacaaattcctagaagggaggagtggagaagtcaagttggaaggatcggcagggaaatacatgcgggtggaaagaagtcacatttgatgacttgggtcttcttggtttatgtgaaggctcagtccttggtggggaagtagggaagagaatgggaaacccaaggagactagacatggttcaggctgccaaggtaggggatgtgctatggaagagtagaaggattgctgagcagtggtgttggtgttgagttagaagcatgggcttggcgtggcccctgacagcatggtttaagtgagtttcgaatcctggaaatgaaaataaagaaggcagaaaatgatgggcaatttcaaggcctgcatggcaatggctaggcgattaggtagtaagcacagaccaaaacacaaatgaccatgggggcctggccctggcaggagagtgaagccagagcaaaggtgatggacagggaggctagagaggggagggcacctggccagaggttatgacatggactgaaaaggttcagtccgaggaaggaggtggaagccatgaccatacatgggaggctgtggtcctagggagggttaggagcttgagatcagacttccagatttcatgatagaaaactccctaggaaagccctgcttttagaccagtgtttttctgccggtggttctctggccatcagcctcagcatcacctaggaaactgtttagatatgcaaattctcataccccaccccaggtccactgaatcagagactagggatggggcgtggcaatctaagtctcaacaaaccctcccctggagagcccagtgctaaggctcaaatttggggagctcagttttagactgaagagctgcaggtttgagatgctcatgtagccattacctttgagaaaaaggatgatgatctcttctataatcagacagagcaaacctgcttttccaccttggaacactgggatgtgttaggacctgtactttccaatttatctgtgccactcggcttgccaggagtgcagtgttttgccaatttcaagatctgataaatttcaagaatttacccagcacccggatgctatgattaatttgagcctggttcattaattaattttatagatttggaagctgaagggacaagcagaggccattaagacttcccagtgggaccatagacacttgcttacaagtttggtgacttgttgtcccaccatgatggctgaaatcaaatttaggtcctgggtttatgtttttgcagttgttgtttcttaatgagttttggaatgctttcttttgaaaagaagtctctatttactacatgaaaggcagatgtatattttactgaagataaatcatctacaactttcaaaagcagatttgaaggagttttttttttttagctctctaaaaattagctcctcaaatcgcttttcatactaataagggaaattaattgggggatttcttgagtctaaacttttagaacctctattttcactttcagaataccctttggtgggaatggggattttttttttccatccacattatcctggggcggagggtgggtgggtgacagcctgtcctgctgaccccttggtgtcaatgcagagtgtggagttggacaacgatgatggagggggcagtgctgcccagaagcagaaaatttccttcttggagaataacctggagcagctcaccaaagttcacaagcaggtaggagagttctgcccgctcccctctgattccctcctctctcctggaaagaagccccaccaggtttggccacagtgtgcggagaaggcactgagattgaaggtaaaagaactgtacactatcagaggacatgagggctggaaaggtccttacaaatcctttagttctcagtgacttcccgtatatataaaggactttcttttatcaaagccaaatataacgcatagggtttgagctctctggggttggagagggaagtgttcagaggcctgtcttttcatcctgcctccacccctgactttggacaccatctagcctctgtgtctcccatgacacctctgaggtacctctgtggacctgaaagtggacaccactgagctggttcaagtcctttatttttacagatggggaaacagactggtgccttgcttcattgcaccgtgggaggaccgggactggaaccagcaccctctctgctcagctgcccattcctagcgatctcagatgctctctcggatgcctgcgatgtgctggcatttgtctagagtgacagagagtgataactgtgtccaaactcaccagtgatttcagcaggtcatttgtcttggatactttctttttaaatgttggtgtgtgcatggctgttttccctctttaggaattgggatgtgatggaaacggcccaagtttttagaccacatggccgaggagatgtcatttctctttgacttgttaagtcttcttcaatattactgatgatggcattttttccccagagagaggatgatagattctagatagttgaagtcactcaaacaaattgtcgatgagaaatacgaaagcagaaactgtcagggagcttgaaatagggctctgagatgcatttttaaaatttatttttatttatttttgttttttttaatgttttttttttttttttgaggcagagtcttgctctgtcgcccaggctggagtgcagtggtgcgatctctgctcagtgcaacctctgcctcctgggttcaagagattctcctgcctcagcctcccgagtagctgggattacaggtgcgcgccaccactcctggctaatttttttgtatttttagtagagacaaggtttcaccatgttggtcaggctggtcttgaaccactgacctcgtgatccgcccaccttgacctcccaaagtgctggaattacagacgtgagccactgcacccagctgaaatgcattatcttattcatggattgaacgagcatttattaaaaatgtactctctgccaggcactagagctggtgctaggagaacaaagcaggagacccagcagtagctcactttggtgtagcactttgtgattttcaaaactccctccatccatctgggtcccctattatgtagtacacttgtgttatagatgagaaacttgagacttgtggtggtcaaatgacttacaccaagtcagatggccaggacataaagagctggcccttgagcccactcctacctagggctgggctgttgcttcttcaatcagcaaaaaggcgcagtctcctcctcttaccttagcctctggatgtgttgcaaagctgggtccaaaccccatgccagtgtaaacagcaggttctgcatggaaggaagccctctgagagctcaggaacatgcttgtttttcactgagtcctttcaaaccgactttaagtgtttcagctttctcatgctaatttagtattctcatatgtggtcgattttctcacacaatccccctttcctctacacacacccaaacagaagaggaggtaaatcctgcctcagatggaaagtttcttgtggtgggaaataggttttaattgtatccccaccccaccgttccttgcaccctgtgaatcacgtgttcaggaacctggaccccacagtctgagttttcctttcctttctgtggttgtacggagtgccaaggacaacctagcaggggccacctgttcagcagcaggggctgcttctggctgctctggtttgtgcaatgctgcctgcctggtagtaactcccttcctttatcctcctgccccagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcggtacgtgcgtgcacagtggcgcccggggtttgagaagctactgcggcctctcagctcagatttgctaaaaggtgaagacagcgctggcccactctggaacatctgaaaggctgggttggagcccgcaggacgcagccctcaccgcaccctgtgctcaccctgtgggaatgggaatgtcaggcgcccccgttatcctactctgagatattccagcatacatcgtggtctcaaaacttctgagctgggcagagagaagccagccaaggctgtaggcctaggtcttgggctataaatgggtacactcttagaaatactggaataggaggatatttctctgcaaggtgtgaagggccctgtgttctgcacccggtgggagcatgaaggagcccatatgtagccagagccccagggaaagcctccaagtgcaggtttggaaatacccctggaagagccaggctggcatccatgacagggtgtggctacaggctggcacagaacctggggaggtctggagtctcagcctcttcaagacctgtatggatttgggcattttgcccatgtaggaaatgagggtgtagccagagtcctggttcccaggatagccatagggacaaaaacaatttaggaatattctctaaacagcttcttctccttttttttttttttaaattgaaacatctccaataacatgtaatttatttcccatcagatattgctgtgtagatgtattgcaaaccagcagtttcacgtttctagttttaaatcataccttagaatagtggttcattgcatgtgtaggatttcataccctttgagaatctattaaaagctatggaccctctccccagaaaacagcatcacaggcagaattctgcatccaatttcaggggctacacagatatccttgaaagtcatggggaacctacgatccatttcagatgaaactgaaaatctttttttctaacttttcttggcccaaattagaaatgagctaattgatgtttaagttctttctgtcccctaaatatttggatgccttggatttgctaagtatactgatagttttcccattttcagagagatctggtggttgataagaattgtactgttggtaagaattgtgacttttagttgtcacaggtgacctgtagatatcagggttgctgttaagacttttctaaatgtctgttctctcttctttctgttggttggatacagccaagcccatccgccccggacactacccggcctcatctccaacggccgtccatgccattcgagggggaggaggcagctcttcaaattccactcactaccagaaataaatacaaagtgagtcccatgtcaagggtggtttctctatctggaggcagaggcttcttgcctttccaaagcccctgcctggcagtggaccttgagtagagaggagttctgctctactccagcacacaccctgggggttccaggtaaacagagacccagacctgtcctcacttagtccagagccctggggtcttctagctgaggctgtctggggcccatgggacctggagccaggcccggcctaatcccctccaggggtaggggtggtgagtgattcagccgagctttgttttgcctgtgggactcccctctttaattggcatcccaaagggcattacctgtttgtcaactgctttacccacagcagacagaagttgggggttgctttaagtctcaggaacagaatataaagaaagagccagataatagaaagtgatgtttttatgtttactatctgaactcaacaagtggggattttaagaagatatctagatgagtccaggatgcttttttctttgagatggtggtctgcaagcttctctacccacaacccatgtgcacgacatttctctcccagcaaaaagaaaaggaacgagtgatattctttccaaaagagaagaagcagagagcgaaaactgtcatcctgatggaaatggagaaaagaggttactagttgggcgggcagacagatgactaggtgaccagaaaactttgtttagataaactctgactttgaacatgcagatgggaagaggtggctctgaacattgtccttggactctaagcccttgctagggtagctggctcccaaggcaggcaagcatgcaaggtgtgaagcctggacccctcctcatccagtcctttctgcatcaaggcaagaaggtgagcaggaggggctggagccatcactcagggtcccggcatcgcccaggcataggctaaaacttccaagggaaatgctttggtagttgcccccacacaacttttacctgtgctgccccaggcagtgccaacgagcaggccaggggctggtcagagtagtgggaacaggagggaaggcggaggcagcccgcgggcgggcagtgtgcctgccatcatctgccatcttctagacaggaaaatgggaaatggtcttggcggtgggccaccccattcctatctaatctctgcttccaatcagaaatagaatgaaactggaagttagaaagttgcttttgactacatattgtcagtatcgaggctgatacctgaagggaactctaagatccagctgggcagcttagaacagaaaagcctgaagcagtggtcatcgaactttggtggatgtgagcatccttgagcacccagaggcccaggctccttagaagaggaagggcctgggctttgtttgtctttttaaccaagtactccaggtgattctgatattcatcgaagtttgaaaactctccatggtttatacaggatggcggtttacgtctgtcttatgtaagggaaatttgaaggtggtacatcagtagttaagaatctccacagtgaaaacagaaacctagcctcttaactaggttaagcacgtgcctgcctcctgaactcaaggccagctcaaggtcaccaaatgacttcagtttcagccatcatgcctacattccaactttagcaaccagagaggaagcagagaagaggcaaaagcagccgtcctgaatgaatctcctttaagtagccttcctgaagccccatgcaatgctgatgcctccctttccctggacagcactgagccacatggccacatctagctggaaaaggtagtcttttagctgggcacatcactaccccaaagaaaggtaatgcttttagagcaaggacagggagagtggatgttgaggtgggcagctggcatactgtgcattatggaccacctaatatgctgcagcactgggctagatgtaatataggcatcacctcatttgatgaaagcacacatagaggtgtatgtgtgtttcccagcaaggccttactaaatatactggtccagggattctggggtccagagattgtgcagtgggacagtcaccttcttcatgggttccaacaaaggtctgccagtcccatattttatgtaggctccaaacaaccaaatgctggccattcatcaccagtgtagcctcttctcatacagaagagtgaaaatcagtaggtctggggagactttcaagaccttcggagtgaaagaaccaccctcacccattgtggcatttttttttaattttactttaagttctgggatacatgtgctcaatgtccaggtttgtcacataagtatacatgtgccatgatggtttgctgcacccatcaacccatcatcatcttttcgagatggagtttcactcttgttgcccaggctggagtgcaatggcatgatcttggctcactgcatcctctgcctcctgggttcaaacgattctcctgcctcagcctcccgagtagctgggattacaggcatgtgccaccatgcccagctagtttttgtatttttagtagagacagggtttcaccatgttggccaggctggtcttgaactcctaacttcaagtgattccccccacctcagcttcccaaagtgctgggattacaagcgtgagctactgcacccagctggcaatttgtttctttactcaaagtgttacaagtggttttgatggttttatctgaattcagagcctccttgacataccttctccacacagcttcagacacagcttctgtaactaggtgcttctctcaccaggttacaaaataaacaggccccctcttacagctctcaggatggcagtgtggctgaggggactggcattggacaagggacctgggttcaggtgttaggtcttccacttccttcaagttacttaaactcaggtctgtttcctcatatatgaaatggggaaaatcttttatgttggtcattggcattgacagaaggcttaaatgaggtcatgcttctaagcccataacaattgctcaataaaaatgttagctgctagtatagatgagcactgcagaaggtggtagttgatacatgttggtttatagtgtcctttaattcatatagttgttactaaatggtttttagttcctctatagcaataaatcctggcgactggatagggaaggcctatttctaactgagtatcctagttgttgctatgaactgacataagggcttttaaagataatattggccgggcatggcgggtcatgcctgtaatcccagcactttgggaagctgaggtgggcagatcactttaggtcaggagttcaagaccagcctggccaacatggtgaaacatccttccctactaaaaatagaaaaattagctgggcgtagacatgcacacctgtaaccctagctacttgggaggttgaagtggagaattgcttgaacccaggaggcagaggttgcagtgagccgagattgtgccactgcactccagcctaggtgacaaagtgagagcctatctaaaaaacatatatatataatttacttatctacaagctatgactatttttaagaaatgactgggcatttgtcagtggagattaaaaaggggtagtaatcaacagattcaggaattgcaattgaaaagtaaagaaatgctaaatcctttttgaaaagtaattgaaaatatggaattcattgcttagatgagagcaaagcctttttgagacagtctttcctgacctttgggattttcattctgaagtatctcttccctgggtagaaatgatctcaattgtgtcttcccagccctcctgtggagtcaaagcacatattcttacagctggatatctttggaatttccttctgcttcatttcagggttcaagaattatagccataatgagtattttggtttattctcaaggtttcagagcctatgaagatgccaatatacaaaaatcaaaagaacccaggataatgctggctttgatcttatctggttcaaatccacagggggctgcctcaggaggagatgatctttttcaaaccccagagctacatatggggcagtgcagtgcaaccatgtgacattgggcaagttacttgatttctgtcagctttaggtttcctaccggctaagtgggatcaggcattgagagcctagctctgtacttggtttcacagtgaatcagacaagaaggctgtgttcttgtccagtgatatgcttgttaggggaagatggacagaaaataaggtaacttcaagtagtggtaagtgctcagaagaaaacaaaaacaggctaatggaataggaacactgttttagaagagggggtgacatttaagttgagaactgagtgatgaaaaatgccaggcacacagcaacctgggagaaagtggttcgatgatcactcaaaggtaggaatgaatgagggttatttgaggaatgttaccaaggctgataaggcagtagctcatggatctgggagaacccatcttcattagagtggatggggagggagttgagcccaagtaaatgaaggtgttgaagctgtgggcaacttagattgtagcctagtgtgaggggccactggggctgtgggcgtggaagcagtgggagctggttcatgattagacaaggccactctgggctggaccctgaagaaggggtaggaatggggtaagcactgggggttgcctagggcgtcactgtaggtggccatgggggagggtccggtaccagacccaggtggtggcagcaggggagaagtggcctgagtcagtgcctgcttagagctgattcagctgtcaggcttactgatgagggttgagagcaagaagaggaggaaggaagggaatcaaggtagttcctagatttttgtgggctctagcagttagggaaacattggtccctttttaaccatgccagggaaaatcgggggatgagcaggttttgtgggaaagcttggtttccatcatgttgcttatgtgctgcctctcagacatccagctgagcccaccacgcaagtgggtgtgtggaacaggtggctggatccgtgggtctggagcacaggagagaggctgaggtgaggccagggctggagagttgtgacttgtagattgtgtttatggccacaggtctgaaggaggcaacctagagaaaaggtgggcacagcagagaggggagctgaggggcgagttggaccaggcccaggcactggaaaatgggaaggccagagaaaagaggtggcaccagcagaggggcctgaggatcatgtgggggcacagaggtcaagtgaagaccttgaccctagaaggaaggtggtcagctcagagcttgagtaagatgatgacagagactgggtggttgaagaaggccaggtggcagtgaccttagcatggactagacagactaggtgaggaaatagagccggcagctgaacccactttgggggttttatttgaaggagatcagagaaatggagcgatgtggtggtaaggtggggctgcgttgcttttctgttgtaagatgggagatattacagcatagttgtgtgcgatggtgatggtatagctgagctgggcagaggaggaagcacagctgtgggtgggcggtagatggggtgcattgggaggcaagatccaggtcaccttagagcttgttttctcgtgcaggcaagaagccagatgatcagctgagagagagggaggaagcagggtctcgctcttgagaccagagacggtgtaaaatcaacctctcaggcagtgctgagtcttctttgcagccccacacttaatgtagacacctgattaaacatctgcccagctccctcgttttgagagccctggagatccacttcctttccaggcagtgctttggcaagccaggggacttgttcaaatgtctccaccagatggcgccagtagggcattgctgaaaccttagatgttttctgaaagacggaaggcagaatggtcttttttcttggttttcctatatttagaccattttatctcaaacttgagtagtaaatagagtattttgaaaggaatacaattctcacagatccccagagttgatttaaattattttattataatacaatttgcacattgtaaacagtatacattccctacttacagatcttatacaactgtcaagtcaaaacaaatttagaaattaaatcgaaataaaaccacaaataaaaagtccaaaccaccaaacttcacataatttaatgaaagaagggctttttctgaaaataaagagctaggtgcaatgcgaccccggagtgcgttgcttcttgtagagtttgggatgcctgttttttgtgtgtcgtggtgtgactcaattctttcactcctgtactcccagcactctgagaggctgaggcagcaggatggcttgagctcaggagtttgagacaagcctggacaacttagcaagaccttgtctttactaaaaataaaaaaattagccaggtgtggtagtgcatgcctgtagctccagtgacttggaagggtgagctgggaggatcatttcagctggagagtttgaggctgcagtgagctgtgatcatgccaccacactctagcctgggtgacagagtgagattctacctcaaaaataaataaacaaataaaaacaaatacatgaagattagcctagtgcctggcactgaacaagcactccgtgctcatctgtgttgtcctcatcacctgatcctgtctcctcattctacatcccaaagaggcgggatgagctgtcaagatcccataactatgagtggtagatcctgggctaagagcgatgatcttctctgcaacagttctcaaagttcttggccttaggaccttttctcctcttaaaaaggatcaatagactgggtatggtggctcacgcctataatcccagcactttgggaggccaaggcaggaggatcacttgaggccaggcgtttgaaaccagccttagcgagactctgtctcaataataataataataaaataaaataaattaaaaattagctaggtatggcagcttacgcctgtagtcccaaccacttgggaggctgaggtgggaaattgagcccagtaatttgaggctgtggtgagccatgtttgtgtcactgcactctagtctgggtgacagaatgacaatctttctcaaaaaaacaaacaaaaaaggatcaatgagtttatatatatatatatgggttatatttattgatatgtatcatattagaaattaaagcaaaatatttagaatactgccgggttcatttaaaaaatagtaataagcccatacatgttaccacaaatgtgatttgtaatgaaaataactattttcaaaacaaaaaatagccaaatggcattgttttacatttttgcaaatctctttgatgcctggttatttaatagatggcagctggattcccccagctgtttctgcattctgtctgttgcggtgtgctgttttggttgaagtatataaagataatccccctttgtcacaccagacaagattcttggccattggacagctaagaaaactgtggaatggggaagttgggatcatagtgcccgtatcacaggcttgtctgggattgaatgagagaatgtgaaagaagagagaaaaaagtcttagaagaatacctggcaaaaattaggcccccgtgcatgttagctaatgttaaagtggtcatggggacagacctgaaaagacagctgaggtgggactgcagggagagaggacagaaataactgtaggtaggtgctgctatggcagaggactttgaaactggcaatctcaacccaaagaagggaattgtggagcacccggaggcaagaattcctgattccatctacagcacagtaggctcctccactttaatactcctcagcttcatggttctcagagtcataaattcagagcaactaaaattgttcctccacagcagattgtaccaaagctccaatgagataaatccacttctattcagcagtgataagtagagtacaattggtaattcttataatgtggggattgaattataaaaaggcaaaagaaaaactaaaactatgtactgtttggattaagcttaaatccactgcaagcaattgcaaaagcccaagttgggtgtgaaaacggtctctaaatacttcttgcaaaacccttgtataattaacttccttcattagctttccccaccccttctaaagaaaggtgattttatttcctcctaaatctggtcacacgttgccactttgaattaccatctccagtttggcagagtgccaggggaagtcctagagcaggtcagttggtccagtcccctgcctctaagtgagtgagtggctacttggaagagagtcaacaggactgggttttaaagattctccagactcctcagtctctctgggattagaacagacagaaatgctttatctcagggcaaaaccatttacctttaaaatttatatctattttctcccatgaatttatctaaggatatgaagatccagatagtgggaaggatggatgagagcatcctgctggaatccatgtttcttgggcctgctggaaagacttctcagcagacaggcctgtagagatccttaactggggatgaagaggaacgctgcatcctagtaaagaaaggacccttcattggcagagttcctgtgcttttcctctcctttctcactctccttgaggtgactaaactaagcaggtggggcctcctttgtggccccgtgtttcttccaaactatgagccaaaacctgctgaatcttgcccagcggggatcgggggctttgactgagaggccttccagggggaaattgtgtcactttatggtctgctggagttattgaggccgccccattgcatttgtgtctagtgcttgctgggtcaacacggtttggctgcaaacattgcgtcaggccataatcccacaatccaaggtatgtgctggcacctctctgcctccaggcacgcagaacggccatctcatccgaccaaggggatcttatctgaccagggggatagcgtgcgtggagaaatgaacctgtgagaaagtgaaatggcagtttcagtggtggcattcaggcaggcactcctattggttttcagctcagaatgcattttaaataacaactatgaccatgcttttaggtttttcacttctaattctggcaataagcccaaaatttcaccagaaaggccatgttcttcccaaagacatcttactctctgtgacttctaaaaatgacagaaatatcaccctctagggttgtttaagcccttcttagttgtgtagctttgccactgtgggtgattataccaaatgagttctgtgaatattttttcttgtcagtgaagaggtggttttgtttttgtttttgtttttttgagactgagtctcactctgtcacccaggctggagtgcagcagcatgatctcggctcactgcaacctctgcttcccaggttcaagcgattctcctgtttcagcctcccaagtagctgggactacacatacaagccaccatgccgggctaatttttgtatttttagtagagatggggtttcaccatgttggctgggctggtttcaaactcctgacctcgagtgatccacccgcgttggcctcccaaaccaaagtgctgggattataggcatcagccactgcacttggccaagaggtggtatttttaaaaagaatgtgttgttctgtttttttttttctattcagtttctgttccgtatttcttctccctttttcacccactttgcttgtatctgctttaataacccctttctagactgagaatttttctatttatatgtaacttacatcctgctgatttatgcaaaatatgtgaggttgcttacaatattataacatataaatcagaagagtgaagaaaaaaaagagcatggtagcgggaatctgagatattaccacagttgagcaccaaatgttgatataagccttctagaggcaaaacagaaagcataatgcataatgtgtcaggttacagagggctttttttttttttttttttaatcaaaagagaagttgggcttttcttagtggctgttgtatttccagtaccaggtaattccatgtatttcttaaggataaggctctacctccctcttgtcatccctgtccccatcccctagagtaccatgagctctgcacaaaacctatagtaagatctcagagctagggcctccagccggtgacaggaaacagagcctttcagtgtcttctgaaagttgagcttactgatgttgggtgcaggctgacagaggccattcaggctggtctagacgttcatcctggagatgcgcccagcaccagccgaacttctggtgggaagtggaatgaaatggacaggggtggtcttttggagaatcttattatccgatggagacgaagcatacctttgggaactgggaacctctttctacagagagtctgggttaggggccttgttgcacctgcttgctatcctaagtgcaggcaaatgagaaatgttttaatttccccctaggaatgagaaaatgcattatgttactctgaatatccatagcctcaacagataccgacttatggaagagaatgttgagactgtcaggactaaatacttaaagcaaaatcaggaaatcggaggttgtgctgttcatgtgccactatccacatgtgtcttttgagctctcaaaatgtggctaagtccaaattgagatgggctgaaagtgtaaaatatacaccagattgcaaacactattgtgtgaaaaaaaaaatctcagtagtaatattgtaatgtaaacgatctcaacatgtaataccagttacatgttgaaatactatttaggctatataaaatatattacaattaatcttacctatttcttttcactttttaatgtagccactagagaatttaaaattaaatatgtggcttggccgggcacggtggcttatacctgtaatcccagcactttgggaggccgaggtgggtggatcacctgaggtcaggaatttgagaccagcctggacaacatggtgaaacaccgtctctactaaaaatacaaaaattagccgggtgtggtggcaaacccttgtaatcccagctacttgggaggctaaggcagaagaatcacttgaacccgagaggcagaggttgcagtgagtcgatatcgcgccactgcaccccagcctgggtgacaagagtgaaactccatctcaaaaacaaacaaacaaaaaatatgtggcttgtgttatatttgtatctgacagctctggtctaaacatctagaattaaacaaaacttttttgaggagtaaatttctactgtgttttctaattcctatgttctctctttggttctctttcaacagatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtctgtttctccttatttgagccaccctgaaggtatggtcattggagatgtcagtgcctgtgtgaggatgagccattttctggcctcaaaagagttcacttcaagtgagcaggtgccccaatacacagcataagcaaagtcaaccttgaccatttttgcttttactttgcttaaatatctgctctaatttttttttcatttcagaactaagaaaacttgacatttgtcacttcaattctgaaaagatagcagctgttgtaaaaaaaaaagtgtcttattagcttttttaaaaagtaggattgactgaaagctcaatagagcagtgtattcactgaatatctgaatttcttcttgcctgagaacggcattaattctccaccaaatgaattggagccctgtttgcatatgttgaaagattatcagcatcttttgaggattggggtgtttatattcctgtttaacctactgattcatagcgttaatgtacaggtctgagatctcgtgagaggacaccggagcatgaatcctttgggggctaaccagtgccaggacacaggataatttttttttctgctctcataacaaggagacttccctaccttaggacactagaatcgtgtgaccatgcatgacattgtgtatgtaaagcatcctcattcttgtgcttggtttgattaatggtgcatgagagccagacagtaaacctctttcccttaattgattaaaaatgtaaaggatagatgtcaagtgaatgtgtaattaagggcactgcaaatggtgtgcttttatgctgtcttatccatctttttcgaaattgttattctcccaagaactctgaagaagtttccagatatcagattgttaaaagtgacttatgtagtaaacttcaaacgtggtggttgaatattcagctgatgcctgtgtgttttagatgggaaagcagttgtctgaaagaaccagattacaaagcaaatttcaatatcaatgggaaatgacccccacagatcccagaacacagcagctctgcgatgcagtcagactgcgttgatgccagtgttctcttggttcctgcaagactttcttgaggtttcttgtttccgcaagctctgaactgggctctggctttgcctcagaagcacagagctggagcatctgtgggagaaagtggaaatggagcaataatctgcaaaggcaattactggtgatgtgtgtattggcaggtttcattctagcatttgtgacaggtcgtgtcttgttatttgtcttgtgtacataatacactgaacagaggtaggagtcacctcttggatgacacattagttgaaaatgtgggctaacttgacaaaaggcatcctgagccatggaattttcactttccttttggcgtttggtggttcttcgtccaatttgcaaagaaaacacaaatctctctgtggggttagttgggttcaaaataatttttaaaaatcccataccaaccactgttggtggtctttctgcctccattaccctggatggcaaaggctgggattctccatctgctttgcttcaacagcagtttgttctggacttccaggaggccctctttgccgtcgagcaccttttaacccttcacccttccccatgcccagatcacaaatgattctcatagtatagctgttcaagatttatctacaacaatattttattccttcagaatgtaattagagaaattgacaaacttgttctggatgaaacgaaacagcatcagaatctcgtaatgctcagaaagctgcaataagcagtcagctatttccagggcactattctggctgtgtgccagacactgttttaaatgctttacatgtattaatccatctaatcttcctaataaccccgtgaggaatgcaccattatctctcctttacaggtaaggaaacaggcgcagagaggttaagtagcttgcccaaggtctcacagccggcaagaggaggcgccaggattgaaacccacacag

SEQ ID NO: 13297 - DNA, 43507 bp, Human
gcctgcaaagaaacaaagatcttcccttgaagagggagggggaacatggtgctataaatgtaggaccctcccattgggctctgaagtcattagagagcctcatatcatctgatttgcacacatgtgttcttctttgatctctcaaaacaaatggttcaagacgcgggtagagctaatattattatctattccactttacaaattgaaaaaaaaaaaagagagactcaaggagtcatggcaaagagcatgggcttaagaggcagacagactgaagcctcttcccagctgagtgaaatttactgattctctacgttgcctttagcctcagtttccccatctataaaataggcatgaccacacctacctttcaggattgtggtgaggaccagagatgatgaatccctgacacacaacagatgcttaataaatacttgttgaaggaatgaaggggttggtggcacttctggggtgtcattggaggagtgtagtgtccggcagtgacaggtcagcccagcctgtgggtagacagtgctccagcttctggctgactgcctcctgagtctgctctcagtcaggggccttggtgtctcttccctgtctctctgcctggcccatgccagggtcctgtgaaggactttttaacccttcttggcactgagatttgcattccaatcattctgctcactcagcccatccaagtctggagttgtttagagctgggcaaggcctgtgggatcatctgctacgacacctcgttgaaaagataaggaaacaaggctctgagagggtcagtaatgcctgagtttccactacccttcccacctcaccaccatagccaccatgtttgacaaatgaagaaactgaggcatagggaccccctctcctgccccagttcccgcagtctgccagtgagcctcctgctctgggccccacctgcccaattccagctagatcccggttctgctgggatgccctaaggtggtggcaggtgctatctctggcaactcagcctaagcccagcctggtgcacgggtgcaagacaggaaccatgggagtcgggacagcctagaagcccctgggagcgaagcaggaggcctagactcccagcctgtgccttctcagccagttccaagaactgtgctgacctgggaaggcacacattgcctgagaacagggctttcccttgggtgtcagctcatgtgtgcccaggtccacagctgggccctgcctgcttccaagacagccagagtctggcccaagggaggaaggagtgtggcctgggaggaaggaacgcttggctgagtcccagtgctgtcacgaaatcactgcgtgcccatgcgtgtcacttgacctctctgggcctccatttcctcatccataggataagggcaggacagcgaggccccaagtgcctcctggctgcaatatgctgtgatgagggtggagggtggggtggggaggggctcgctctgccttccttgccttcctgtctgtttctctgtcattagtttatctccagcaatccaggcctctctgtctcagtctgttgctctctctgtttccatcttttgctctgtatttttctgcccgcctctcttctttttctgtctgagtgcacctctgattttatctcctcctctgtcacacagcccccttccctcagtcctacactgcctttctcccattctccgtagttatcagcgtttcgctgtctagttttctctgtctctcgggctcgctctctctctctttctctctctctgtcctgcccgggctctctcgcggccgcccctcccgtcccctccgccagcccccctcctccctcctcggcgcgtctccccagtccttatttggctgggcgggagggctggcgggaggaggcggcctgcgggcggggggcggggggcgggcgcggggccggccgaaggagggcggtgggtggtgctgaagggacagctccgcggcggcggcggcggcggcggccccgggcgctaagcgggtgcccggcgcggagagcggcgagcgcaccatgccccaggccgcctccggggcagcagcagcggcggccggggcaaggcgcgggccgagggcgccgaggggccgggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggtaacggctcgccgggcggggggcgggaacccagggctgggcgcggggctccgggagtcgtccggggccggctggggctgggggcgggggctcccccgagagggctgggcgccgaaccctgcgctcgcagaaacccgagttcagcctggcgtgtgtgctccgcggggacggaactcggggaggcgtcgattcctggctccggacctgactctccggccgggccagccctaacttggccctgccatgttgcataggcccccagggactccgaagtgtgtgagaggggcagggacgaccggcggaggctcgggcaggaggggtgtggccggccaggcctgaacagggcgctgagagtgagcggcgggagagcgccagtgctccgtatccctgaggatcggcttccacagcctagcaggtctacacctgctgggctctggggaggcatgaggatgtcggaatgcggcacttcggggcacttggggccaccctataacggcggctgtgagtgtacgtgtgtctgcgtgtttcagctccaggagtttggtcgccaccagtcagtgcctgtgattttctcagagcggcagaattggtgcgggaagccagatctggccttgtcagccttcttctctgctgtcccagcaaaacagtcacctcacaggaataaccccagttctttccaagccagggcagatcaccatgtaggaggccacacgtacacccagactgtcagacaacacaggcataggcacacatgcacacagatacacacaggcactcacagggtacacacagggcgggcacacacacacacacagagagagagagagacagagagagagagagagaacaaacgttgcccaggaaaggaatctctagccaggcccttggtggtgctattcaaaactgtccagacgggaataacaccttacctgtccccaataccctatgatttcagcccagctccatcactaccgtgatatatgaccttgggcaagtcccttcccctgtctgggtctcaggctcacctccagacaaggaggggtggccaaaatgatctcaagagctcctccccagccccgacgtgcttggattctgagatgaaacccaccttcccccaaagcccattgagatgcctccagaagcagtttcctctgtctttactgttccctctcctctccctagtccccttccctgccttgatcagactcccaggggttcgttgccacttagcgcagcccatgaagatggcattgttttcctgggagtcaacaggagctgagggagtaaaaggcaggactagacactcttcctgcggtctatccactgcaggacactgttccaagaatctacggctccctggggaccatggggagctatgctgtgtcgtttctggattcttctcttggaagagggaggaaagggccctgggagtggatgtggcccagctggggcacctctgggtcctactggtcctgtgagtttaggataggatgatcagacttaggtctgcccaaagaggagcccgcttcctgaaaaacaccagcccagatttggtctgcagtctcttccactctcacaccccactactatttgccagggtttcagtagctgtttagctgtctggagaatcaaaagaatcagactgaacatctttggaccctctctctccctcttttccacacgtcaagccttcacgcgtgtcccctttccttctcaggcccatggtccccagcttcatagtaacctcccaactgacctccctgcctaccccacaacaaggcatgctcccctggacaatgctgccagaaagaaaaactcagctgtcaccaaaccaattcccttcttggaatccctcaatgactctccactgtccatggaatctggtctatgctccttatctcaaattttgaggatctccatacctggctccaacctctatgtctgacttcacatctcacttcttacttatgtgatccctctcgatagctgccaacctgtcctctgagaataccttaagtatgcctgtctggcatgcctttttctctgccctttttcttttcttttttctttttttgagagaaagagtctcactctgtctcacccaggctggaatgcagtggtgtaatcatagttcagcacaacctcaaacccctggcctcaagcgatcctctcacctgggcctcccaaagtgctgggattacaggtgtgagccactgcgcctggctctaccttctatttatcttgtccatgctaaccttccaggtccagctcaaatcccccctcctcctcaaagcctcccaggccactgctctggacaactgcaggtctcactgtgaggatgatctgggtgacacgctgttggctgttttgaatggttatttgcattataggggaagtgttttgtctctttgaccacactgtactcaacctccatgtgggcaggtcctgcagttcctgtctctgtgctccaagtgccagcatagtacccagaggctgtgagcacacacagaatgctattgatgggtttaaggtgtgcagaaatgaaagggtagcatccttccctcttcctctgccgtttcccaaagtgcttgcagtcctcaccaagagagacgctaaaagccatggggggagaggcagacagagtgcggttctggtgattatttatttataaagtgctgggcaagaggaaagacaacatcagaccacccccctggttctgtgggggcccctccctccctgccccacctgaccatcctggctttgtgttgccttccactgtggctatgccaccttgctggaagctgtccacaggggctctgctctaagaaaaacctatttgggctgtgatcagatggtagaaaggggccttagttaggctgataatggccccaaacccaagggcagcagcctgtgttcacctgacccctttgaaaacatgaatgagtctcattctgagataccgggtgtcccattgggatggaataatgacagcacttcccatcatttggtaccttagtgatcacaatgcacttgcatctcttgtcatgattctcagtcttcatgacttggtgaagttgctgggcaggtattgttagctctgctgcatggatgaaggcgtgaaggctcagggaagggaagcggctcccccagtcacccagctggtaagcagcagagtcagagtgggaagctgggtcttctgactccaagcccagtgctctttccctgctggtcttttggctgcttcctttgactccatatgctatgaagctcagacccagccaggcctgacacagccaagccgtgcttagtgatgccagctcacagggtgctcatgggcagccctgattggttggaggtcagcaggttctttcttagtcattcacctggttagtcaccgtctccactggctggaaggattcctccagctccctatccctggtctcccagccaggaaacccttcctttgctggtgccctaagttcacccaacagtaatagaaagtcatttcttaggaagtcttaaccactttagctgttgagtcattaaactcctccagggcccaagcctcatctattcatagctcagaggctgtcagagcaggaaggggcttcggagatcagctggtaccaccccctgctctgacagataaggagtcagagaggtgacagaaatcacacagtcagagggtagcaaaaacctaacccccagtcccctactccttctacttgttcaggatacttatttattatttttattaacaacagcagcagcaacaacaataacaatggcaaccaccatttattatttactttgtggcaggctctatactagacgcttcatttgtacccccttatttaattctctcaccaacctctctagataggcattattacccccatttttcagctgaggaacctgaggctctgagggtagatgactcccccatggcctcaggcctcggaagcatggcacttgcccagattcaattggacctcactgactctcctgccctgaatttttcacgaattctttctccatttcaagagcccattccatgctgggtgcagtggctgacaccggtaatcccagcactttgggaggcggaggcagaagtagacagatcgcttgaggccaggaggtccagaccagcccggacaacatggcaaaacccagtctctactaaaaatacaaaaattagccaggcatggtggttcatgcctgtagtcccagctactcaggaggctgaggcatgagaatcacttgaacgcagaaggcagaggctgcagtgagccgagatcgcaccattgcactccagcctagggcacctagaagccaaggcttgccttttccccagcaaagccctccccagaagcagggggcttcctgctcgagcacactccagtcaggcctgctgcttgccacaccctggcccctgaccaaaccagacgacttgtcacagctgtgcccagcacccgccatgggcacctgccatgggctcgcaggtgcccattctcccactgcaggtcctgggaatctttttggctctaaggcaacaacaaagagaccaggtgattgattcgctgatggggctggggcagaaaaccttctgttccgctctttccccagcttccagcctgtgctcagctgagcaccacctcccgtcacccaccacatggcctgagaacccttagactgtgaactcaagcaggtgattcatgaggaaacctatactttttacatcttttcaagaaggagagtacagatgtgacctgccacccccaaaatcccagaggtcctaaaataagagaaggagacattagcaatcttccaaacacccagagaggtgagcggcttgtccacactcacacagggagttgagagtatgaccctgactagaagccaggccttccagtgcctgcactggtgttctctgcatcctccagcctgtcccccacatcccaccatctctcttagcactcaggcctctggcagctcatcactccattgttcgaggcctctttcgactttccaaggtgaaggaagggtagcccagcctaggaaagtcccggcacccacctcagttggcatttccttcctgcccacaggctagcccgtgggcgtgcttcgaccccacaatttctgcagggcagcggaggaacataggcactgacttggaagctggagtgcctgggttcatctcaatccaccctatccccattcccctactgccactagctgtatgtccttggacacattatctaatctctctgagcttgttttgtcatttacaaagtggggataataatatctgcctgccaggattaaatgggatcataaaaagaaagtgcctggtacagagaaggcacttaataatttgccattattattgttattaatactattgtttgtgcattattacttgccttaccaaggaactgctctgtctcccaagggttaccatgaccacggctacttctgctgcttcctaacaggtgggaacagtgaggttgagggccaggagattgccacaccctttccccttatcttcccaatcccactccccaccccccatctccccgctcctcagccatgcctggtgtttccctaactgtccaggctcctgctcctcctcagagcagaaagctagcaaggggctgggcgtggtggctcatacctgtaatcccagcactttgggaggctgaggtgggcagaccttgcagaaagctagccaggggctgggtgtggtggctcacacctgtaatcacagcactttgggaagccgaggtgggcagatcgcgtgaggtcaggagttcaagaccagcctggtcaacaatggtgaaacccttcctctactaaaaatacaaaacttagccgggcatggtagcacacgcctgtgatcccggctatgcaggaggctgaggcaggagaatcgcttaaacctgggaggcagaggttgcagtgagccaagatcgcgccactgcaccccagcctgggcaacacagcaagactccgtctcagaaaaaaaaaaaaaaggaaggaaagagagagaaagaaagaaagaaagaaagaaagaaagaaagaaagaaagaaagccagccaaggagaaaggtacacggtggtaggagaaactacggagtgtgtttggccagagatctttctgactgtgccatgcctcctgtctgcaggtcccgtttccacgcattaccgttaggggctggagcatggagagagtgggggtgagaacaggacagaaatagaagacacacgcctggccacagtggggacaggacaaacacaataagtattttcaaagcaaacataaacaagcacagatgaatgtagtgcaaatcaccactataaacagctttcagctggctgcacaaacggtgaatctgtgagttgattttgtaattaaaaaaatgtagaaatgatttccctgcagtcagccagcagcaagtggagaccagactctaactgagaccactgggggtctaggccaagctcagtggagacccaggacggacactccctcctccactccctctccaccttggacacagggaacggacaagtgtctgtaacaggtcgggtgctgtccacaacatttcctgtcaccagaatctccacactgctccaggacggcaggcggcatcatcctgcacagtcaaggaaaaggacgctcagagaagttcagaaatctgggcaggaccctacaaatataaaatgacagcaccaggacttgcacccaggtctgtagggagtatttcttcatggagtcatgcaacccccactccccatggagcctctgcgactccttccatgtgagcacagctagcggtggcagatgggtaccagggtctatgcagggtgctcagttgtgggctcagcttcagggtctcttgccctcagaactatggatagagcatttagcccaaagagagaacagaattttagctccaatcctctcagttcacagtttggagactaaaatccaggctggagaagggtcatgcttacagctatcatcagagctgggcatagagccctgtttcctgacccctccgccagcctctggtcctcagagagccacatgacaaatgtctttcgtggcagcacaaagagcagtcaaccgcccagctgatgccaccgcctccctgtctgtccacattctctcattgtgcagaaactgcccatgctacagcagctcccaggtggctcccagagaccttccccttagctggagccagcatccccaagctactgccacaagtcacaccttcactttcccatttgctagagccagcctcaactgtggcctggagccacagctccagttctcctgggctggtggcctctctggctgggcctgacatcccatcctcacccttcacaaaagcaagttccttactacccctgcttcctccagtgacacagcaaagatcccttagtgaaggggccatgtggctgccaggaatgtggggcaggaggctggccttcatgctagagaggtcttagacaaattgtttgctgttgctgcttctgcttctccctcttcatcatcatcatcacccatcatcatcatcatcaccatcatcatcatcatcaccatcatcatcatcatatctctctctctgtctctctctctctcactctgtctgtctctttgctggctctgtgatcatggaaggagcagacacttccctggtgtacctcagtcctcccatctgtatagaggaagcagtccacagagggaactgaggaggccagctcagcaatgcagagttctctaagtcaatacttctcaaactgtaatgtgcagggaataacctggttgatctggtgtaaatgcagattctgaatcagcaggtctggggcagagcctgagattctgcatttccaaaaagcccccaagggacactgatgctgtggatcagatccattgtccacattttgagtagcaaggctctaaagaacctggagacctgacatctgggaatagccatgagatgtgtggaccacagttttaagaaaaagaacgtctgcagctggaaaagaccttgggaatctggtggtaaaatgtcagagctgagggcccaggagctgtggccgcttccctgaggctggagcaatgctatgtcttgccccataggagccagctagagagcctgggtggagccgggtgctgtagctggcaccgtgaggtagaagaaagggaagtggagaaggtggatggaaagggaggagagaagtggagaagggcttgccccatgaggaggccagggaacaggggaccactggtcctcagttgttgccatttcctcccctgtctgccaggaaggcaccttagatcaatggaaaaccggtaccccagagattaaacatcagagcgggaaactggctcctccctcatatcatcagcctgtcttagtttgggctgctatcataaattactgtagactgggggcttgaacaacacacattttttaaaaacttttattttgcctggcgcagtggctcatgcctgtgatcccaacactttggaggccaaggcaggggatcacttgaggtcaaaagtctgagaccagcctggccaacatggtgaaaccctgtctctactaaaaatacaaaaattagtgaggcgtggtggcgcatgcctgtagtcctagctattcagggagctggggtgggagaatcacttgaacccaggaggcggagattgcagtgagccaagaaagcgccactgtactccagcctgggcaacagagacagaccctgtctcaatcaatcaatcaataaataaaaacttttattttaagttcagggatacacattcaggtttgttatataggtaaacctgtgacatgggggggtttttgtacagattatttcatcaccgaggtactaagcctaggacctattagttatttttcctgatcctctctctccttctaccctccaccctcgagtaggccccagtgtgtgtggatccagtggctgtgagagctggcttcctggcttacagatagccatcttctcactgtgtcctcacatcctcacatgacagagagagagagaaaatgagagagagtgctaccagacactcaccctgctgcaggctacagtgtggaatgcagatagtagcacaagacctgttttctttgggccatgtgtgtatgcaaactttaaaaggggcatcaacaacctgggggactgtcagaggagaggagcagcaggtcaaatgagagacacttggtagagcgggcatggacagcatgagtcccaacttcaaatatctgctgggctattgtgaggtgaaagaaccaatcttgctctgagtgtgtccaaggggttgaaccagcagcagtgggtaaagctcatagaaagacttgatttagttcactgtaaagcagaacttgttaaaattgaagctgaccaaagatgaattgcactgcctcaagaggtagtgagcttcccatcacaggaagtatacaagcagacactggatggacgtactacaaaagccacttgtatcagccagggttccaccacagaagcagaactggtaggagatacatattaagagatgtgttgcaaggaattggtgtataggctggtaggggctggcttggcaaatttgagatccatacggcaggccatcaataagggcaggctgggtcgggcgtggtggctcatgtctgtagtcccagcattttgggagtcaaaggcgggtggatcacttgaggttgggagttcaagaccagcctggccaacatggtgaaaccctgttgctactaaaaatacaaaaattagccgggcatggtagggggcacctgtaatcccagctactcaggaggctgaggcaggagaattgcttgaacctgggaggcggaggttgcagtgagccaagattgcaccactgcactccaacctgggtgacagagtgagactcttgtctcaaaacaaaagaagggcaggccggagctctcttcagtatgtgctaaaactgctgtccacaggcagaatttcttctttgagggagcttcagcagtactcttatggctttcaactgattgtattaggcccacccagattatctagaataatctcccaaacttaaagacaacccattatgaactttaatcacatctacagaatgtcttcacagcagtcctagattggtattggattgaacaactaggggctttagcctagccaagatgacacatcaaaaaggccatcacaccacccatatatcccactaagggtcacaataaatggcttttaagattcttcccaaccctgagatgctttgatttatttatcttcaaaggggcagcctggagagtttgagcacccagagtgggactcaggagtgtccttggggccctgaggccctctgggtccccttccaaattgaattggcttcagccttcctttcagttcagttaaccaaagatcatttgagatgtcccgaaatctcctgtgtgccaggcactatgtgaggcatcaagagaatgaaaaactaagacctagagccttccccaaggagccttgggtcagtggaatctgaaaagcacaagttgcatggtgcacatgctaaatccaagtacagtgacccaaagaagggtctgagaaggtgtccaggggtaggtttgaacaatgcgtgaggacttcaggaggtgaagatcagcagccagagctttctgcggtgagcatgacacacgccagggcatgagcatgcccaaggaaatgtactcgtgagcagatcctggagggctctggactctggtgtgtggacttgagtggacaagcactggaagacagaggataggcccgatctgtgtgcccctgcctgagtcctgaccagtgaatgccccaatgaccccagttgaagcagtgggtgccctgtgattccagttgaacccaagggtaatggtgacctgaatcctgattgcctgacttcccgcccaccctgctcacccagcagccctctgtcagcccccagggagtttttgactcccctatcccatttccttttctgggccaaagttccactctggagctcacaccaagtacagttttattgacggcttgcaggagcaccgggacggtgctaagctgaagatgatgctgccatccaacactgaatgcacagcttctgcatggacaaccccaggcccctgctctcagaccccttttctctcccacacaccctcccacaaatccaaatttctggatcccaagcgtaccctccttgatttctgctccgggctccgaggcttggcatggactcagtgtccctcatcaggaatgcacaggcctctcctaaccacaactctgattcagaaataaccatcttggaaacatcctgagagtcacattccagccctccagccataggaccatccggggctttctccagggaactgaactgtcaggccccagtggggcagcctggagagatctacacaggcactgagacaggggcaggcccgctcctccaggatgaggtctagtccccctgcccgtgcagaggagattccctggggctttgggggcaggcacggtacagacagttccaggcagggcaagcctccgatcaacgcaacagatggatctgccctggactgttccacacagatcttacccccaacatggagcagccgctcctcagggagcctgcctctgttaccacagtcatgaactaaggttggcattcatcaggaggttactctggactgagccctttacaggcattacctcatccaatcctcatggctgccctaggagggaggcactattttctttctttcttttttttttggaggcagggtctcactgtgtctcccaggctggagggtagccatgatcatggctcactgcagcctcgacttccctggctcaaatgaccctcccacctcagcctcccaagtagctggaatcacaggcatgtgccactacacccagctaatttttaaattttaagtagagacagggtctttctatgttgcccaagctggtctcaaactcctgggtgatcctcccatctcggcctcccaaagttctggaattacaggtgtgagccactgcatgtggcctggagacagtattattatccccattttacagatgagaacactgaggctcaggggggtcaggggatgtgtccaaagtcatgcagctggcaaatggcagaacacggatatgttaagcactcggtcatcgagtgtctctgagcctcatatcaaccccaaggtgtaggcatcattattcctactttgccaacaaagaaattggacttgagagataaggtcacttcctgcaattgagggtcagtgaacgtgggagccagagtccagtccagacttcccaaccttaacacctagcttctccccgacccaccccaaccacaagtgcccttgcccccttgacagtggcagaaaataggtcattcccgtagtagggatattagagatgtcacagagggttgtgttggcctatgaggggcaaaaaggcagcattgggggcaggggcagttgtcacagaatggccttggttcccggcctttgtccacaccatcccactgaacaggatgggaatctgagaccagaatggggacagagtgacggttcttaagagtggccactgagtggagaggaggccttgctgagggtgacttgggcaactcacctgctccctggtatggaggtaggggggtggggggcaggtcagacggcccttgtgtgctgagtagggaggttacccccgtagcagcagttgctggaaccagagtcatgggtgtgaggaccctgcccacgggagttaattcattagggctgaggtaagcccaggaggcttcaagtctgaaggaccccccaggcgattggaatctgcagcctggatctgggatgatggagaagagagcttgttgggatctgtattccatacttgggaggctgggccactcaccagctgctagaattttctttctggctgtccttggtgtctcagaaacatgcaaaggtggctgaggaagatctttgctcatcctcgagccaaagctcctggggtgagccaggtggccaagacatcaggagtcagtgggtggcccccagagaaggtcgtttcccctcccccccagaggaggagctggagagggcctcagtaggggtcctggggtcctggggacaggtctgtctttcgcttcatggctttagctctcactgcctgctctcaaacaaccccagggaaggtggtcagcccaggggaggccccctccactgggaacaaatctggggttggggccaggctgagccagggtgcccccttcttcagcatgactctgagtcatggattttccagcatgagggtcaggcaaagtaagaccctccagggcttcctggggctctggagcaggggctcctcttgtccttggtccacctccaggaggggccggagagagaaaacctggaaccaaactcagtgggcagccctcctcttgcatgccgtgcccagctaagtgccctggagtcccgagcactcatctgcctgggctccaaagaggccctgctgtcccctgcctgcttccagggggtgggccagtgaactcgtagaggcaggcatctcgtcctttcttgcagctgtgacgggccaaggaaagaggggatccagcctcctccactgctcctctgctcctctgctcccacctggctgtgaaacctggggcgagtcatacctgcccctggccttgtctgtgagggactgggctggtggcacctaaagcccttccagttggggccgtctctgttgcacctgccctggcctcccctccagccctcccgagaagcatgctacccaggattacgcttttgtccccgcttcaccccatgctgtccgagccctgaagagacttcctctgtgtctagtcccaagaatagagttctgtcaaggacctccaagtcaccccttgctggaaagagagcattcttgagtgtggccgaggtcctgcttatcagcacagcgagtccactgccccagcccctggggctgctggaatgcaggagcctcccacccggacagggtcagctgctcacggctcccacagtagtccctggaatggagtgcgggagggagcactggtgctgagggcaggctgatcccagccactgccttccgacagggagtggccaggagcgaggctgcagacacagttttgttgcaccccagctggcccaggatgtgtgtactggcagccagtcctgccatccaggccctgggcttgctccaaggctgccagggtaccgggagctgtgttctgctcatgcaccagccttcaacatttcaccttgaccagtgacccactggatcttctcagggtcagggtttagccctgggggtctccactgtggtttgatcactcagaatgttttggggcctggtgtgattccctgctacagagcctacacagtcatgtactcaacctttggccaggatggggtgagttcagggtgctgctgatggtccgcacctgcagagtagaggctcaggcagacagcagatagcattctggcaattcccagagtcctgcagatgcttcagattctttgagaaccactgatgcagcccaacccttctctcttccagatgaggggatgagacccaaggcagggtgcaggggagatgggcagtggcgtgcctccactacacagcagtccagtgacaaagcagtcctcgaactcaggtccccgactctttccactcccctcaggcacccacgcagtcattcctccacccactcggcctctctgagcatcttccctgtgtcaggccccattctaggccccagggactcagcagggaaaaagagcagcccctgttctcatggggccactttagaggaagtagagagtcaacaaactaaattatgttgtaaaaaataaacaacatcatctcaatggtaataagggccagcaagacaagaaagccaggggatgagagtgagagggagagctgccttccaggaggggcctgtagaaggcagaggtgggagaacagatttctgggcaggggaagagcagatgcaaaggcctcaagcaggccagtgccaggtgggttgaggaacaggagcagtgtggctgtggcatgctgagtgaagtgaggagaagaggcagaaatctgtaagggctggacactgcagggccatggagaccatggtcaagagtttggatttttggctgggcgcggtggctcacacctgtaatcccagcactttgaaaggctgaggcaggaggatcacctgaggtcaggagtttgagaccagcctggccaacatggtgaaaccctgtctctactaaaagaaatacaaaaaaattagccaggcgttgtggcatgtgcctgtaatcccagctactcgggaggctgaggcataagaagctcttgaacctgggaggcggaggttgcagcgagccgagatcgcgctattgtactccagcctggacaacaagagcaaaaactccatctcaaaaataaaaaaataaaaataaaagagtttggatttttaagactgatagaagtcactggaagggtctaagtgggttgtgatgtgacatgacttaaatttttacaagagcactctagctgctctgcaaagatcggatggtggcagtgcaaacaaaagcagggagactgccaggccacaggtcaccaggccacccgcaggtcaacccctccaaagagaggatggtggcggactggaccagcgtggtggtggtggagacagagcttgtgggtggattgagctatgtttgagaggcagaggagacagcactggctgatgggtacgatacatatgttggaggagagggctgtaggagttgggggaagagaacaatcgagaatggtcctcagtttttgacctgagcaaccaggtggaggatgtgcatttactagatggaaaagaacatccagagagtagcaggtttggtagactcaagacttctgttttggatacccagcctaattttgagatgctcatttcaaatccatgaaggcagttagacagataagtctgcagctcgagggagaagtcaaagctgagatatcaactcaggagttatcagatagaaataatattgaaagtcatgcgccagatgagatcagctgggaagggggtagagctggcaagaagagcagagcgcccagcccttcctccagtgctgggaggtcaagcaaggaagggagcctgccaggagatgggaaggaggcctgggcactgtggtggcccagaggccagggggagtgtttccagagagggaacagtcaaccaagctggccactgcttagaggtcaaataggatggaaaccaccagtagatctgcagcatggcggtcaccggagacattggccatgaaagcagtgcaacattcaacagcttgctccaggagcgagggaaggggagggtggtgggagtcggcctgaggtggaacagtgaggccagattccaggagaggcagggaaagagcaactataccacagctcgccctattttcaggcctttccgtaaatgcttcacaccctccccctgcagagacccatgagggagttagccttatatccctcaagcaaatgaggcctgaggcccagcaaggcgatgggcgcagggctactgccaggaagccgagtccgggcctgtctgactccaaagcccccgctcttcctcagcagtccctcaccccagccccaccagctccgcctgccttaccctgccgccgccttccacattccctcccacctcatccatccttgtcctttgatcatttctgtcagcttccagccgtcttggcctctgcctccctcctccaggaaagctctgctttttctctttgatcctgcacgtctgtcctctgctgtgtcctcagctgggccccacgtccctcccaccctgtccttgcgagatgttcccgcaccctctgccaagggtggggggctgaagagtaaccaagagctttgcagggaacctgggcctgcgagacagaagtgtggcccctgtcccccgactgctctttgggaaagagcttggggatctttgggcctagctgggctcagcacaggggcccagagatgagatgcaagcgcacagtccatcgatgcctccagaggcagccaggagcgagctggcagggccgtgcctccttatcctgatgggtcaagaagggcctcggtgcttctcgagaagggtgcagatgaagagcagtgggcccaagtcctaaatagggagtggtagccagcaacacccaccggtgcctgccaccactcacacacaggcttcagagaagaggggaggggcttgggaactcaaagacccttttggagccaggtgactccagtgggaagtcatgtgcaaggcccacagacagtgtaggggggaagagggaagccctggcaggagatgggggcctgtccagcctggctccccttccctaccctggtctctgggataaaggaggctgtctgggatgtctgtagcagcctccagctctgacccttgggattctaaggccttgggattctgaggccctgctgctcccagcttctctgggagggcctggcacccgattctcagctggaagagatgaatagagcagacccaacacccagacaccacggaggtccagccgctctcccgaaagcctgacagggggctgcagtagtaattagctccccacatatccccggggttatttttgtctcattctcccctggtttatttttaaagtaacactggcacgtggctggccggctgcccttcccaggtgcctgtgccaatttgggccaggaatggagcagggcaaaatgtgccccctccctcacggtcccgccctgagtgccggagctaaccagcccctcactgactggctccaggggggttcttgctgcactgaagcccagagtccagcctgtggcaagcaggtgggctggcagcagaagacccctgggaaattaccacgtctctgtcatgaagctgatacacatgttgcctaaccttgaccgagtcacctcacctgtcccagcatcgcctcctcatttctcagtgggatgaatgaaagtgacattgccttactcaccgtgaaaacgctctgaagtgtgcaataaactgaactggtgcagacatcaaggaacagcgtgattaactcccatataaacatgctgccccgcactctcccactaagtcccctccaaggcacatctttctccctagaggagtgactcccagtctggaagtctccactcccatttctccctttcccaccagccctgagacctgccctccacgttttctgtttggctgaaccctaatccaggctgcctggagtgaagggaggcagtataggggagagagtatgagggagaacctagctctgcatttacttgctgtgtgatcttgagcaactgcttgacctctctgtggctccgttactgcatcttcaaatggggataataataatatataccaatagggtcgtttgaagattacacaacgtacatatattagctcgcttagagcagtgcctggcacgtagtaagcgctctataaatgttagctaatattgttttgaattggagaggaggatcagtgacagaggcatttaatcattcgaataaagtcaagtgcagagaaagccagcttgcccagattccatatcggggctggggggagggagcagggtagcactgtaagctgcagctggggggagctgggtcctggggagattgcctgggtcctcgggaggctgcccagcttggagctcttggcaccataaaaagcaagctcaggacaccagtgcataaacaggcagcctctatagatcacaggagccaggaagtcactctcctcttataccctggcctggctgatctcttgccaatgttgcactgtgaacagtgggtgcagagaagctggagggcttcaggatggccgaggccactggaaaggctggaaaatcagaggtcagaagagagcaacaagcccagggcaagtcaggtctcagaaacaggctgaggtgggtactgcctccctgtctccgtgtaaagggcagtgtccccgaggatggggacaactgtttgctgtctccacggaggacagactgagtcaagcaaccgaaggcttgttcacttcattctgcagaaagagcatttcctatagggtgcagggttgagtgagtatgtttctacggagagtggtggattcttagcctcctagaagagtctgtgtccccttggctggagagaagggaggctgaattcagtggcttctttagatccctaagggcctggagcttgtgagaacagtggaaggagtgggaggcccagaggccaggtcctgtgaggtgctgcctctccctttgtgcagatgtcccccttccctgtgtctgtccaccctataacctatcgggatggtgggcagaggcgtgcccagaggccacagtaggggagaggctgggtgttggagtgtgtgtgtgtgtgtgtgtgtgtgtgtgtaggagtgcgcacacacatgtgaatgttgggggtggggacctcatgtctgcaggctggctcggagggagagaaggtccccagcagctgcctccaggctgaagtccctgttgcctggagtccctctcttcctgggcactatgccaacctacaccatctgagctcctgagccctggggagggtgctgagcctaagaaaagcctcctttcacatctcctggcatctgcttccaaattccctgccagcccagagctgtctgggcgatgaccagaatggagagtgaggagcagaagatggagatggggccacacatgccccaagctccccccaccacacccaacccattcatcaagactagcttcatggatctgctagttttccactgtgggcactgggcaaggcaggccagtaggagaggggccatctccacgcaaaacctaatacctggcagatggtggtgagggcagaagatgccattctccggggagactgcgaaaggaggaggcagccctggggctttcattggaggccagaagagatgagggagggaagtcagggcagcagcgactccagtgactctgcagcagtggaagtgctcagaggcgaggcatgggacagatgggaccagaaatggtgagggagtcaggagaggccaggccagtagggcgggatcaggtggtggatggagagtccacttactggccaggaaacccccagactgtattgtgtggactgggggaactaaggaaggtttctgagtggtgaatggcaacacagagctgggcttagaaacatgtatgtgggccggacacggtggctcatgcctgtaatcccagcactttgggaagccgaggcgggcggatcccctgaggtcaggagttcaagaccagcctggccaacatggtgaaaccccatctctactaaaaaatacaaaaaatttgctgggtgtgtaatcccaactacttgggaggctgaggcaggagaattgcttgaacccaggaggcagaggttgtagtgagctggaggttacagtgagccaaaatcgtaccaccagcctgggcgaaaaagcgagaatccatctcaaaaaaaaaaaaaaagggctgggtgctgtggctcacacttgtaatcccagcactttgggaggccaagatgggtggatcacatgaggtcaggagttcctgaccagcctggcccacgtggtgaaaccctgtctctactaaaaacacaaaaattatccaggcgtggtagtgggcacctgtaatcccagctactctggaggctgaggcaggagaatcgcttgaatccaagaggcagaggttgcagtgagccgagatcgcgccattgcactccagcctgggcaacagtgcaaaacctctgtcttgaaaaaaaaaaaagaaaagaaaaagaaagaaacatgtatgtgttaataagagctcctactttgtgagaccctccacacgccaggccttgtactggacactttattttacatgctgtcttctaaccgcaaggtcacccagccacctagcaagagatgggctcagagaggcagtgtgggtggaggggaagcagcaggcccagaatcaagaggctggggtcccaggtccaactcaggagctgcaactgcaggcgacacacccaatctttccaggcttcggtgtccccgactgttgaatggacaccaccccgcccagtgagccacagggattcaacaggaatggccctgcactgctcactatgttggggacccctgggacacagtgcttggggactggggccctccatctggagtggctggggcatagacagggcacagtgcccctttggaccagagcaagtataggggacttctgaaaggaaacagtgccacatagctaacgtcaaaggccagcaggcagaagcccagccctctccctcccgtccctcaggctgcattgttcctgtctctgccttgctctgcctttctcgggcttctcttcccccgcatgtggcttgggcttaccctggtcccagccaggactcacctctttctaaccctgcagctcagcccctcacagctgacccagcccctcagcccatcacaattcctggaagagagaatgtgaattgctaagcccagccaagtcctctcagcccaggtgcccaaccctggtccaatctgctctggtgccaggatgacatggtacaaaggggctgcctaggtcctcccttgactagggttgctgtaggacagacagttccaaaaaggtagaagcgggcagagcccgcaactatgcccaccacagagagcctccctggatccctgacccctgcactccagcttccccctctcacctcctgctctgtctggctcagggccacactgacacatccctaggacagaaaggacaggctacccaacttcagggtgcatctacctggcagaaagcagggtggggcgaggctcaggagagaggagctttggctaggaaggcctcttccatcctcacagtttgagcacctgctgtatgcacggcaccaagactgcaaggccagattctgcctagagtggagtacaatggtcttgggatgttggcctgttggacatgctttctatgcgctttgacaaagggagtggtcctggggacatctgagggggtcgacaaggttgaatcctacctttgccaatttttatctgtgtgaccttgggccagcagtgtctaaccttcctgaaccttagtttccccatcaaaaaggagcaaatcatggccaccttcaggtcatggggaacattagggataacaagtgtgagggcatccaggttccctgccaccattgccactgttcacggaggataccatagcacaggctccgctcaggcgtgtgaatgcctccctttctcgcccttacttcctatgctccatcctctgcattcccacctgcagcccagactcagctgcacagaggggaggccagcaggacagcacccacgcaggggtccaggcctgagccctgaccacctcccaaaaggcttgtccagtgcccagcacccttccgtgtgagccagccctcatcccccgtgctgtgtaggcagacttgactaaaaggagctttgctcagagtcaccgctgtacataaggagatgggtaaataggccagccagcgcctgccaagagaggcccaccgagtggcagagatggatgtgacgtggggagagcagaggaggctcctggggccacagcaggaaggaggcttcctgggggaaggcaaggtgcagggggaggaacagcagctagcactgcatcaacgtaggagaggtgctgactattgagaaaggaagggaggtctctgcactaactctataaatctgaaactgttctaaaatttaaaagttggttttaaaacatagtaaatggcaaacaaaccagaaaagaaagaaagaaggaggaaaagagagagtgtagcctcagacattgaccttgatccaatctgtagtgacaaccagggccaagcagctctgcacaccagccaggtgttcacactgactctgaacaatgtttccaggtgtccagggtcatcttccaaggctgcaagacgtggaaaatgccatgcttccagccacaggaacgctggcaagatgcctgggccttctgactccctttccaggttcctgggtcccgctttcaccgaatgggcccctctggcacagatgtatcatatcctggggcaaatctttgctcagagccatttcccacctgcctgctggcaactgttttagaacagtttcagatttctagagttagtgcaaagacctccctgcctttctcaacaagtctttgttcccagagggcaagatccagctggcctgtctctgcatcctctcttcacttagcctagtgcctggcacagagtagtaggtgcttaagaaatgtttgctcaattaattaattaagacaagctaagagggaataaagccattttcgccttgctgattttccagatgatattcttgagaccaggcaagtgccgcaggctccctggggaccctgcttcccactcagcctccccaggtgccacagctccctctgccagaggcagggtgtcttcttccagggctggccatgagcccccaacagcctgtggccagcctcagcctgcggcctcctgccatttggctcaggccagtggatgggtcctctgtggagacccagtgcactctcaggcccaactgctgctggggaggggttgagcaggaaggatcaggaagcagagctggagagagcacccgcctgcctgtcctccccaggccatcattttccagaacaaccttaagaggagggatgcaggcaggatgcagtggctcaggcctgtaatcccagtactttgggaggccaaggtgggcggatcacttgaggtcaggagttcgagaccagcctggccaacatggcgaaaccctgtctctactaaaaatacaaaaattagccaggagtggtggcacacacctgtaattccagctactcaggaggatgaggcaggagaatcattgaacccaggaggcggaggttgcagtgagccgagatcatgccactgcactccagcctgggtgacagagtgagactccatctcaaaataaataaataaataaataaataaataaataaggagggatgcatcaaggtccccttagatgggccatggatcctgatccctgggccccagcccagagaccctggaggccacatacctgtgtggccttgtccaaatcaccaaccactcactcagcccagtctccttagctgaaaagccagggcacctgccttctggcatgcagcatccattcaactaacattagttagactggacaaggtgaccggcctgagcttgtcccctggctcagacattcactagctgtgtgggcttgaatgagtcatggaaactttctgtgtctcagtttccttatctgcaaagtggacataatactcatctaaaatgtttgtgaagactaaataaacgaatgcgcagaaagcacttactacagtgtacagcgtctggaatacaagtgcttaataaatgtgagttttattattactacggctgcttttgttgttactaccaccattagctgctgtgtgccaggcactgagccactaagaagtacaaggcagtacccctgccctcgatagcctctgcgtacagacttacaggacaaaatgacagccaaaataaaaagcagcagcagctaaataaatgaaagaaagcaaaggcccaagtccccaagatcctggtctcctgcatgagatgagtggcagggagtagaggagaagctgggtaccaacacgattcccaaatgttctggcttgtcttggcatgggagactcaggcagggacacgtggccatctcctccctgactccatgtgcccctgagggccgggagggtgtaggggccgggtcggggattttccacctagctctgcctgcccctccgcttcagctggggaatgttacaatcagagctgggctggccaggccggccccaggtccctcaccctctccacagcatctgatcagtgcccaccaggactgtcggtctggcatacacccaaatgcccagtgttattgctttgggccagctgacattcccagtggcctttgtctgactgaaactattgctgtctccactgtttgtgagggagagaatgtggccctctgaaagcccacaatcctagaacgctgaagggcctcaagaatgtcttctaagttcttcatttcccagaagaagcgctcgaggcccagagaggggcagcgtcttgcctgggatcacacagcagcacaactagaaccacaccccaggtcttctgacttccatcttggtgtgaagagtcccggggcagccaagtgcagcagaaaaaaactgcctttgaatttcaagtttgattctaccatttatggcctgagatgaaacactgtctctctctctgagcctcaggttccacatctgtaaaataggaataatagcacctcctctaaaggacagcaatgcaagctcaaacaatagaatgtatagagattgctttgtaattgataaagtcctgcacaaatgaaatacaagggattattattctagaactcagagcacagcacatattaaggactcaaaaacacctgctggttggagtggagaaatgtttgaaggatgatgagtaatgaacaaagggcccctggagcactgatttgtttaggtgggtgagatcagggaaggtttcagagagggggtgacttttgaaatgggctttgatggaggagtagaagcccaacaggcagaacaaagagcacgagcagtgtccagaaatgtggaaaggggccctcccaagagctgctgacaccatgtccgcagccaggtttaggcaccagatcctgctcaaaatgtacccctctcctcagggcctctgcatggtacatggaataggagcaactagcgatttactcaatgctaaaatacaacttttcagggaagaagagacataagggatcttctaatctaacttctcttttgaaggtaggaaaaattgagataagaaaactgactcagataagtctcagggagctggcgtggcttaacaaacaccctgcagtaggcttagcaaactagggactatggactgaatctggcccaccacttgttgctgtcaataaagttttattggaacactaaatttgccatgcccattgtcacgtagtatccatggcttctttcttggttctatggcagagtcaagtagttgcaagagaccacagactcataaagcctaaagtatttactatctggccctttacaggaaacagtttgctgacccctgtcatacagcaaggtaatagtagagctaggatggtagccaggcctcctgactcctagtactttgtaattcctatgcaccatcaccctctgggccccgccctgcccccataacactgcccactgggtgagatttcaggcagccagactctgggcctacacctaggctggcctctgctgctcctcagacccaacagggcttccagttgggagaagttcattccctttaggagattgtggcaaggagataccaacacacccctgtttctcctcaatgggctcaacaggaaaggcctgggagtgtaaatgtgtaagattcgggccagccagatgccagcgtcatggacagggccttgaaaaaagcatgtgggggaaaactggcacctcagccatccgcgaagagggccaagtccactttaaattgtgctgtggaattcctttctcaatgccaggctgttcctggtggattcatttaattaaaaccccaccagatccaatctgttagaagctctgagctcacagatgccctgtccagctggtcatgaggatgcagacaggccacaggcctgggccatggcacctggctcaatggctagcttagaacaggccccaccggccccaggtcagggccctgcccaggacccccaggataactggctggtggtgtggcattgcctgctttagccctcacgctctgcttatcctctccgtctccattctgttcaaacctcaggctcatctctgatgcctccctctccctcagtcattcattcaacagaaattgatgaagcagcagctctgtgccaagcccccttccaggtgtgagggatccagtagcaaacaaaagagatgagaacccctgtcctcatggggcttacagtttcacccatgaatgcagggcatcccacacaccatgcatccactctcctcccctcgccccttcctgtcctctcctttctcggcccctcgcccctacctcctcctctcatcccgaactcttggatcctccgcttccctctagctcaggcctgagcacttgacaactggaccatgcagaggacctcagtggatccacctgcccccatctcccacagccacgcccctgcccagggttgccaggcattcagctcaatatctctctgagcacagccctcccctgctcaggagccatccatggctcctcattgccttaaaacgaagacttcattcctgaacccacccttgaaagcacctcaaattttggccccttctcaccttgacgatcttcacttttcaactgtacttcctgttccaagaacgccagaagaacttgtgctgtttttaggtttataatattcatcgttttctacttacaaaagtaatagttttttgtagtgaagaatttataagaggaaaattaaaattaatcacgagcccattattcagagataagctatatgagctttagaatatttccttacagctatatatgtgtgtgtactcatacaaaatgtatatgtgaatacacttttttttttgaaacagggtctccctctgtcacccaggctggagtgtagtggtgcaattactgctcaccacagcctcgacctcccgggctcaagggatcctcccacctcagactcttgagtagctgggaccacaagcacaagccaccatgcctagctaatttttcgtttttttctagagatgggtctcactgtgttgcccaggttcgtctcggattcctgggctcaagcgatcctcccacctcagcctccccaaatgctgggtttacaggcatgaacgagtgtgcccagccacatttttcatattttcatattagcgtgggatcccacaatatagaaagcgttgtctcctactcttttaatttaacatgatgtggtagttttctatgtaatcaagagactgttcaagaactgcactttaatggtcacacaatattccaccacataaatataccttaatatgtttaaccaaactctattggtggatatttggactgtttacaatttttcacaatgaaaatgctgctataaacatccttgttcataaatctttgttctgatctctggttattttccgagcagagattcctagaagtgccactgcagggccactgggtagacacatttctaagcttcttgattcgtatcatgcagctgcctttctgagagagtccgctggcccccacaccaaccccatttgtgagcacacccaccagtcccacgcaggtctattttctctgaccttaacacatcatgtgtcatcctaacattgtatccttgcctcagtagctcccctcatcagaaccctgcatttcctatccacccttcagagctcagagcaaatgtcacctcctccatgaagccctccctgataacccaaccaaagttctctatgtccagccctccttcggcttctgtcttaaatccctcctaaaacatttcccacctttgccatgcattttaataatttgtgtaataataacctctgctttatacagggcactgaagttttcaaagtgcttccactgagaggtttcatttgattcaatcccagatggaaagtgttttgaggtcagggacctcatcaatagatcatctaggtctatttctcctggctacatcaccaactcaagtccagcacaacctcaagctagcccttgtgtaacagaagtgtttcaccagcccttgttactccttggcctatcagaacagacttcaagatgctcccttctgcagcatagggcagtaaaagatgacatgagggccctggattccagtcctagctgtgtcactgagttgctgtgaccttgggctagtccctgctcctctctcagcctcagtttacccatctataaaatgagtggggggaagggcaccgtggctcatgcctgtaatcccagcactttgggaggccgaggcaggtggatcacttgagatcaggagtttgagaccagcctggccaatgtggtgcaaccccgtctctactaaaaattagccggatgtggtggttcacacctgtagtcacagctactcgggaggctgaggcagaagaatcacttgaacccaggaggtggaggttgcagtgagctgaggtcatgccactgcactctagcctgggcaacacagcgagattccgtctcaaagaaacaaaacaaaacaaaacaaaaaacgagtgggttgaactacgttgtcacaccaggactgatcgctcctaaggtccctatccccaggcacccagagcagccctggggtgcctctgagggcctctgcacaaagccggcctctgggatgggccagaaggagctggccagggaggcaggcctggctctaggccaggctgtgtctgcaaacactgaccttggctgccgcagggattttccatgacaccagcaccctccctctgagctccctgcatcacacatgggcctgaggagggtgggggatgggggctttgggggtttgtcctacatcagaggccccaagatcagtactagggccacctgtggatgggaggcagctcaaggcaagagaggagacagcagtgggcccaagagtggggagtccaggaggaagcatggggcagggagagaagctgctgggggtagtggggggaagagctgggagaggagatgggacaatgggaagagaggcctcgggaaggggcagggcagaagaagcggataggtgctgtgcttcagagctgtccttcccaggagctctggcctgaagagggacaaactccagatcccattctgtacattggtcccacccctaccccagctccatgagacccggtggttcccaggcctagctaggggcttgcccaggcccagtgcaggggggattccttctgaaccttgaagctgacctcattttgaaggggccagaggccacagtgaaggcaggagctatgagtcacccgaggccctcctgccaagggccacctcccgtccccatcctggatgtctaaggggtggtttctcatcaccatcccagacctcagagtccttcagaactggagcctctgggttctgcagccctcccaccccaggcctgtgctggacactgaggggacaagccagccctgcaggactcctctgtggacatgagtgcccaaatacagggtgggggcctgagaggggcagagggaggagaggcctcttcagtgcccagagaaggttcccagaaggttctcgggaaaggcagtgtctgagctgcatctcacaggaggagggagagcacctgcgccctcctcccgtctccaccaagctgcagcccctccctcctctcctcccccaagacctgggcacagaagctaggctccttccgcctcatctcctttaacatgccaattaggctccctcagagcctgcagtcccacttcctggttccacactgctgccatccccacaactgaggggcggctccatgtctgtgcctcaggcgcctgagctggttcctcgtgggccctcccctgggtgccctctgagcccagctgccctctgccatccagcaggggagcccagccttcctctgagggccctccctgtgtcttgcagcccccagagctgcctctgtctcccccaagcccgcactcctctctggctgccacaccaggcccaagccacactgaggtcacttcggcatcagcccagagttcacggcctttgggcacctcaggccacaggtccctcatccaccttccctcaggacaaacattagcccagccattgcctatttacattagataactaggtcagcctggagacaggcacagctggcattgccaagggctgtggtttctaatctacagaagggctgggccacccagagaaggagatcaaagaatcatatcgtcagagacctgggggaaggacctcagaggttcttgatactgcacaggagcgtttcccaaactgtgctcccagaaacacttgctcggtaatgtgcactatgagaaaagtgctccacggtcaaggaagtgggaagacaggcaccttttcctggccttgatcgaccttgcacatgaacacatacatagccctgagaaagcctaggctcaaatcaaatgatggtgaatcctgttaaattcagcatttccccaatttaattgagccaagcaactcttttctcatccaacagttgttaacattccatggaactggtatttcagaaaaataacttgagtaaacactgatcatagaatgttggcactgaaaggaactttaaagatcatcaaatcttggtgctccccaaaatattcatattaataattcatatttattgatctcaatgtcctaagcatgttaagtctatgaactcaatcaagtccccacaccaagtctatgaagtgagtacttcattattcccattttacagacgagaaaactgaggcacagtggattaagcagtgtggccaaagataaagttgtttggcttcagagcctgtgatcttctctactccactaaactgcagagatcctctccctgtgttcagtatttcaaacatacaacaataacttaactccatctcaaagagtcaattatctcaggctaatcagactttctgactggcagatgtgtgcttaattaattttgatggggaaagaaattaattatggttctaacaatgatttattcagtgcctgctctaaagagtatccacactgcactgatcaccacatcgaacttcataaataaaatcttccaaaattttgcctctgtgaatgggtgagtgaacagagaaaataataaaaggcagtgggaaaagctgggaacctcatctcttgccctatcttccatgtcacagatgaggaaacctgaggcccagaaggaacttgccaagacacaaagctgtctttgatcagggtcaggtcagaccccagatctcctgcctcctagccccatgctctttcctctgcccaaggctgtggccagcatcctggccttgtggccagctaggccaagggtaggaggtcaagcaagcagactagcaggcataggaggccagtgggaaacaagcagccaagcccagtccagccaaggccatgaccaagggctcagagtggctagttgtgctttgaatagaaggaaataagccacagggagagaaagaccagtaaaagggaggaccagacccaatcccactcccacaccaccatccccaccccgcatctccctggaagacagcttcagccagtttctgacctccttggtgattctgggaggaaaacagaggaactgaggtggcccagggtttgcctctgatctcttggttttcctgctgccctaaaatatttacactaacaattaatttttatgtccagccacctggcttccttaggtggattctgtgcctccagccagggtcccaggccacctcttagctgagttgctcccaagtaggagctgctgggccatgattgaatgaagaggccctggtcatacctgagctggagggcagtggacagagcattggttttagaaccaagtatcctgggttataatcctggttctggcattcacaagctgtgtgaccttgaacagattgctttccctctctgggcctccatttcctcatctgtacgatgtaaagactgaaccaaatgatggctaagggtatttctggatctgagaaccttaaaacctatgttggattcagggaaaggaggctgggagaggaggcggtatggatagtcctggtagttttctgagaggcagtggccagagtctcccggtcagaacatctgctctggttgatcagcccagcaggtactgcgagagagggtcctcagagagtcagccacacagaaggacagatgcagcccctcacccagagactcgaaggcctggacagaggagagaagatagagaacaccttttgccccctgcctcataaagccaagcgcgacatgggcaaggaccaggcaggcagcgggcctgctggcaggcagacgggtcttgccaaactcccacttacttcccagaagctccagggccccctgggagtggctccacccagctggcacccctccaagttgggcgcccacgtcagcaggtcctcacactcccttgccctttcacccagtgacaatgggacaggcaatggggtggggggcaccctaagccggatacttggagaagcgtctgactgcctgagcatggccctcctgttaccacctctgctgcaactggctcagagcaacgcctgaggctgatgcccaagtgaaatgctctcctcccaaggcctcccggcctggtcgcccttcctgggtgatgcattggctcccacgtaccggaatgaatgctgagtcagaaaggcccagtggccttggccaacacccaaggcctctctggacttcatgacaccaactgtaatatgaagatagtcataatagtgaccttgtaagaagtttttgaggattaagttaaaaatacatctgaagggtaagaacttattattcttaagcctcagcctgcggtaggaagtgagattgagccctgggggcatgtgaccccaaagaggaggcacatctaggccagggctgcctggacagggcagtggctgtggtggagcatgaggtgctgcctgggataagagcctctggttaagcctggatgtgtcatttgctttgaaagtcactaagttcaacaggatgaagggcagaggaaggggttgtcacttgcagctgaagctgggtcctgaggagctaggtctttgtgggctggggtaggagaggcgaaggagggccacgaggcagtgtgggaagcactgtggagaggaggggccggcttggctgggtgtgggatgaggacgggtctctggggtggccgcagggtatagcaaaagaagggcaaggaagggatgtgtggctccttgaagctgggcgctttgtgagcacagtcacagtgggcagtgaggctgccagacagggggcactggcttttcctaagagacggtgggcccagggaagtcacggcctatgacaaacacaggacaagggagcagtggtggcagagagggggtgagggcccctgatggtggtatgtgtctgcctgaccccacagagatggccctgcccccaggcccatgctctcaggtcacccttcccctgtgagatcccacgaccactgcttccatctcgcaagctacagcttccaaagagctctaacgcccagtctctcctgtgctcctgcagagggctctggcgggcagcgagggtgggggttaatagctctagctcaatcttccagagtgtaggaaagacaagtgagcccagagaggggtagggatttgtccaaggtcacacagctatcacgtggccaagctggggctatgtccatgctccctacttcctgttgagccccatccatggtgccatgccctcccctctccaccaagtagtgccggcctggaggacagggaaggacgggatgagaagcagctctggctcagggcctgcccagttgtcgaggtgagttgtggtctggctgccatggcccagctggcgggcacaatctgttctcaccctactggagcacagacgtcctaagcacagtggctctacagctcagctgtccaggtccctagcaaatggtgacacagttactggcccgacgctgtggagggggtcaggggagctggttctaagggcagccccaagcagctgtccccagagctccttgagctttaagatccaaatggccctgggttgacagaggtgccagctttactggaactgagctgccctcaagcctggctgctctcttggaaacatgacagtaatctggcacttcactcattattaatcacagtgagccattattgagcacttgataggtaccaggctctgggctaagtgcattacacacatgatcttacttattcctccccaaagtcctgtgaggcaagtgtattattaaccccattttatagatgtggaaactaaggctcagagaaatcatgcatacacacacacacacacacacagagagagagagagagagagagagagagagagagagacagtaagtccaggacagagtcacacagtatcctgccttgcaatttagttatcaaacatattctgggcctccataggtatggctggcaatgtggaggtagaagctagagaggaaagtgacaagacccatcagtgccaccccttccccccaaagctagtgtttagctctatgtagttggggatcctagaggacagggggtggtggtaatattggccctggaattacaagctgaacattttcagtgccactcaaataaggcagagatcataagctgtgaggaatccaggaggactgcatggaagaagaaacatttggttaagatttgataaggcttagaatggaagaaaatgccagcgtcattttattatcataattatgttaataaaagtagtaaatatatcaacaataaaagaagcaggccagcaccagtaaacacactttacaaatgaagaaacatgttcagagagtgggagtaatttgcccaaggtcacacagccactagggccctgtcactagggatgagttcccatccagggtcattttccctccagttagccggaagaattctcaacttaggctttggaatggctggtgcagagggaacatttgcctctgccctgatcttggctcagggtgggccagggtgggggcggggtacagagagattatctggctgatgatagtaacacacctggaaagacaccgagggctcctgctttgccaagggtaacaccacctccccatgaggacagatcctacatcaggtcaagtacagaggaagaccccaaggcctccagttggaggctgatggggaccctggaacactcattcatcctgctcttgcagggaggggcaggcagtctcctttcttctgtggcacagtgggccagctgccccagggagactgaagggcccttgttgccaagcaaccccacataagctttggctggcagcggggaatccaccaagaagccagccctgcctcagtctcccttcctgtacactggatcacaggatgtcagaaaccattcagggcaaccacctcaccttgtagtcaaggaaactgaggcatggagaggacaaggaccacgcccgcagcccaggacactgaactagaatccagctctcccagctgacctgtgccctcacactctccctgtgcctctagacaagttctcagcagcacccaggccaccccttctctaggcatacaaaacagtcccgtcattgaggtcaaacggactcgagttcaaacacggttgttctgctcccaagccgtgtgaccttggaagtcatccctccttatttcttccttcctacataccttctgcaggtgtcacaagagtacaatagaaagcatgagccagggcctagcacagtgcgtggggataaggagcgcccatcactgtggacccagacccacaaggtgggggaggtggcggggcaacggggagggagaagaaggtttctggaagggcagccccaaaatgtgtgctttttctcctctttcccactttcccccaggctacgggcacgcggcacccagcacggatggcggcaaggtgttctgcatgttctacgcgctgctgggcatcccgctcacgctcgtcatgttccagagcctgggcgagcgcatcaacaccttggtgaggtacctgctgcaccgcgccaagaaggggctgggcatgcggcgcgccgacgtgtccatggccaacatggtgctcatcggcttcttctcgtgcatcagcacgctgtgcatcggcgccgccgccttctcccactacgagcactggaccttcttccaggcctactactactgcttcatcaccctcaccaccatcggcttcggcgactacgtggcgctgcagaaggaccaggccctgcagacgcagccgcagtacgtggccttcagcttcgtctacatccttacgggcctcacggtcatcggcgccttcctcaacctcgtggtgctgcgcttcatgaccatgaacgccgaggacgagaagcgcgacgccgagcaccgcgcgctgctcacgcgcaacgggcaggcgggcggcggcggagggggtggcagcgcgcacactacggacaccgcctcatccacggcggcagcgggcggcggcggcttccgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtgactgccccgagggacctggagcacctgggggcgcgggcgggggacccctgctgggaggccaggagactgcccctgctgccttctgcccagtgggaccccgcacaacatccctcaccactctcccccagcacccccatctccgactgtgcctgcttgcaccagccggcaggaggccgggctctgaggacccctggggcccccatcggagccctgcaaattccgagaaatgtgaaacttggtggggtcagggaggaaaggcagaagctgggagcctcccttccctttgaaaatctaagaagctcccagtcctcagagaccctgctggtacccagacccccaccttcggaggggacttcatgttccgtgtacgtttgcatctctatttatacctctgtcctgctaggtctcccaccttcccttggttccaaaagccagggtgtctatgtccaagtcacccctactcagccccactccccttcctcatccccagctgtgtctcccaacctcccttcgtgttgttttgcatggctttgcagttatggagaaagtggaaacccagcagtccctaaagctggtccccagaaagcaggacagaaagaaggagggacaggcaggcagcaggaggggcgagctgggaggcaggaggcagcggcctgtcagtctgcagaatggtcgcactggaggttcaagctaactggcctccagccacattctcatagcaggtaggacttcagccttccagacactgcccttagaatctggaacagaagacttcagactcaccataattgctgataattacccactcttaaatttgtcgagtgatttttagcctctgaaaactctatgctggccactgattcctttgagtctcacaaaaccctacttaggtcatcagggcaggagttctcactcccattttacagatgagaatactgaggcctggacaggtgaagtgaccagagagcaaaaggcaaaggggtgggggctgggtgcagtggctcacacctgtattcccaacacttttggaggctgaggttggaggattgcttgagcccaggaattcgagaccagcctaggtgacatagtgagaccccatctctacaaaaaataaaaaattaaccaggtgtggtggcacgtgcctgggagtcccagcgacttgggaggctgaggtgggaggattgtttgagcctgggaggtcgaggctgtagtgagccctgattgcaccactgtactccagcctgggtgacagggcaagaccctgtctcaaaaaaaaaaaaaaaaaatggcaaagggagacaagagcccagcctgcttgttgctagccaaagtgttctttccttccagcttggcctgctcttaaaagcaaagctcctgcagtgtacatcctggcattgtgtggctacctgggttttaaaccagaatcagaagtcccggatcagagggcactgctgaggttcagcctcttctcttcttggccaggaggcagcagctctgaatgggcccctgaggctgcacaggggcctttgtcactggggcgcatgcttacaaacagtgcagttcttgggaccgaggtaagcagggctgggtctcatggcagaaaggccaggatctggggctctaggaatttgggaattgggcagagtggccaagaaagctggcaggcatatcctatgggacatcacacctggcaccattgtcattgttggtgcctgtgtcccaagtagctagtgataagctgaggctgcagcaagaaacacccttcccaggtgggggagtttggaccagaggtgccctctgcccaccacacctgcaacccagaagcccagatggaacgcagctgacgaaggtgatgcttgaggctcacttttggggccccacagctggagccggtataatgactgggacaacatcaaggggtggatgaggggcctctcctcccgcaacactgccttcccatgctgttcccctgccagctccttaacactgccgaccaaggccagccctggcattcagggaaattggagggcagcacccgtagggtggccagcctcaggccccaccccagctgtgtcctctagtctctggggacccctggggggaagaagtctaccctgcttgtgagtcccgtctcagtgtggaggaactggctgcacatgggacctgaaggtgccctctgtgtttatgttgggggtgggggggcagtgctggctgcctctgtcctgtgtgtgaccctaccctcgaagggtcctgtcctgtcagtcccgagggagccacaaccaaagctgcggagagaaggtggggaagggtgcggaatggccgtggggcacagcgtggcagactgttcagtctctgctgggtctttcctagggacctggaaggccagtgttgcttccccctcactccctttcactgtaggcagcctctctgcttccccaatgccttatgcctgggcacactgccacagaatatgcaatatgtgtgggtgaccatgccctcacgaccacacccccaccccgggcagcccccggactccaaaggtcgtggctgccacagcctccctcagctcttcctgcctatctgtcttcacactgagaatggcgcccaataaatgctatccacggagaccaggctcaggctccagctgcctctgtcatcgtatgcccttgctgctgccagggaggggccatctcccaccccctcccctgccggggtctacaaacatatctagctgctgggtgccgtggctcacacctatagtcacagcactaggcgggcagatcacctgaggtcagaagttcaagaccagcctggccaacatggtaaaaccccgtctctactaaaaatacaaaaattagctgagcgtggtggcgcatgtctgtagtcccagctactcggctactcaggagactgacgcacgagaatcgcttgaacccgggaggcggaggttgcagtgagctgagatcgtgccactgcactccagcctgagcgacagagtgagaccctgtctaaaaaaaaacaataataataaaataaaataacatacctagctgactcgccatgggctcgctggcctgtgggcgacactggcttcccttttgggatttcccagaagatccagattttcttaagtccccttggaacagactaagaaaggatcaccttagaaatcacctggtcctattgtcccccccgtacatgagtaactgaggcccacagagagcaaatcgcctgcctgagtcacacagcagtgagtggcagacctaggctaggaactaggact

SEQ ID NO: 13298 - DNA, 6442 bp, Human
gactgtggggtcatccccaaaccagactcaccttactctccttcctgccgcaaggtatggatctcaccacccccgggacatggagttggctcacgtccagtacctggacccgtgctttcttagctcatgctttcctgaggaccctgcagatgaccccttagaatggtattttgctgggatccccatttgtcttcagtgtaacccattagttaaaccgcctactgcaaggaaaccacaaggcttggatcagatcatgaggctgccctacaagttatgccaaaaaatatggacttggaagacctgtctgttataatatcacacccaaatctaaccagctctgccaataacagctctctcctatgttactaggaaaatgcctatggattggagtgtgttctgtgtgcaggaggctggtccaggtttcacttctgcaggacactggacatccccacaaccaccagaccttccccacgtgcacacacaccccttctcattttgcctctacatccatatccactgggcccttcaggcacctactaatgccctagaacctaaaaccatcatctggggcccagttccccaaatagccctaatttcttcctctgctggaatgagtccagtgcccacttcctccaaaggtgaaattgctgggcctgcaacagatcaggaactcactgcttcctcataggggcagccgacttcactgctctggaacagcgaccacccctagcgaggcttgagatgcctcttccctccttaagactgagagcgccgctgcccccagtcctccatagcccagtgcctgctgccttcacgcagagctgcaggggaggccctgagcacccagcctgctggaccagcgctgtgcacggccctcccatggcggcaggggctgcctggactgcatactgggttcagcaacctcactataggtattcattccctcaggaacaactgcattcttttctcatttccagaaacctcatcccgtttacctcactacaaggaggaggatggtggagagtggtacattttaaaatgtgcactagtctccctgggactccccttcaaataacccaggagggaccacacaagggaaagcttatgcatcccccccacccagtgaccatcttcctaactctgggtgtagggagactcgtaagcctacgggattggtttgggaacagggtatttgagctcacaacacaaggtgatgcaagctaacaccaatctcgctgcagctttggccaccatcctaagggacttctgacagacattaggtgtcacgcaatcatttgatgagtccttggcctggatgacctagacagtcatttaggcttgaactatctaaggccaagcaaaaaggtgactgtcccctctagggaaccacatgctatatgcacatcctttactcgggagcctgcaacctgccctatccagcaacacaagcccaggcggtattcagtctcatccaggtattctccaaccttacttgtctgaatggcttggatttgtttttatggttagaccccagggcctggggaggtcagttcagaccacattccaaatcctcatctgtgtgtgggtggcattttgatcctagtctcctcgcaaggtgtatacaacaatatgcaggccaggctctcctggtggctttaaatattccctcggtccaggtagttcagcctcagccaccagcataggtatcatggggtcaattgtcttaggagtcatgaggaatccatagttgattgctgcctgggcctggccagggctgaccaaagtagacgaggggtcggtacctccgtggactcctgcttgaactccagctttctgccaaatttctcaactgcccttgttaacagttatttaaagtacccaatagaaagtaaccctgaaaaattaggacacctgataccaaaagacccttaaataaggaagtcctctcctctgtgtgcatggctgctcttgctacataagacctggaacacaggactgctgtctgccctctctgctcgccctgcctagcttgaggatctgtaagtaacacaaaacttaaactttcacattgaggtttcaatattgaagctgtgtccccagtctgacctctcactgtggggccaccccagagggacccagcgggtgaagcccctgctgtgaacttctatctgggtgtctggcggctgctgggggtaatggctactagctaagtcaatagagaaactcaaaaagtttccttccaaacacacgtgtcctacttgacatgtccaataaagacgatcacagcttcttaaaacattattttattgtgagagaagcctctgcaggtcctaggtctgtttttcaatcaggttgtttgttttttgctattgagttgtttgacttccttatgtattcagatatttaccccttctaccacgtaggctttgcaaacattttctctcattttctgggttgccgtttccctcagttgattgtttcctttgctatgaagatgctttagcgttcaatgcagccccgcttgtctattttcccatttgtttattgcctgtgcctttggtgtcatagccaagaaatcattactcacgtcaatgtccaaagctttatctttgtatgtgcttctcgtagttgtatggtttcaggtcttttcaagtctatgttgagtcttcaatccatgttgagctgattttttacatgctgtgagagaaaggaccacgtgtatgcacctagcaactcatgaaccttacacaactctttatctctctcactgagctcatttcacctgtaccctgataaggtcattgtcctcttcactctggcccctacaggagactactcaccccattacctcagtcgccccttcatgagggtataatgacctagaagcctgcaatgagttactctctactccaccggaattcaggtctggcaccagtgtttagacctgaagagaatagtagggcccattatcaggaaataagaggcatttgctctcttaaattattgaatgaaagcactgtttccattctttttagaatattaaagatttaaccaggaaatattaggtatttcctgaaaacaggaaaaaatgccagggtcctcatcatcaccatcaacttcaacctagcacagacactaaacatagagcttcctgtgaagaaagctgggagagcagaggagcattccagggatgtcaaggccaataggagtcggcatcctctctaacaaaatgcacacctcctctcactcagaaggccaaaggtttcttatctctgtgccttctcccagcaaagctataaatccaagctggcttctccctccccacacagctgctcctgctctccctcctccaggtcaccccagccatgaggattatcgccctcctcgctgctattctcttggtagccctccaggtccgggcaggcccactccaggcaagaggtgatgaggctccaggccaggagcagcgtgggccagaagaccaggacatatctatttcctttgcatgggataaaagctctgctcttcaggtttcaggtgagagaggccagcataaaaaagctaccgagtctagagagacggatgggagatgggctctggaatcacatctcaatggtggatgtcacttaggtggctttacttaccatctctgggcctcgattttcttatctccaaactgaatagagagacaaacaaatgtaagtagtcttctttctccaaagacttgattccaaggtatgtctataaaattcgctagggttaagatatggagagacagattgaccagttctttctggatctaaacaagtagatattatagggaaaatatttcattctgccaacaaaggaaattttaaaaactggagatgggcttaagagtatgttcaggtgtgtgtctgatggggcaaaagcacacaaatcagagcaaaagagaatgagtctcaaatcctgtatgagcagcattgctctgtgtatttattcctattgactaaggttgtttgtgctaccggcactaatgcagccagcatcaccggtcagccagcatgtgacttctccaagattccctttaccacccaccgctgaccttggtgcttaatttctcatgcttcctctgtgttcccaggctcaacaaggggcatggtctgctcttgcagattagtattctgccggcgaacagaacttcgtgttgggaactgcctcattggtggtgtgagtttcacatactgctgcacgcgtgtcgattaacattctgctgtccaagagaatgtcatgctgggaacgccatcatcggtggtgttagcttcacatgcttctgcagctgagcttgcagaatagagaaaaatgagctcataatttgctttgagagctacaggaaatggttgtttctcctatactttgtccttaacatctttcttgatcctaaatatatatctcgtaacaagatgtctttgtttacacctctttgaaatttgatatgtgtctgtgtcaagacactagaaagcaactgccagaatcctacatgaatattttggaacaaattaaagtttcaaaatctagaatttttaaggaggagccatggcttcagacacaaactgaaacgaaggcacaaatgatgccactgatctcaccatccactgctctgtcttttcattgcctcattttgaatggattcactctcaaagacaactctcatatactaggcaaaagaatcaatgtcagcttccagtttagctactcacaacctcactacttctcgggaaaaaccaccatcctctgcgtcaaaatattggagttttattgaacatgtccaggtcacacatttgccttttaagacatagggttataggagatccactgaaacaactttaattaagagggaaatgggttgttagcaaaggcggggtgcatggaacacaaaacacagcagcccacaatgggatgtcctcattaagagcacccttcagccacgtctatgaagacctggatttcacacccataaagtcgtcttcacacccagaaaacgcacacacacaaatgctccactacactttgcaacgcgcactctcttgggttgccttaaagctgctgagaacctgattctgctgggaaaatacagcttcaccagaaaccttacattcctgttgttgctgcaggctgcggctctgataaccacaacatcctgcacatcagtgagtgagcaagaaaccaggtctagggaaagggaatgaaccaggagcgctctctgagatgctcagagcatttcctggaaaggccacagcgtcccctgctgtcctaccttcaactgcagcctccccatcaggcacagcacacgtggggtctgtaccttcctgagcttgtcttcctcctcccctccaagagaacagggtcactgcctaacccgggtgtccctgagggccaggctgacatcttgctggggtgtgatgtgacctctcttcctgtctctcctctctgtccctaccctagaaacccactgtacctttaacaatagttgaggatgtcttgtcaatggcctatgaggacatgatcacaaagctccagggacaagtccagcttggcccacagatttcttatattttggatctagcagttccagtttatgaatccactacacatgcttggaaaaataccttctctgttcaagccatggctcctcttatctggagggtcattcatagaatgcccccacaacttccaagagtgacagagaaactacagtttgcaaataaagggacagtgattctagtaggattattccccattcttgaccaaaacaatctgatgggccaagacacagctgtgaccaccaacaccaaccacccacaatgcccagagcccaggagaaggaagcaggtgttctccacatctacccatgcagattctgagcaggtctcagccccagactgaggctctgcctgtctgaagaggcagctcaggggtccaggcaccccactgagacacttcacagctggggaacccaatacaggtcccagggaagacacagtgggtctgtgattgacaaagaaatggtccaaggtcttccccttgtatcgaaggtgaaggtgacattttgggtttcaggatgtgaaagggggacagtcttccttgggttcctgtaaccgccactgacttgaagtcacgcggttcttgctgtaactctgcatattgctcctaaccgtccactgagtccggctgactccatcacgcggtttctgcacttcccagaagtccacctggcttgcgccctagatcctggggtctctgctagaacttccctttgtcactgaggactttgctgatttcttaatttcaaattgcaactagttccccctggtgacctctatccccctcttctctttatttttaactgtagaattgtaagctatctcacatctgtgcatttcatttactctctggaacattt

SEQ ID NO: 13299 - DNA, 4881 bp, Human
agattgaatgatacagggacattatattttactgaattagtcctcatgtaacatttcccagaagaaaagctactttttatttctccccacctttgaagccccttaagaaaggaacagttgggcagggtgtgatggctcacgcctgtaatcccagcactttgggaggccgaggtgggtggatcgcttagtccaggagttcgagaccagcctggtcaatatggtaaaacactatctgtactgaaaatacaaaaattagccggcgtggtggcatgcacatgtaatcccagctacttgggaagctgaggccggagaaactgcttgaacccaggaggcagaggttgcagtgagccatgatcacaccactgcaccccagcctgggcgacagagcaaaactccatctcaaaaaaaaaaaaaaaaaagaaaagaaaagttaatggggcccctgactagaaagaaagaccttctgtgagtcccctcactctgctagaaatccggtcatccggctcagaaatcaacaaggtagacttcaggattaattggttggagccctgatatttcatgaagacaaattagtacattatcaagcacagattatttttattgactagtggtcattttaataaacaaagaatccactaattccttcttataagtagaagttaatttaatattttatcacctttcttatttccaaaaatgtctaaatcagtcttctcttatttattctcttttttccacaatgacaaactatgtagtccactatagcaagctatctctaccatatagaagaaatgaaatctaatccttttggtacctggggagctcctcagtgaatcctttgctatcaccatcttggataactctctaatgctgcttccaaaaaggcagtggttgctccattttacaatcccaccaacaagggttccaatttctccacattctcaccaacactggttattttctggtgtgtatgtttttggttttgtttttattttaatagtagccatcctaacagatataaggtgatatttcgttttggtttagtttcacatttctctgatgcaaagagagagaggttttgccttcaagtcttccaccttttgtttcatgttctttcccatcccttattcttccttcttctctagcagcataccttctcccattccaactactgtgatccctaacacagagatcactggcacagatttactagaatatacaggaacttgaggatatatactacatatccctgagggaaatcactggccatctttaaatcactgatttaaagccatcaatggtcactattgtccttatatcttctcctccccataataaactcaattctaagttaataaatataagtatgcttatttttgtgctcctacagcctgttaaaaaattctttttttccaaggcctttctctacctccttggtctcaaatcataactttggccctggtagccatgtgacctgctgatttagatggtgtcctgtgccctcttcgtctaagaatttctaacaaactagtcatcaggtaccactttagctaaaccttcattttgatcttcctattcaggatgcctttctcccagctacctttatttccagtcttctaacacttaaggattttctagtaagctgagaacctcaggcttcagctcatctaagacttggggatttttccctcaaatcccttttgagtcctttctgaactttccattttaccacagtataataattgtataagggcaccctccatgcacaacaacttctttatgagagtattattttcttgcaaataagtatacattacattttccttagaagcaaatgtgatttttttaagatggaggaaggcaccgaaccgtaatctattacatagaatccatgccctaaacactttgagggaaataaaaatacataaaatatggttcctgccctcagagagtttatgctgtatttgagatgatgaagtatataatattaataattaaaaaaactctctcctcccgcagcccaagatgctgaaaggaaagaaggccaagggaaagaaggtggctccggcccctgctgtcgtgaagaagcaggaggctaagaaagtggtgaatcccctgtttgaggaaaggcctaagaattttggcattggacaggacatccagcccaaaagagacctcacccgctttgtgaaatggccccgctatatcaggttgcagcagcagagagccatcctctataagcggctgaaagtgcctcctgcgattaaccagttcacccaggccctggaccgccaaacagctactcagctgcttaagctggcccacaagtacagaccagagacaaagcaagagaagaaggctgttggcccaggccgagaagaaagctgctggcaaaggggacgtccccaccaagagaccacctgtcctttgagcaggagttaacaccgtcaccaccttggtggagaacaagaaagctcagctggtggtgattgcacccgacgtggatcccatcgagctggctgtcttcttgcctgccctatgtcgtaaaatggtggtcccttagtgcattatcaagaggaaggcaagactgggacgtctcgtccacaggaagacctgcaccactgtcgccttcacacaggtgaactcggaagacaaaggcgctttggctaagctggtggaagctatcaggaccaattacaatgacagatacgatgagatctgccgtcactggggtggcaacatcctgggtcctaagtctgtggctcgcattgccaagctcgaaaaggcaaaggctaaagaacttgccactaaactgggttaaatgtgcactgttgagttttctgtacataaaaataattaaaataatacaaattttccttcaaagaaatacattgggtaatacataatatgtgtcctctgtaatgactcactaatcattaatgatcatataatgatcatacatggaggatgtcaggagactgcggcatttgagacaggctttgcctaaccccttaagatttcagctaagttcagaacatgtgtaaattcatggagaacactctatggtcaaaaaggagaggtgccagcaaatgcagggaggtgagatgctccagacatggtctggatatgacaatcccagggtcacacagaaagtgccccccttccaactgaactgcctacccatgacagtggtgctactcattctttacgcagaagtggccactgattggaacagagtgggcctgacccaagggcagcttctccacagcctgcgtcttgacccatggagtggacttactcaaaggacttttcctactggggcaatggaaattagtccagactatctccctccagaatttatagtagagaatacagagagaattgatgagagggagaaaggaagagagcaaccccctaagaagacaccagaaaacaaagcctgggtcctgggtatttataataaacccctttatcttaaaattatctgagtgaatctcttccttgcaaacaaaaaagcctgatgtaacatattttaagaacaagtaatacacaagtctaccctgaatagagggtttatcgaggggagtagcagaaggtaattttgaaacagtttgaggtctttacatgtgaagaactttgaaggtcaactatatatttttgtcttttttatctaatctatgcttgaacttagccaaaaggctgacaagtgatttttaatctaatcttactttaattttgccattgcatatttaacaaaatttaaaccaaaacagtacctatcagattaaatagaaataaattaatttgcaagatatatatgtgacttgaatagcgggaataaaaatgtttgattttggccaggtgtgatggctcacacctgtaatcccagcactttgggagaccaaggtgggcggatcacttgatgccaggagttggagaccaacctggccaacatggcgaatccccatctctactaaatatacaaaaattagccaggcctggaggtgcgtgtctgtaatcccagctactcgggaggctgagacatgagaatcacatgaacctgggaggtggaggctgcactgagctgagatcgtgccactgcactccagcctgtgcgacaaagtgagactccatctcaaaaaaaaaaaaaaaaaaaagtttgattttactcttatttgtcacagatgaccaaaggcattaaaaattctggtggtgtctgggcatggtggctcacacctataatcccaacacttcaggaggctgaggtgggcaggaggtcaggagattcagaccatcctggccaacacggtgaaactccgtctctactaaaaatacaaaaactagctgggtgtggtggtgcacacctgtaatcccagctacttgggaggctgaggcaggagaatcacttaaaccggaaggcagaggttgcagtgagccgagatcacgctactgcactccagcctgggcgacaaagcaagactccatctcagaaaaaaaaaaaaaaaaaaaattctggtggttagttgatataacaagctgatgctttctaaatcttttcttttttcacacacaaaatgatggagatctatacccacacctcatattgccatatatttttacacacagtgaaggatgaatttagttttttttttttttacttttttttttcatcaaacctgtcagcaggaagtagaaggatggattttgtaaaccgaaatgttttggtcaacattataaaaagtttataggatatctcaaaataggctgtgcgtggtggctcatgcctgtaatcccagcaatttaggaggctgaggtggccggatcacttgaggctaggagttcaagactagcctggccaacgtggcaaaaccccgtctctac

SEQ ID NO: 13300 - DNA, 75176 bp, Human
  misc_feature (1)...(75176): n = A,T,C or G
cttctgaaaacttgtgtattcagatgtctatgtaaatatgaatctgtattatgcaccttaaatggctgtgtagttttcacatcttatgtactatgatttaattgaccagtgtaaattacagtgatcagttacacttatttagtgcttactctatgccaggcactgtaataagcgttttgcttgtactaattcatttgatcctcacaaccctattattcctgtttcttacacatgaggaaactgagacaccaagaggtgaagcaatttgtccaatcactcaatgtgggacatttaatggctggcaatgctttgatcctttagacaatgttgccatgtatacctttgttcatgttttaaaagaatgtctttaggattaatttgccgaaatggaattgctgggtcctaaggttttaaaaatttttttacatgcttccaaatatttcccttaggaagattatacagtatttacacttcatccaacagtatgtgagtgtctgactcctcacatccctgattctttgcaatttttttctttttttgagacggagtttcgctcccgggttcaaacgattcccagcctcagcctcccgaatagctgggattacaagcgcgcaccaccacgcccggctaattttttgtacttttagtagagacggggtttcaccatggccaggctggtcttgaactcctgacctcaggtgatctgccggcctcggcctcccagagtgctgggattacaggcgtgagccaccgcgcccggccgattctttgtaatttttacctaaatgacaaaacattatctaactgctactttaatttgcacatttcacttttagaggtgggacttcatttttaatgaatttttaagcactctttgattactatgtattaatcctgtgttgacatgtcaatattagtttccacgctacatttggagatgccgtaatttgcgggataatttccatttacgtacaagatgtgcttactaagtttgttccaagtgggacgcaacatctctagtagatgctccttaaaacttctccatcacacagagaataatttttattggttaactaaacttataagtaaaataaataaaccaacattttgggttgctaggaatcactcactgatcaacttttagctccagtttttttctgttttcttttttttgctcagtctagggaggctatcttgggctgtgaaagacatgtcaccaaccatcacagctgctgagtgattgcacggttagtcagtaggtgccaacgccctgctagaagagctgtctgcagattccaaagccgggcgttcagggactcccgggaaggagccagcgttacctcagcctctccgagggacacgcgcgccctgaacactcccctcttgggattcaggccaattcgttcagctcccatgacttcatccgagcaagtttgtcacctcacgcagctaattaaactgtttacctagaagatgatccaaaggaatttccatttccttccagagggaatacaaggttatgataaccgagagagcgagaggaaaaaaggcgcacagctcgacccgaactcaacctgctttctttctcctggctctcccagtcactcctggggttgttagtaggcttcagcacgcctgaaggaccccgtcctacggagactcctagccaagggaaaagcagaaaacacaagaactaattccactcttatgtgtgactaattaaaagaggagtcaggcagaggggactccctgttcagcctttaccgatggggcaggctcggggcagctttgagacaggcagcgccaaggtcgcccagattcccgacaagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttggtaagtgtttttgcctctccctgcccattcctcaccggactgcacgctcactctgccagcccctgcctgcattcaggaccctcgggccagggccaaggaagagctcgctcttcccctttcctgaggctccctccttcagagctgggaggaggttgagggcttggcgcatcctctttgaaagaaatgggactcatcctgtgaaatgggccttgagctaggactgtaggttgccaaagaactgctgaatgggttggtgtaaagggcctgggaggagcagctggtgtagcatctggtgcagggactgtgcttctggaagaacagcgaagggcttaaggcgtatgttggctagattaggattgtaaaccctgtaccaaaagtgcttgcctagacaaataaatgttgagcgtctggaactggcagaatgttttaggtaaggttccttagaggattttaaaatcttttgtaacggtaactgaaggagggagctctggttaagggtagactctcaaacatgttaggagcgatgaagatgaaatacttggcaacgactgaaaccgaattgaggacctgagcctttgggatgtctctcttaggctaggtctctgcactttaaaaggtgtaaagaagtgtggaagaagttgttgaatctggaaagagtttgaaatgctacatttttgttgttttctgaatcactggtattaggtactgatgatgtcaattcaataggtttgcttttggtttttaattttattttattttatttttttctgacttgaagataataattatgggaatttgagtttccggggagagaattttggtttaatttgaacgcacgtaggaactaccttggcacacaagtgtggaatgaaagcaagccaaataccatttccaaatcccttatggcagaatgtaatcattactgtgaataaggacaaccttatgaatttacttgtctttgtgtattttaattatgaaaggtggatgttgaatttttctttttaaactcttccttagagcatgtcactgaaacttggaagtttatataagagtagaaaaaagttcactccttacctctgccacttctcagctcacggtgaaatcataggcaagttaaattctttgagttccagtgttcttgtctttaaagaggggaaaacacatcattccattctgcagttaaataatatgtctagagggcctgctacagtacctttatgtggttggcacttactagatgctaccttttttgttccaccttaaatgagtgtcctgaatcttagcagtggacagaaccttggagatcaccgattatacttaatgaattggaaaattgcatttaatttaataagcagttagcacacactacaggacacagcagctcagtgacataagagatacagtgatgagcaaggcctagttgctgttctcaagcagttttacatctcactacatgaatctctaggggaaatacttaaaacagcttcttaatacttgcttcttctgtttacagcacctttgtctagttttcttggtcctgtataatttagctagcaactacccaatcacctttatattctactgactttgtgaacacatatttgcattggattcaggtaaatttcttaatgtcaaacccgttcctagtagctgtaccacccagttcaaacacaggcaccttcttgcctttatgcttttgtcctacgcttatgctttcttttatctttcaacatatccttgtgtgttaaggccaactcagaatccaacttgttacacctgagtcatttcctgattactgtagcaaagggtttctcagtagcaacgttattgacggtttgggccaggtaaatatctttgtcataggagtttgtcctgtgcaatgtagggtgttcagccttatccctggcctttatccactagatgccggtgacacccagcccccactcatgattttagaagtctcaggacattgctaaatgccccctggaaggacaaaatacctcccagttgagaaccgctgcactagtccactctaatttccaccttcttacaaaatcctctaacttattttagcatttttgcctttaccgaattatttagcattcaagatagttttatactccttaatgagaggttgctacataggaggtgtttaataatgtttgttgagttgagaatgtgtcagttgagcctgccagacattatacttcttcagtgtagcaacattgttttgctccagaaaagcttactttttaaagttgctcaggttttggtattggaccaattctcttctcacaatccttgtattgaaatattacaaaaggtttatctaagaagacccctcagagattcccagtacataagccttgcacagagtccagtagactcatattattttttaatagtataacatatagaatacagtgtatagaatacacttaacaattttttctttcaccatatctaccaatgaatatgtcataacattaaagtaactcatttgatacagttatttatcacttaacactcgtatacatttgcacatcttcaaaattaattgtcttcagtcttaatctgaggctgaatcagaaattcactgactgatttatataatataacattttttataaagagacacaatgctggtgatagcttttcccttggaagaaacaccgaaagatgttactagaatgtgagctctgtgaggacagggatttttgtttgattttttcactgccgtatccctagctgtagaccagtttttggcatgctgaagaactttcagtaaacatttatggaataaatgaatctcattttggacattataattcaagagctgaatttagaagaaacgtaaagataacttatttcatcaagtttgtatttcaaagtctctagtgacttccaccttgccaaatccaatggtcactttctagtccatttcttttttgatctcttaagcattcctctttgatatacagtattttattcatgggatttcaggacaccaaactttttctcattttctacttagctccttttaaatttttttgcttcccctttttgcaacttctaaaagttgagtgccctgcggctcagttccggagcctcttctctccttccacttttttttttcccttagagtattaggaagcaatttagcttagtgttaagaattcagactggggccacactgcttggattcagtcccaggtttgctgcttaccggtagtgtgatttttggcctagttgcttagataatctgtgtctcagtttccttatctttaatatggaatataagagtaataatagttcttacctcagagagttgttaagagggttgagttaatatttgtaaagcacttagaaaaatttctgtactttttattaagtaagattttaaaaagaacctcatctaatttcttagctttaaatacctagcgtattctggtgactcctggatttatgttcttactctcagcctcttgcctgagctctcgacctagatatccatctccttactgagcatctccatttggattctgcttagagtctaaaaacaaacattcaaaaactcaattcttagttctttgcccaaacctgctcattccttcatccttgcccttctcagtagacgacaacatgattactgtttcctgtcactgagctccaatgtctaggagtatcactgattcttcttatttcttcacacttcacattcatcctatcagcaagatattttggctgtactttaaaaatatatccagaatttcattgacaggtgaaactagctggacttcctgggtcaagtggggacttggagaacttttcggtcttacaaggggattgtaaaatgcaccgatcagtgctctgtaaaaacgcaccaatcagtgctctgtagctagctggaggtttgtaaaatgcaccaatcagtgctctgtagctagctagaggtttgtaaaatggaccaattagcactctgtaaaatgaaccaatcagcaggacatgggcggggacaaataagagaataaaagctgggcaccctagccagcagcagcaaccggctcgggtccccttccatgctgtggaagctttgttctttcactctgcacaataaatcttggtgctgctcactctttgggtccgtgctacctttaagagctgtaacactcaccacaaaggtccgtggcttcattcttgacgtcagcgagaccacaaacccaccagagggaacaaactccggacacatcatcacctttttctgtctcaccattcttaccttacttcagtcattgttatctctcatagtcagtggcaagagccttctggtaggtttctttgttaccactcttgcctctacaatcagttctcatttacaaaggtcagtgatcttttaaaaatgttagataatgtcagttacctgctcagagttctctggtagcttcctatcctacttaaagggaaatgcaagtttttttattgtggctcacaatatggcttcttcctgtgtgtctgatatgattatgatctccagactcactctcttgaattccaggcttcttaaatctgaacgctccaagctcattcctgcctctgtagctatatggtactctttgcctgggatactcctcacccaggtatttgaaggtctggatattcatcacacccattcaggactctgttcaaacgtcattttctgagacgctttacctaataatcttctgtaaaaaatatccttcttgggctgaatgcagtggctcacgccagtaacccctacactttgggaggctgaggcaggaggattccttgaggccaggaattggagaccagtctgggcaacataatgagaccctgtctctacaaacaataaaaaagttagctggcatggtggtatgcctgtagtcccatttactcgggatgctgaatccagaggattggttgagcctgggaggtcaaggctgcagtgagctatgactgcactcttgcctgggcaagagagtgagaccctgtctttaaaaaaaaaaaaaaaagaattaaaaaaaatgcatctttaccctctcactctgtttctttgttccatttctttttctttatagtacttagtgacctgacattaattgattgattatcttttgtgtggaatataaactccattaagatgagaacttttcattttttttcccctaatactttagggatagtgtctggtacatagaaagcactcaagaattatttatcaaataatgaattattggtgtttttctagaacattagtcttgtatttctatttgctgttcttttttccctccaaaacaaattcatctgtcagaaaactgaagttatctttctaagtctggctcttcattcattatttggtaacatttttgtttgtttttaaatctttttttacattaatatagatggggttttgccatattggccaggctggtcttgaactcctagcctcaagtgatctgcctgcctcagcctcccaaagtgctgggattaccgatgtgaggcacccgggcccagccaatttggtaatattttagtgttgtagttatcttgacttgaaacccaagaggcatctttgaatcatttccctgcctctgctaaatcatcatatgtctttgtttctataatagaatatttgtgttcccagtcagactgctttgggccagtccacatcctacatacttggacatttttttagtctgctttgcttagtccagtcagcctcataaatcataagctagatgaatcttaaatgttaatgtcacattctcctgaagtgtgatatgatagaaagaccttgggctttgggcttaaattgcacctgcagcatttactcttagtaaatggacacaatgtatagttggataggtataggacccctttgaattcactttctactttggtaaatagggatagcaatatccattatacatcatgcggatgctatgaggattacttgtgaaaacacatgacattctgactctttaccagagttgaataggcttcaaatatctcaagttcagcatgttcaaaaccatttgaaatttttcttctcaattatgctttttgtctgttttgatagttggtacctaagtttacttagtcatacaagtcgtgaacttgggagtaattcttgacttctgtagttgtaattttctacattctaaacaacaaatgtatcctgtctaccctgtgccagataccctggtaccgaatatgccctcaaggattccaggtttagatcaccactctctcagattagtacagtagcttccagctgttcttccctgcttccagtttttccctagttattttccagatggctgatggtgatatttttaaaatgtgaatgtacgcgtggcccctccgtttaaaatatttctagagagggctgggcgcggtggctcacgcctataatcccagcactttgggaggccgaggtgggcggattatgaggtcagcagatcgagaccatcctggctaacatggtgaaaccccatctctactaaaaatacaaaaaattagccgggcgtagtggcgggcgcctgtagtcccagctactcaggaggctgaggcaggagaatagcgtgaacctgggaggcggagcttgcggtgagccaagatcacaccactgcattccagccttggtgacagagcgagagtccgtctcaaaaaaaaaaaaaaaaaaaaaaaaaaagttctgaagaatctaccgctttcacagtactttgaacttttcagcagggcatgtaaggcctcttatatttggcttctttgtgactcttgagcctcaccttccacttttttcttgcaggtgtatttcactccttattggttttatgccactgtgctcttcaggtgtggatcctctggcttgacatacctatttgttcattaatcctcagtaggtttgttttgaggagatgatgcatgtaaagcacttagcatagcacctggcatgtagtaaccaatggatacgttttagctccttttataatcaagttagaaatagatgtggggactattggattctaaggtgtgcaatcagttactgttaaaacataggagagaaatgtgaaaattcagaatacaagtatgttaaccatctgatatccactggattaagaacttgtattctttgattcttctgtccctattttacctctcctctaagctgttttttctaatgcctttaggttatcatttctgttttatgttcctctctgaaatgcttccatgctgttcttttgatacctacttctttttctggttagcagagcttcagattacatttctttgcagatacagtttccaggaggatcagggatattagatgaaagatttttgaagaattgatttgcaaagaggataatttctttcagacttacttttccattggccatttttaatgaactgttacatcttcgggctgactgaatgacagtcctttcctcaccacctaaatgtgatgcgaagtcctcctgtcagcatttcttacctccccagatctttgacagtcataaattttgagaaaaatcaaaagttgctgcttatcagaaaaagttctctaatcttttgaaaagactattgaaattcaaatgaggctctgtgtatgttttttctgggtactgctgggcagatttctcaatctcctctttttgagtattagtgtaaggatattctcaggataaaatgagatcattatgaagctttgaattctttagaagcaagtctgttatttttgtcacttttccttttcccacaaaccctgtttttgtcttagaaaataaatagttttgacttcatttgctattcacagaaccatgttgtaggtagtttatatccttctgattaaaaaaaaaatacttgttcttttataactgagaagaattgtgccactgattttgatgattttgagacagcctcaataaatgatgtgaacaattttagatttctgaagtgggttgtgtttctgatccatccatacaaatatgaatcagatgctgattctatttatgtgtaggaaagtaataaagtagttcatgagttttcaacataatatctgctgataactgtatcatatgttcctggatgtatcattaatcaagaactgtaagatagcactcaactatgatagtaggcaatttatatttgatcagataaactgttaactttttaataagttttaatatgcttagctattatgtttttaaataaggtggcaggttttagaatttaagtgtgttcttttaaaaaatgcacttaaaaaaaaaacaacctgcttggctaccagtcagtgagaatgatgaattaattattaaaatgcactaccagaccaaagtaataacatgctttccttttctaagatgaagtaagtgatattgttcagaatgactcactcaatattcttgggctttagaggggttgagtacctagggagcaggctctgggactcctcaatcagagcacttccacttgggtttgctgtatatattgggtttcttttaagataaaattctcttatagtgttgaatgataaataatttgactagtctttgtttcctaggagacagcctctaaatccttggaattttctgagtgataagagcatctttgttatttttggtgggcccctgggataatagcttagtttatgctaataagatgacttggtctgggggctggccactccagaaggactaaccatgtgattaaaggatttgggctttgagtcataggacctcctgggaaggatagggacctggagattaagttccactgtgtggtcctatttcataaatcatacctatataatgacaccccaattgtagaatccatgaaggtacatttcccagtccatcgaaacctacactgaaaaaccgaatattccgcgataaaaactggaaacaagctatttgtgaaaatgctttgtgatgtgtggattcatctcacagagttaaatgtttgttttggtaaaacaggttgttttgataaaacaggataaaaactctgaacactgaagctcagttaagcattctggtaggtgatacacattgtggtgatacacactgatgtatttggagggtgatgaagcttcctagcacagaagctttatgtttggaaccctcccagatctagctccatacaggtggttgtttgtatctgggggtctgcattcatggattcaaacaacagtggatcaaaacttgtagaggaaaaaatatcatgtctgtaccgaacacatagagacatttttcttgtcattatgccctatacagtatagttatttacataacatttacattgaattaggcatgataagtgatctagagaaattaaagtatataggaggatgtgcaaaggctttatgcaaattcaatgccattttatattagggacttgagcatccatacattttggtatctgtggaagatcctggaaccaatctcccatgtataccaagagacaactgcgtatctctattggctggtcctggtttgtgttttttgtgataaaactctaattgtaagtatagtactttctatgtgagttgctatggtgaattatcaatcctgaagggtagtgggaacttccagtttgtatccagttggtcagaagtgcctggggaccccagagcttgtgtctgaggtttgaagtgaagggagtcttatggagagctgtgtcttcaacctgtgaagtctttgctgactgggtagttagcatcagaagtatgctagccctctgggtagttagcagtgcattgtagagggtttctgcatttgaaagttaagtttgaaaaccattaaaccaggtattattgttattattattattattattatttttgagacggaggcttgctctgtcacccaggctggagtgcagtggcatgatctcagctcactgcaagctccacctcccaggttcacgccattctcctgcctcagcctcccaggtagctgggactacatgcgcccaccaccaagcctggctaattttttgtatttttagtagagatggggtttcactgtgttagccaggatggtctctatctcctgacctcgtgatccgcccacctcggcctcccaaagtgctgggattacaggcgtgggtcaccgcgcccggctaaaccaggtattatttaaggtcaatgtgttactatgactttttgtggcttcatattgcagatacatgagtagtcttatcatttttttgagcacttagactgagagcatggttattgaaataattccccaaagtaaaccttattattttcaagggatttacaatatattaccaaaacttgagcaatgataggtaaatttgagctagttctcctcttttccctcttccaaactgcttttacatattggtgatagattaatatttttcaaaaaagtctaggtcttgttgttttatttccttatttggaactcttggcattctgatgtttcttgaagcagtgcaaacacctgagatagtattttaggtcttaatgttgttctcttattattccaaattttcacaaagtagtctgtatttcagccagcctagattcttcattatacttcttttctgttttgatgactttactttttactttattcacttaattagaaacagattaattcattattctgtcctcttcttattttctaaatacatcgggaagcccttcctgattctcctcttctctctctccaggatctttacctgtctttcaatttgctttgggctttgcattatttgaaaccctttcaatcttaaatctaagtctatctgctggtttcatttcctttcttagattgtaagctacttctggtagggtatggcgtggactagaaggctattccattttgctgaatatgtgttcaaattttataattgcctgcaagtaaatcgctttattgagatcatgaattgtttggatctttgtattaattcttatgcaaggaattaatctgtgtgaataacctgcttttgctatcttctatgttagaagattttagggtagctaggtaggtaccctacctaaccaatacctattggttattatccacttggtctttactagatgcttattttagttgtccggtggtagtgactaactagcaggtgatgctgtgatatatagcaggtattatacacctgtaaaatatttggtcagagttgactgctttttattttctgcgattaaactcacttgacgtacttctgctctcagtagtaggtcaaaatgaggaaataagtgtactctgttgatctaggcaacagggcatggaggagagtatggaaacaagaatttcattatcacttggtcaagaccaaccattacagataagaatcttggtatgagtcatttccactgtccccccaacccatctgtgtttaaaaaatggagactgctattgaagatcttggtgatgttatctttcagcatatctgctctttgaattgcagtgttccagtcaagactggttaccctctgcttctgtacagctgttgttttgaaatataatgatttttttaaagttttttttcctcctacgtgtgtattctttttctcttaagttgcttttttctttttctttttttggtctttttctttatcttccacattagaaggtagtttcctcacgcctgcaatcccagcactttgggaggccaaggtgggtgagtcaccaggtcaggagattgagaccatcctggctaacacggtgaaacccgtctctactaaaaatacaaaaaaattagctggacgttgtggcatgtgcctgtagtcccagctactcaggaggctgaggcaggagaattgcttggacctgggaggtggaggttgcagtgagccgagatcgcaccactgcactccagcctgggtgacagagtgagactccgtcttaaaaaaaaaaaaaaaaaaaaagatagtttcagatagcttgcttgtttgcccatggctaatactggagaaatcaaaagcacattggaagttctgatcatgtggttaggtctcattgacttttaacttcactgtaggttggtctggtgggccattgactatggaattctgcctctccactcctccccctgcaatattactgtctttaggtctttcctcttgggctgacatagagcccccagaaaagagtcttctgatttcttggagggtaacggtacaaatgttgaatcagccttgcatacctgggatgaatcttaattggtcatggcatatgtaattctttttatacattgttggattcagtttgctgatgtttttgtaatcggtggaaggtatctgagttactggcagtgagtctgtatgggtctgcaccaatctcagttcttgcctcctcagaagaaagaattcatctaaggggcgtaaggcagaaaaagagatgaagcaagtttcagagcaggagtggaagtttattaaaaagctttacagcaggaaagaaaggaaagtgcccttggaagaaatccaagtgggtgacttgaagagtaagtgcggtttttaactttgatcccaggactctataggttggcccctttcctgtgattcttcccttagagtgggcggcccacatgcgcagtgccctccttatacttgggaggtgagcatgcacagtgtgtttagaaagttgtatgcatgcccatcggaggcttttttcccttttctggtggagtgccccaggaaggtcgtatactgccattttgtctcttaatgcccctgcctgggctcactcactcagtgcctgagattttattggagcccccttttttgcttctccctggtgcctgcattcatttaacactttaatgtttaacacttgtggactgttaggagcttctctctccttggtgcaagctgccaatttatcacttttagagaggcaatgtgataattgctgaatcacccaacattcctagtgggtgtgggagaaccctctcctgccctgctcgtacctgtcttactacctgtaacattttgttgaggatttttgcatttatgttcatgagagatattggcctatagttttcttgtaatgtttttgtctggttttggtatcagagtaatgctggcctcacagaatgagttaggaagtatctcctctgcttctatatactgcaagagattacacagaattagtataatttcttccttaaatatttggtaaaattcaccagtgaacccatctgggcctgtgctttctgttttagaagattattaattattgattcagttttttaaatagatgtgggccatttagattgtctgtttcttgtatgtatttcagcagattatgtctttcaaggcattggtccatttcatctaggttatcaattttgtgggcatagagttgttcataatattccttcattttctttttaatgtccatggggtttgtagtgatgtcccttctttcatttctgatattagtaattggtgttttctctctcttttttttttttccttagtttagcttggctagcagcatatcggttttattgatcttttaaaataaccagcttttggttgtgctgattttctgtattggtcttatgttcagattcattggtttctgctctaatttttgttgtttgttttcttctgcttgcttagtttggatttaatttgctcttctagtttcctaaggtagaagcttattgattttagatcttgattctttttaaaaatatgtattcaatgctataaatttccctctaaccactgcttttgttgcatcccacaaattttgcgaagttgtattttcacttagttcaaagtattttaaaatttcttttaagttttttttttactcttgtttaaaagtgtgttagtctccatgtactttgggattttccagctatctttctgttattgatttctagtttattccattgtaatcactatgtgatttctattgttttagatttgtcttggtttgttttatgacccagaaggtggtctgtcttggtgaatgctgcatgagagcttgggaagaatgtgtattctgttgtttttggatgaagtagtctataaatgtcaattgtcaattatatacagttgattgatggtgttgttgagttcaactatgtcctttctgattttctgcctacctgacctgtccatttcttctttttttggtcttgctctgtcgcccaggctggagtgcagtggtgcaatcttggttcactgcaacctccacctcccgggtttgagtgatcctcctatctcagcctcctgagtatgttcagctaatttttgtattttttttgtagaggagaggtttcgtcatgttgcccaggctggtcttgaactcctgggctcaaatgatctgcccacttcggcctcccaaagtgttgggattacaggcaaaagccactgtgcctggcctcatcctttaacttttaatctctatgtgtttttatgtctaaaatgagtttcttatagacaacatacagttgtgtgttgttttttgattcactttgacaatttctgccttttaattggtgtagtatgcagaccattgacatgtaaagtgactgttaatatacttgtgttaatagctaccatatttgttactgttttctattcattgcccttgttctttgttcccattttctatttcactctttttttggcttttgtgattttaattaagcagtttgcatgattccattttatctcctttcttagcatagcagttatacttttttaaaatcttttttttttagtaattgcctaagagttttcaagatacattcacaactaatccaagtctgctttcagataacactgtaccacttcatgtgtaatgcaagtaccttataataaatgaaaatattattaattcctccttcccatcccttgcgtcattgctgtcattcattctacttacatggaagcatacataagaatatcagaatatatataaaatcgtaggtaatgaatacattgttgctgttattatttagaataaactattttttgttagagtaagaagaaaaataaaaataaaaataaaagttattatttttatcttcgggtattccatctttattctcttcctcttttttttttttttttttttttaaagagataggatcttgctctgttgcctaactggagtgcagtgtacgatcatagctaacttcagcctcaacctcttgggctcaagtgatcctcccacttcagccttctcggtagctgggaatacaggtgcatgccaccaggcccagctaattatttttttaaagatgaggccttgctctgctgcccagactggtctccaattcccatcctcaagtgatcctcccacctcggcctcccaaaatgctgggattacaggcatgagccatcctgcctagcctctaatgctgtttttttctttatgtagatacaagtttctgacttacataatttttcttctttgttaagaagttctgctaacattgctttcaaggcaggtgtacttgcagtagagtccctcaatttttgttgagaaagtgtttatttcctcttcacttttgaagaataatttcttaggataaacaacaggcagttattttctctgaacacttaaatacgtttttatttaaggaaatacattcagtcaaaacttggttttctttccttcagtcccctctccatattatcaaaaaaaaaatccacaaaactagctaaataattaacttaattacctgaaacatttttataaagatttactagcaagtaaataatcttttgctaatgaaaatagtatttcttattttagtctttctatttgcagatggtggtagacctatatataatttttttataaagaaaaatcaatgccttttattttatactaagtaaagaggcaactgcattgtgaatagggaaaataattgcaagagataatgagcgtacatcttttcaagatggccatgaaaataactagaatgctggcaactattctgatttgttgttaagacttgattatactatagttttgtgatttaaatgtgattatgtatcttttaaagatttgaaaaataatgtttctgcaatcccctttacaatctacagagaaagcaaccagcgagatgaatactgctgaggactggggcctcattttggatatctgtgataaagttggtcagtctcgcactgggtaagtatttagcgtttcaaaggatttttattctttctttttaaaaaacacgaaaggccaggtgcagtggcttgcacctgtaggcccagcccctcggtaggatgaggtgggaggatcgcttgagcccaggagttagaggctgcagtgtgtgatgattacacccatgaacagccaatgtacacgagtcagggcaacatagtgagaccccgtctcttaaaaaagaaggatcaggaggtaaagtatattagcattaaatttagtttaaaaagagaatatttttattaaaaagatttgaagaatcatctcatttagtttatataccttttaaccagttagggtaacatggctggtaaaaagttgatgctttaatcaccctccttcatattttcttctggaatctcattttttccactgattttagagttattagtgatttctcagttaccaagtttcatggttatttatgagttcttttctcctttgtcagatttgcaacattccacctaatgaatcagttaggtggaattgaaaagaaattttttctttctgttgaaagattaggggaatagaatcttaaactttttggcatgtattacagagctttccaaacagtacagtaattggattaattggtgtggatatgggtgatttcttcagctcctgggctaacagcattagcctttagcagtttcatttactgctttatgccacacaaatggtattgtcttatttgtgcactttcatgtgaaaaagattaggaagcactgctgcattacacttgatatttgcagtggtaatatgaagcctttgccagtgtcttctttgcctcttcttccttcacccctaaatatagatgttcctgaaactttccctgattcattttttatttctaagattttttcttttggtctcacaacttccagctgtctttatgtagatggcatctgtatttgcagctcttcttactcaagcactagtcttatggacactgcattatttctggatatcgttctatataagccttcatctcaccatctagaaaccagaactcctgtctctttttgttttaaacctactttctttcagtttttccatttctattaatgacaagatgattctttcattgcactaaaacttgagtcaccttcacatttattactcaattctgtccatctgccttcataatctctcaaaatgttgacgttttaaagtctccttaatcaagtttttgagcatagccaaatggtgcagaggcagttttcttcaggggctgtataccctccactctagctttttttggcccataatgtcctcccactatgacgttcccaaagaatctcccaaatgtggtcccatccatccctttgttgtatttacattttagtatattctgacctggttcattaatttaattgaaaatttttaactactgtgtgttacatatcgcgttcccttttctccatttttatttgtcctactttactttggacgttccttaccttgcctaggctagcgaattaacccactggcattttttttctgtttccatctcttttctaattcttatatccagttgccgtataacagctgtgttcatgttactcccctaccttccatactgagttcagtttaagctccttagtcttctgaatcatgcattttcatttttttccctcctgtataacattcatttcagctcaactatctgagttccagtgctttttttctaccttagtttgatgcttttggtccttttgtttcttgaggatggaatgttttcctctttaatttcccatctctgtgtctcatatcctttcagacccaatgtagataccacttcttccacaaagcctttccttatcccctttactgacaatggtatgatcctctgaatcctcaaagcactctatcaaaactattcttatttgtgttttttcctgcattttagtaacttatatctaatgaactgaagtttcttagatataaacctagtagatttgtagaatgaatggtccatgaacttctgttgcacatgggaaagaagcaaatagcttagtggtggagatcatgtactctagagggagattgcctgggttcaaatcttggctctagccatttagctatgtcatactgggtaagtaacttatctttctgggccttacttttccagtttaccacctaagaataataatagtatcatcttcataggggagttgttgtgactttgagattagctttatcaagtgtttataacagtacctggcacatggctgaatgagtgcaactctgcctgcttttgattgaagtcatattttgtgacagtttctgttgaagactgggcaccaagctagaccacttcatgtgcattttggagataaaagttttatctagcattgcagctgcaaagcccctcctctctctcttcactttgttggtttcctttttatctttacttcggtgtttttcattttgtagacgctttctgtaataattgggtcaattgcttgaagttgtttgtcaaaaggcaaacccccttttacaactataaatattccatgtttttccagttaaaaaatcaatttgtaatgcatctgaaattctgtatgttgtagcacaaagctgtagagatcaatttgtttttcttaatgttaacgttattctcccagaaatgtttattattattttccctattttatttcctttcatatttgaaatttactaatttatagctttaaaaatattttttgtctttttgtttttatccagtatcaataggtttagacacatgctcattttttttagtttttcatatttatttttaaactacatactttctctcagtatattccttaatatttgaattgtcagttggggattttaattgacattatactaagtctatgagtttacttaggaaatattttcaacttcagtgaattcgataatgaaggtggatctgtttgttcttttagtcagtgttttttccttttcttcttccttccctcctttttcttcttttttcttcccacttactcacttagttttgactcctttaatagttattgctctctggttcttttaaatccccattaagttaatcttcaagcatttattgtgtgcataaatgggatatcttgttatacctcttgttaataaagagttgtttgaaaaggattaaacaataattgagataccattctaatattattgaggttttaaaaaaatgtcaggccttcaataattgctcatgtatgtattttctttcaataatactgtttaacatacatctccagttgtgttttttctttcttgttctcccttgataatctcatattaggaaatggtaaacataagggtcatattaggacattcctgggccctaggcacttttgtcttcttgggctcctctttctattaaaaaaattaaaaatattttatgactacattgttttaaggaaaaatatattagtattatatattaaaacattttctttgaagcaaaagttcacttttttcttcttgttttaaaagaaataaaacatttacgtgtacttccaaaattattgtgagtcctaggccctgtgcctacatgcataagcgtttacagaattgggttacatattcacagatcaacttagtaatagaaaattttaggtttctttcaggtgagcactaaactgtgggatacttatggtggcattcctaatatgttatttgtttttatttttgtggtaaattatatatacaataaaattaactattttaaagtgttcactttagtaggattaagtatactcacatgcccgctgtctgtctccagaacttatccatcatcccaaactgaaaccctgtgcccattaaacaataactcatccccctttcctccagctcctcttaaacatttgtagtttgcctttaatattttaaattattttataattagtatatatggacaacttatagaaatctggtttatgttttggaggaaactgtgattggatatgggttgctgatggtcgcataagaatgttgaacagtattgtaggctgccattgaggtattctaaatacctgatgtgctttagagaagactataacatgtaagtgggttgagagggaaaagaggacatgagttttccaaagacaaattcaggtagagtcttttgaagtagaggaatgttgtagattggaatgcagttcagaagtgatttgtgtttcaggcaacaatctagatttagaaaaaaaattattattgctatttggtgttagcctgaaattttgtaaagtgcggcgatctttttaagaggacagattcagagatggtggaaggactttaggaggagcatttcactttcagtaatattgtattttttaaatcaaaatgatttgtaactagtaatatatagtagaatcatttagaggataaataaaatgaaataattcatattattttaacctttttttctcttttggcttctttttttaaagtcatctgtcttagaattatggtagtttgaaaaatattcttaggttttaaagggggagaaaagagctattattgtgaagtttcatttagtcagaactgtgaccaggaaacatggctctcagtggtgttgtgaaaaatttttcttaattccttctcttaaaaaggaaaaaaccagacaaacccattttctgttctttaaactcacatatacatatgcatatgcatatatatttatgtttgttgattatataaagtatttatttcttttaaaaataagtatgtattcacatggctcaaatgttaaaacaatttaaaaagatggacattgacaagtctaattcctatccctgtttcgctgctctcatcttctataagttaccacttacgtaaattttgtatctttccattcttttacacaaatgtgaatacattttccccccatttacatgtaataagaatgttgtatatattcttctgcatttattacttaattacttatcgttacttattgactacttattgtatcctgtcagtcttagaaatgtatttcttttaagtctattagtattggacaaatttggaaattattttctagtttaacattaattttggttagtggcatgtagaatatctaacacatatacataattactgaatgaaaattagtaatttttagtaattatctcaatttcagaaagcctactagatgtaatccctgtttacttcatttaagttgtagtttctttttaaatcttgaaatacttgattataccaaacctaaaactttaacaaacattctgaaatttttttctaacgtctcaagatattcacatgatttctactgcgcaatttccagtgtgtgagtaactagtgaagaatgcccagccaattaggtcatatgatgggctgaacagccttcatttgtttagaaatcaagagaactttcacaatgataatagccgttttctttaacatgtcttcacataaataatttttctatgttagtgttgattgatttgtttatatttatgtaaacatagacgtgaggataaatactgattatcttcaataacaagttaaaattaaagttctgtaattgacctctagattaagttttgctgttattttatatgttaactgtctttgcttagctttagccaaagatatagttgactaaaggtggaaaacatcatgtaactttttctttacccgactaatggatatgttttggtactaaatttattctaacagaatgagaaagatcatatgatagtcattattggtgttttgtgaaaaatacaaatgtaagcctttgggaaggagtttgttaaaaatgtttttccttggctttgtatttttttttttttttttttttttttgagacagagtcttgctttgttgctcaggctggagtgcagtggcacgatcttggctcactgcaagctccgcctgccgggttcaccccattctcccgcctcagcctcctgagtagctgggactacaggcacccgccaccatgcccagctaatttttttttgtatttttagtagagacggggtttcaccgtgttagccaggatggtctcgatatcctgaccttgtgatctgcccgccttggcctcccaaagcgctgggattacaggcatgagccaccctgcctggcctttggctttgtattgttttgtcctggactggactgtgactatttccggccttcagtaggaagttgaaagaatatttcctgatttttgtaagggaaaaataatctctgagctggatattctagagttgaaaggacagcatcagtagagaaacagacctctttcaagtctttttttcttcctataatcatatcctcattttacaggactttatcatcaaagtcttttaaatgctcttttaagaataatcgtcacttattgactacttattgtttgctagactctgttacagtgccctatgaacattttgtttgattatcacagcagttctaggtactgtagattctctcaactttcaagtgagaaatctaattgatatttaggattcttttatataacttaaaatagcggaagtgttccagcagagttaaataatttttttttttttttgagacagagtttcacttttgttgcccaggctggagtgcgatggtgcgatctcagctcactgcaacttctgcctcccaagttcaagcgattctcctgtctcagtctcctaagtagctgggattacaggtgaacgccaccatgcccggctattttgtatttttagtagacatggggtttcaacgtattggtcaggtggccttgaacccctcaccttgtgatctgccctcctcagcctcccaaagtgctggtattacaggcgtgagccaccgcatccagcccatagaattttttttttaaaacgtgatcttgatttccatgtttcactcagtttcgtaacatggcagaatttctttaattcgtttcattctctttgcgttcgtcattttttcttttatttgtcaaatactgaatgccaaatatcatgctttggctatacagtggtgaataaagcaggcatagcctttgccgtcaatggtgctaatattctaatggtggaagatgtgaaataaacagatactaacagatgatggtcaatagctaagaagctagtaaccagagtgctataatggaaaataaaaaggtagactggtatgagggggttacgtttatgctataattttaatgttgaaaagagacagagttcaaagcactgcatcccagaaagaagcaatagtctgtaggtgaatgctgaatgctacaaggtagagaaaacttgatgccttctaagaacttgaaagttacagagtagctggagcagaagtcagttgccctgaatgagcgcagagctgggtttcagagtgagttagaaaaatagaagatgatggttggaaggtaggatcctttaaattaaaactatagagggttttcagttattggtaatgacaaggtctgatgactccaaggtccatcggagttaataagatgtgatagaagttgaaaagccaaagtgttgaaagcatcacttacactgttattaaaagctccaagaattaggacaggagtgatgttggagagagaggcagtgatccagtagctaaaataattgacaggtgaaggggcatttgagatttttaaataaactgcaacatgaggggactgacgtgattggagctgggcagttttaggaaagagggagagtggtttggaagaggcaagggaaatgaatgcacattgcttagcataatgcatattgaacagatagtacagaggtcaactccgacacaatttccccaattattcacatatttcattagtgtatatatttgttacaagatatgaaccaatattgatacattactattaactaaagtccatagtttgcattaaggtacactttgttttgtacaggtcaatgggttttgacagtgtatataatgacatgtgtctaccattgtgtaatgccacgtatctgtcattacagtaccatgctgaatagttttatcaccttaaaatgacctgtgctccatctgttcattcctttccttcctctctttgcactttaaacagccactgatctttttactgtttacaagtttatcttttccaaatgttgtgtaattgggatcgtagactatatagccttttcagactggcatctttcacttaccagtatgcatttaaggttcccacgtgccttttcgtggctcagtagttcatttcttcttattgctgaatactcttccattatatggatgttctacagtttgtttattaacctactgaaggacatcttgttggctcccagttttggtgatttttaataaagctgctataaacatgaatttgcagccttttgtgttgacatcgttttaagttcagttgggtaaatatgtgagaacatgattgctagatcatatggtaagactgtttatctttgttagaagccaccagactgtccccacagtctcagtatggttttgttttttacattcaagtctttgatctatttggaatttatcctgttaggcagtatgaagtatggttctaactttattcttttctatttggctaccaaatatcccaacaccatttactgaatcgtccatctttttttcttctgatttgaaatatttcttttatatattatatttgcatatgtatttaagtctgtttttctcttttgacccgttggtatgtgtctaaacacattctgctaccacatggttttaattattaatatgttttgacatttggtaggatatggtcttgaggtttttttttttttttccggaaatgttgttttagatattctttccccttcctactctcattaaataaactttcaaattgagttggctgggttaaaaacaaaactttctgtttaaattggcctagttttaaattaacaaatttatgtctttatgatattaaatcttcctatccgagaacatagcatctctttttgtttataacctttagtagtgtttttaagttttcctcttaaaagtcttgtacattttttgtaatgtttcgtctgaggtattttgtcctttttgctgctgtttcagtggggtttttctttcactgattgggaatttcccttctttttctttctttctttttttttttttctgagatggagtctcgctctgtcacccaggctgtagtgcagtggcgcaatctcagctcaccgcaaatgccgcctcccaggttcacaccgttctcctgcctcagcctccccagtagctgggactacaggcacccgcccctatgccctatgcccggccaattcttttcttttctttttttttttttttttttgtatttttagtagacacgtggtttcaccatgttagccaggatggtctcgatctcctgacttcgtgatccgcccatctcggcctcccaaagtgctgggatcacaggcgtgagccactgcgcccagctgggaatttcccttcttaaagggtagacgggattatagcatctgtgtatctggaagagaatgatgcactttgagggggaaattgagatgatgattcaggagagaattgggataacaacagaagtcaagttgttgactaggcaatagggaatgggatccgatgcgagctgatttttctatctttacttgcctagacaatgattttacttttttattttactaagtcttaaaaacatcgtatattttatagaatgagacttatagaattctgatgactgttgtgcttgttttgcagatgagaaaactaaagccctgagatttttaatgtgacttgtctaaaacgagtgagcagaggcaaaattagaagtcagatttctttacttcccattttatgtttttttctaccttcactgtgctgtgtgcttaggtgcttgtatgagcagttatatttgaaggttaaaattatgaatcaagacataccaatcttacattaaagtttttggtgattcctctctccccatacgttatgttacattgtgttttgtttgactgaaatataccttagtgttacatggtctagaaaactcaaaatatcatcgtactgaatttaatcctcaatattttagttcagcatgtagaagtttagtttatctgcttttctaatgaagtcctttgggacttacatgaacatgtttgttaaataatagtcaaataacatcactgtatatatttatattcacgttccattatctcataagaaatgcctacttaataagcttaacattaagggaataatttgatatttgtactctatattttgctccttttatatgttgtgtggattatgttttatgtaatgtatgttacaaatcaaatttgcattttgaatatgttcagtatataaagattgcattatttctgttgtgatttcttttgtacttttatattagaattctcttacagtctgtgacatgccttcatgcttatgaaaggcatctaaataaggctctactcagtattcaaggagcattcatattatctcttaatttctaaaaatatttagttcattcagcaaagatttgagttcccatgtcttttagctgctgtgtgtctgctaggtcctggtatactaagacctataaaagctatgcatgcacatactcctccttcctccaatatagacgtacatatgtccttgaatggtaaaccacagtaaagctttttttgtagcattttagatgaagatgtaatgtttaaatcactctaaaataactttgaaagctacagttgtaaaagcaaagataaaaaatgaaacatttttgtgctttcaagaactaacattgttgagagtctctaaatccctggcatgagtctaggagttttgtattaacattctgataaggaggtattagacatctcctcttttacagatgaggtctgtcaaagcttcaaatcgtttttctactgtatcacaatgcttcttttgtttagtaatggttttcagcctgggtggtattgctccattagggatggtttcaggtgtcccatgacaggcgggttactactgatgttactgatgtagtaactagcagggatcagggatgcaacatgccagatagtctttcactagtgtccttgtacgtttttagtctgacataggttattagaggttaaccatgcaaacatatttgttaaccatgttttttattattgctattgataatttttgttttgatcatttttcttttatatttgcaatacttttaggcaaataccctgttattttgttatgtcctgagagagggataatgaagaggtgatatcctcattttgaaaagttgattggtctaaaaatcatttattaatttagtaatatatacaggaattagaatttaaatttactgtcttttcaatgacaataatttcctttagagtatacaatcttcctgtcactgctcggcatatggtttttatgatactaaaaagtacttttcaactgagatatagagctatttgaaataggagaattttcaaaagttttatacagcataggatgtcacaaatcttgactcctttttccaacaatagctttaaatattcttggcttcctcctatatagcaatggaaataccttttcagataatctcactaactggtgaccgcgcctaacattgagctatagatctctcataactgtacaacagtatacctataagtagatagacatttgtaaataatatagtgacattgttgaaaacttactgtgggccattcaaagacatttgaaatttcacttttcttggaaaagagaattgcaagaatgcaaaattgcttttagttttccttgatcctctgactgtagaattgagctgtatcatatacatgtttaacctactgaatttaactgtattcttttccagcctcctcagattttttcccaaaaaacttgtgcctgccaattcatttagtgagcttgtatgtgctgtctcacaattacaattcccacttttctcatagcatcaataccttgctgtgctgagggccattcttgctcggagcatgcatattttatctaacatagtcctgtatgcaagccagcttcttcagctgttgctcaaagtaacagttttgctttaataattgaggaaaagttggctgtattggacacatttgagagacggttcatgagttctccaatagttaaatccctaatcaaagaaaatggagtaactgcagttttggcctttataccttgactttggaaactgaccttaagaatgttgttcttctgtgacatcttacagcagtgtgatttgtgttatggtcatttatcaaatgataagtaggtatttttaggtggaaaactgggaaaagtgagagataattctcctttccctgttctttgtccctgcccctgacccctatctttttcttttcccatctcaagataaggaaaagagaggatgtgtcttacaaaaagttttaaaataccaaaatggggttttaagaagctttttgagagagatgaggatttgcccaccctttaaacaggtaggtgatggaaacctttggtagactcttctaagtgcacgtgcagattttctcttaccatgtatttttacaaaatattttgtgtttattgccacccgtctcttctcacatcctctgttcctcccagcactacttattgtgcgttttccccctcatggctttattatagttctattaactacattttatgaaaggatgtatgttttccacttagcgaactcagtggaagatacacagaacttggtaataaatagaactttataaggaagatgacttattctaaatattagttgtacaatagtgaaaagcagtatttttcgtgttttgctcagtgacttttttttgagcatcagccacgttgaaggcacaattctaggccccattcgcaatgacagtgttttaacttcagtcacgggagagcaacagcagttgctaaataattcttattttcattttctcaaatttcagttgacagtttattatgtgccagagggcatggttaaggagtggcatgccaaggatgagctgtgtaaccctgggccctgccttcagcagccctcatgatggggagataagtagttaaggagaaaaaccccgcaaaccaacccaacagaagagaggtgttaaatgctaaagctttatcatgtgatggtgaagagcacagactctggagtcagattgtctgcttgtgaggttctcagcacagcatctaacacaaagcaggcactccctaagcgttaactattagtgttacaactattatctgacagatttagttcaatatttgagtttgcaggaggaatacctaacattccaggcacagcttgatgtggggagctgtcaagggcctaagttcctcagtttaagagatgtgtaagctctgatctgtaggatgagtaagcgttgactaagaacagcagggcgggagagtccttggagggactggaggtccaagagagcagggttttgagaagtgatccagggatgagattcatggctggcttttgtaagcctgacctgatttagtctttataaacttgaagtgaatttatttaaatatgtattatgtttaagttatgttttaaacagagattaaaagaagacccaaacaattctaaataatatgacttagtactgttcaaacctaccagccgtcagcttcctttgttagaggctgttctagttatctcttactacacaactcttagtagtaactgtcctaacacttagcttaaaagagcagtttattatatctcaaagttatgtgggttaacagctgggcagttcttgcgtggggtctgtcatgaagttgtagtcacatagtgcctgggactagggtcatctgaaggcttcactgggatggatgcttagtatggtgagcagtgatggtcgaccatcacctgggacctcacctggctatcaggtgaaactcttacccaaggcctctgcttgtggcttgagcttctcacagaatggtggtgggttcccagagggagcatcctaagagctagtgctccaggagacccaaatgtactccacatggcttcttgtaagttatgtgtctcagaatgtcacttccactatattttattggtcaagcaagtcactgaagtcagtccaggttcaaggggagggttgttagatgtcacctcttgaagggaaatggtaagttcatgtcaaaggaattattatcatagttatctttggaatacataatttgcctgaggcctgttagttccataagtgttgaatcagaactttgaacttaacaaaacaatgaaaaataccattaggaaaaaataattctaataaacaaaattataaattccacttttgatacttgagacactcaatccttaagaatggaatgacaaaatgtgatacaagggtttcttcatttttaaatctaacatttaattatgacttttgacatggaaaaaattgttctgtgttgaaagatgtacccatttgtgtgtatttataaatatgaacagctgacagatagggaatcttaactgattaggtagtcatgaagattttctttcatggtgccttttcatcgcttggttttagacacatggcctgatacagcttttagtttatgaacattcataaaagcctaattaaagataatagcattttttggctgggcacgtggcttacgcctgtaattccagccctttgggaggccaaggtgggtggatcacctgaggtcaggagtttgagaccagcctggccaatgtggtgaaaccctgtctccactaaaaataaaaaaatcagctgagtatggtagtgcctgcctgttatctcagctacttggaaggctgaggtgggagaattgcttgaacccgggaagtggaggttgcagtgaactgagatcgcaccactgcattccaggctgggagacagagtgagactctgtctcaaaaaaaaaaaaaagatagtagcgttttctgaaattgatggttttaaacatgatattgtagtttatataaagtttggacaactatgtttatgtcacagttttaacttatacagggattcacttaagttttagaaaaaaacactaggctagactatgaacttcatgaagcagggtcagtctcttcttgttcactactttattcctaaagccttgcataatgcttgtcacctagaaggtaattaatgaacgttagttatggaaagtattattaacagagttctttggtacctattgaatttttttttaacagtgactctctaatttttatggcggtgattcaccctgaaagtcttgcttacctaattagattaatccaaagggccggtatccttttgcactgatacctacaaatagcactccatgtggtggaatcagattatctgagtacttccaacacgatgaatgggcaaaaatgagaagttttcttaatttaccattagatcagagaagtgactgctgatagaattcattaaaaaaaaaatctgtcctttgcacatttgccctaagagcttcaagttctgcagagtttgtgttttgtttgggaaattagaaaggtctattgcaaaagaaagcacagtagcacagtttggatatttgtgtgtgaagattgattgattaaggaaggttcacgacttaattttcatttacttccaggcatgagctgacttatttttaatagttatgacttcacctagaaactgaatggttgagagtggtataatggggcaggagtgggtatagggaggatgtgatagagaggagctccatcttaaatctcctttctttgaatctgacagtgcagtttgttgagataggagtaatactggtaaataatgaaattgaatttgatgctttcagttcatcagctgacatatgtaggcagttatgtacattcctgcaaagtctgttctttgtctggtctgtgatttgagaaaaagacattggaagctgcaacggtatagaaatactgcccccttttcttttaccctcttacgaactatatgacccagatctattcataaaaagatgattttgtggatgaacatagttttggctgttgtgaccataacatccaatttgccttggacaattgtagtttatgcctgctgttcctctgttatgtccagttaacaccatctttcactcgcgaaagggtactgccatagagaatgaattatatagacaccatgcttgtaatcaactttcatttgtcattggaaggataatagccagaagtatactcacgttaaattcacttataatccccaaacctttttaaaaagtagtgttttaaccatacttttaattacttggtaagatttaataattatacatatatatatatataaaagttcagtattacctatctggtggaaatactaaaaactgaattaaaaatgcataggacagaatgaaacagttcataatagtggttaagttctgttttgtagacagttctgaagggatttttaagctagtatgtaaaaagatactgctgtgtttgcacaaacaaggtgttcatcagcgcttcattcttactggctttgcagctctgtccttttaatggttcagtagccaattttattttggtgccagagatatctttgctttggtttttacaattggctgtggtaaaacaacataggaatgtctaaaataaaaaggaatagtttcatttcaacacccctttccccaccatcctttccaaaagtcacagtttaggtttcctaccttaaaaaaaagtggtttataaacaaaatacataatcaattttatttaacatttggtaaagaaagtatacaggattattttctaaaatattgagctgaatcatctttagattattttttactgattttaattttagtattcaaataattctttatatctggcctttaccatgcattgaaatgattgttttgtgtttttatgtcggcatggtattcacaactgcaagtcagtatggggtcacggaccctggctcctaaaataagtccaactgtgaaaaaggcaaaatctaaataatagtgttaaagtacataatttcttcagtctaatgatgctgctatccaaaaattttaatctcttacaaaatcagtaaagtagaagaaaaaagttttaggattaaaaaaattgaatgcttggcacataatagacattcagtcaatattagttcttttgtgtgttgtttctcccttcaccatgctctttaggtggaagcagcctcacaggcagttgagcatccttaaaatcaggaatcctaccttgtatcctaatttttctatataattattaaaaaggatttttttgtatttattacagtgctaactaattatacttaagcatattgctttgctttccagggctcattggagttcaaattgcccgataaaagtttttacttttataaatacatatatatttcacataccatcaaatttaccattttagaatatacaattcagtgggttttaatatgttcataagtttgtgcaacagtatctaattcctgaacaatcatcatcccaaaaagaaagctgtactcattagcagtcactcccattcccacctctcctcattcctggaaaccactaatctactttctatctgtgtggatttgcctgttgtagacatttcatataaatggagctctgcaatacatgttcttttgtgatcaactttcttcatgtggtgtaatttttttttggaagacagagtctcgctgtgttgcccaggctagaatgcagcggcacaatctcagttcactgtaacctgcacctcccaggttcaagcgattctcctgcctcagcctcctgggtagcttggatggggtacatgccactgtgcctggctaagtttttgtatttgtagtagagatgaggtttcaccatgttggccaggctggtctcgaactcctgatctcaggtgatccgcctgcctcggcctcccaaagtgctgggattataggcgtgagtcaccacgcccaacctcatgtagtgtaattcttctgaggttcgtttatgttgtagcttgtattagtacttattttattttggtaaaatatatttaacataaagtttactatttaaatcatttttaagtgtataattcagtggtatttagtacattcacagtattatgcaaccaacaccactatccattttcagaactttttcatcatcccacgtagaaactctacacctttgaaataatggctgtccatttcccctcctagccactagttacttttttctatgttctatctttatgaatttgtctattctagatacctcatggaagtggaaacatagaattttttgtgcttttgtgtcagacttatttcacttagcataatgttttcaaggtccatccatgttgtatatagcatgtgtcagaatttccttaaggctgaatactattccattgtatatcacattttgtttatccattctttcgttgatggacatttggctgttgtgaatactattaatactactctgaacatgggtgtacggatattggttagagtcccagctggattatatgtggttatgcttaattttttgaggaactaccacacttttcacagtagctacaccattttacattcccaccggcaatgtacaagggttctaatttcactacatcccctccaatatttggtatctttcctttcttaaaaaaatagccagcctagtgagtgtgaagtggcatctcaatgtggttttgatttgcatctccctaattgctagcgatgttgagcatttgttatgtgcttattggccctttgtgtatcttacttggagaaatgtctattcaagtcctttgcccatttttgaattgggttgttgttcgttgttgagatgtaggagttctttatatattctggctgttaatctcttgtcatatatatgatttggaaatattttctcccattctgtgggttgacttttctttattgatggtatcccttaatgcacaaaaacttttaattttgatgtttaatttgcgtgtgttttttttttttaaatgaagtgttgatgttaatttttaaacatttggtagaattcaccagtgaagctttctgtttctgagattttcttcgtgggaagttttcttaatcagtaatttagtctttttacttgttacataggtctattcagattttctgtttcttcttaagtcagtttcttttcttttttctttttttctttcaacagctaagcatatcatagagttagtttcggtagtttcctgtctttgtaggaatttgtccattttaactaggttatccaatttgttggcataaagttgttcatagggtcttttaaaatcctttttatttcagtgaggttgagagtaatgttccctctttgttttttgattctaataaattgagtcacctttctttcttggccagtctaaccaaaggtttttcagttttgttgatcctttaaaaaaaaacttgtgttcattggcttttcttgattgtgtttctgttgtctgttttatttattgcctctctttattgtttccctccttctcctttgcttgctttgggtttccttgctctttttcctcgtttcttaaggtataatcttaggttattgatttgagatctttttccccaattctttagattgtagcaaaataaacatagcataaaatttaccatcttaatggtattaaatacctgcataatgttgtgaactctagtccccatctacctccagaactctttaaaactgaaactgtatacccattaaacaattaaacaataactccccattcgctgctccccaggccccctggcaaccaccattctactttctgtctatgattttgactactcttttttttatattttattttctttttnnnnnnnnnnnnnnnnnnnntagctattgtgaataatgctgctatgaacacgggtataccactatctcctccagaccctgcctgctttcagtcctttggggtatatacctggaagtggaattgctggagcatatggtaattctatttttaattattcgaggaaccagtatactgttttacacagcacctgtagcgttttacattcccaccaacagtgcacaagtgtttcaatttctccacatctttgtcaacacttaccattttttctgtttttctttatagtagccatcctgatgggtgtgaggtggtattgagatcgtcttttttttttttttttttaatgtaggtgcttataggtataaattaccttctcaccgttttactacacccttaagttttcttgggttatgttttccttttcattaatctcaaagtattttctaatttcccctgtgatttttttcattgacccattggctatttaggaggatgttgattttcacgtattttaattttctatatttctttgttctttcagattttattctgtctttggagaacatgctttctatgattttttatctttttaaatctgtagagacttgttttatggcttaacattgtttatcatgtgtaatatccatatgcccttgagaataatatattgtattatttctagttcaaataatttatagatgttgataatgtattgtgttattagaggaaaatatatgtcattttaatctgatgatttaatattttgaggctatccttttgacttatataaagagctccctgtttatgttatctgaatttattgggaggcatatctgtgtccagaacatagcatgtttaagtgacaggtatgaatcttgttagtgcctattactgcctggtaactggcatcatgggcaaggaactgaacttcagtaaatggaggacttggtttgctgtgaatgttttgaacactgaatgagtcctttgcttattatataatttttgagagcctaagcacatgatgtttcgtaggttatatgaatgattactctgctttactattatcattaattaccataaagcatccccatgaaatgcatgtttgctacattcttggcctgtcatttaaatagatctgtttttactgacctgtgatttatctacaacaaagagcatcccttgtatgtgtatggtttgatagtttgatgagttttgacaaatatatatacctatataagtatcaccccaaccaagatagcatttaatcactcccaaaagttccttccaccttatgcaagtactaatatgcattgtcactatagattaaatttccttttctagaatttcataaaatgaaatagtattgtcagtactcctgtgtctagcactaaatgtgtttctaagatgaattcaaatttttgtatgtatcaatattcctgtttcttggggaagaggtattacattgtgttaatatattacaatttatccattcatctgttgatgggcatttggattgtatccaggttttgactctgaacagagcctctgtgaacattcttataaagagtactgggtagtatgctttcattttcatgtccttaagggaaattatggttctgtgatttcatttgttgtaagccttagatatttgttatttgatttccaaatatttgggtatttttatgctatcattttgttatcaatttgtagtttaattttgttatggtcaaagaatgtactttgtatgactttagtccttttaaatttatcagtgtttgttttataggacagaatgtagtccattttgttgaattttccatgcacatgaaaaaaaatgtgtataatgccatgggtgggtggattgttgtgtaatgccagtcaggtcaagtttcatgatagtgtcattcaggtattccatatcagtacttttttttcttgtgttatcaagtcattgagggggcatgttgaagtttccagtagatttgtctgtgtttcctttcggctgtatcgatgtttcctttatatattttgaagttctatttttgtgttcatgcacatttagaattatgtttccttgggggacttaaccgttttattattatgtactgtctctctttatccctgttagtattccttgttatgaaaactgctaacggtagtgaatagataaaagtgtagttggattacaatcttaatctgccatttttctagatgattggttatgtttcttctgttttctctttctgtcttttgtgtatcaatcaaatggtttttatggttttatttttttgatttaaaactttgttttgagacagggtctcactctgtctctcaggatggagtacggtggtgccatcacagctcactgcatcctcgacctctggggctcaagtgaacctcccacctcaggccattcactgcgcccataggagctgggaccatttctggctaatttttgtattattttttgtagagatagggtttcacagtgttgcccaggctggtcccaaacttccggactcaagccatctgcccacctcggcctcccaaaatgctggaattataggtgtgagctgctgcacccaagctattttattttcatttttctcttaaaaatatttgtagtggtggctctgtgttaaattttttcattttttttctctctgtacttcagtttgggtactttcagcatattttcaaatttactgatctttcattcttacctgattaattccatccactttttaattttacatatttttttgtctctagacttttatctgggccctttttaatatatttcttcatcattatgtggatgatttccagcatgcttataatagcttatataaagtccttgactgctaatttcatcatctttgttatttctgcattctcagttgactgaattttctgctagttgtgtatggtagttttcttcttcatatcatgtcttcatatcattttattgaatgcttagtactttgaattttatatttttgagcatcaggtgttgtattcctgttaaggagtattggactttattttttcagaagtggttacattcgtctgtggcttatgttgttaggcagtatgtaggtatgattgagctgcattgctagggtctaaactcccctgtatatccactgaatcctctggattttcaatagatgcttcactgtggcctcatctctgacaactgtgtgagcgttggatctctttagcatatcgccctcggtcactttttgaccagtttcatggagtttttcacctgtgcatgcgtgggtttttcagaaggtcttcactgatacttggaaagtgcctctaggcagaaagttgaggcaaacttctggcttatctaattcattttccttcttggatattatcattcagtactgcctgtggcctcatgtctttaaaaagttaacctcagtgtggaaaatctgtttttccagttttctaattgtttacaacgggagtgtaagtctggtctgtttttccaccctggctggaagtggaagtcatggcctaccattttattttcaaacctttttttttttcctacccagaattagcctgaaatgcctcatctacgattactaataagagagcctgttaattttgtttgaaaaatttaaaggaactagtttacagtttttcaaccgtgttattaataaaaattaaatttccctactttatcatagtctccctttttatcgtagtcttttgtctataacagttaaggggcagggggaagctagatgtattattaagtaatttttacttttctcatttttttagacctaaggattgtcttcggtctattatgagaagagtgaaccacaaagatcctcacgttgctatgcaggctttgactgtgagtggtttcattttaatctgtaccacgaaattacctgccacaattgagcccctttaacttctgattttgtgcttttagcttctaggagcatgtgtatcaaactgtggcaaaatttttcatttagaagtatgttcaagagattttgctagtgaagtaagcaacgtattaaataaggtaaggagcattatttccagaaattaattaaggcagtcttctttcttcacatattttattgtttaaatcttcacagaggactattctgtgctttttaagaaatcctttctaggctgtgtctatccagtatataaataaatattatgttttgttgaagagactgcggattcatgtaactttgagttagttttttcaagccatattagagtgtttttaacctgttcttttccatcatactttcatctgataagaaaacaggtatttctatatctaattaaataatatcagtctattttacatactgtttttgtaggcacaaggtattttcctaatggaaaacctttcagaaacactgcaaaaagtctatggcaccgttgagtttttatctttatcaataaggctgcttcctggccatcacaggattttaatactatactgctattcttactggctgaacccacagctggagttgcctcaaaagtggtggcgggggagtttccacaagggactgccccaaactgttccagatagggccagatgagagtccaaaaaaagaggcactaaatgccagggtgatcagtctaaaggatttattaggggaacttacacaggagggctgcagtttataggagggtttaaggaatttggctcagggttggggctggtttctgtgtgtttagcaacatacttgatcttttagtgttttgggccacaacctgaacaactttatcagtgcctgagaatgttcaaggccccagtttgggtccaaacctatggtggaaaacatgcagctggctaggtcacagagcgggacaaggcactctgtttttctattgggacacagaaagaaagcagggagaactggggaccctacaactgcccactcaactgtagaattctagtcacacagttcaagaaatttttcaattttcaattagtaatatgtgagtttccccagtaaaaatttgtgcattctaaaagtaattatttttggcctttttagggggagtactgtaaatcaagaaaaagtttttgtatgttaaaagggaaaatgcctcatgtttttgggaaaaatgaatagttccaggttacagtagaaaaatagcagtatagaaatatagtaagaatgtaaaattctgtacttttcgaacatcatggttaaatgataattctttccctttcctgctttatgcagttaatatttattttctactaattaataaacattgtcttttaatgtcctgaatgtccatcgagattacaactgtttatgaagagattctaataccatgttttttgtaatgtaggtgaaaaatgtggtatacttacctatgtataatagtgcaagcagccatttccaaaaacgacttcctataggcaagaggacttctctttattttctgaatgttttacagtgaacatattggttttgtacttaataacatcccgccttttttttttttttttgagacagtgtctctctttgtcacccaggctggagtacagtggcgtgatctcagctgactatagcctctgcctcccgggttcaagtgattctcctgcctcagcctcctgagtagctgggattacaggcatgcgccaccacgcctggctggtttttgtagtgttagcagagatggggtttcaccatggggatggtcaggccagtctcgaactcctgaccttgtgattgcccacctcggccttccaaagtgctgggattacaggcatgagccaccgcgcccagccaacatcctgcccttttaaaaaatttccttttattaaacaaattaagttcatgtatagtctcaataaagcgtttgcaaatccattatatgctccttgaccaaaatacagattacatgtgcacttagaaagaattttttttcttctaatagagtaatctaaaagtctaaccttctccatttttaaaagctttagccaattatttagtaagcattggtttgaaatacattcatgacatttcatagaggagttatttcttctctggtatctgtgaaggtttctttatatctattacatcaaatagtaagacttcaaattattgccgctatgaagatacatcagtattttaatgaactggccaggttttttcccttaataagcaatgagtaaaataatttattttgaaaactcactacatttatctctttctttaatacggaagaataatgccctgcacacctgccttagactaacttgaatctttgttatacatcaaccataaagagttatgttattttgggctgggcacggtggctcatgcctgtaatcgcagcactttgggaggctgaggcgggcgaatcagttggggtcaggagttcaagaccagcctggccaacatggtaaaaccccgcgtctgctaaaagtacaaaaattagctgggcatggtggtgcgcgcctgtaatcctactcgggaggttgacacaagagaatcgcttgaaccgcatcccccacccccctctgggaggcggaggttgcagtgtgctgagatcgagccactgcagtccggcttctgccacagggtgagactctgtctcaaaaaacaaaccaaaaaaaaagaaaagaaaagaaaggaaaaaaagttatgttattttgaagaaattaaattttcaaaatgattaacatgcagtgtacctcaaactaggccccagataattaagcatcatggaaaaaatgcatagtcatgaacattaagaagtcaggaatttggaataaaggaactgtatcatttattctctccttcccacttttttattgctttgcaaaaagcagacacttttccttgtcttactgatgtacaaaccttgcttcgttgcaaaatattctgaaaagtcctttcagatctccaaaatcttattacctatttaatgctttaatttgaagtgagatatatatgatgggttttttcatagtgtgaacattagttttatttcgaataactatattttcttgtctatagctatgcataacttgtgattcaaaaaacatcacttaataactttactatttaaaatgtctgtattaaatcattggctaggaaattggtgctcttttatttctttttctattttacagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggtattttgggaatgaagttgtgtgtgtgctacagtttgtttctcttaaatagctatatttatttgaatttttttcttcattcccaggtaatttttactacttcagaggaattttcgttagctaattgtgttagtaactagttgtattgctagttagtaatactagttttctggcattcagaggtgccagaaaagtattataatggaatattaatgtgctctaacctctctacttctttataaacgaattggtttaacattttgcagtttttgaaattttttggtatagtttttgtttgtttgtttttgagacggagtctttgtttgtcgccctgggtagagtgcagtagcgtgatctcggctcactgccacctctgcctcctgggttcaggtgattctcctgccgcagcctcctgagtagctgggactacatgcacgtgcagccagacctggaaattttttttttttttaaatagaggtgggtttcaccatgttggccaggctggtttcgaactcctgacctcaggtgttctgcccgcctcggcctcccaaagtgctaggattacaggtgtgagccaccaggcccagccagtacagttttaataatatacacaaaatagctttattaattaggtaacactgtctttttaaatgctcttaatgctataattttctacaaagaatgatagctcagaaatcaggatatccttaaaagttagggatgacttgagagattcttttgtggaggaaatttatgaattcctctattaacaatgagaggactttagaaggggtaaatgggaagagaagcacctgaagcattttctccttagtaagagccgaccagtacataagtcttcctttccccagtggatatggctaaatagcttaactttgctctcctgtccacccttgtgccaaaaaaattcagtctctaatttatgtcatgtagaaaaaaatcaagaaatgtcttttttattcctatttctattttgggtaaccttcctttaggatgcccaactaatcaagaggcttaaaatatgtgctgatttactacactgtctttccccagtttattgactgggacagactgtaatgagtgatgtgaaaccatgaacagaaatctgtgagtgtggaggggcttatgttttgaccacttcagggagtcatgtagcttatctacattcatccagacctacatgtgctttcttcccaaggcatttccagtttatctgagcactcttgagatgtgaagactcaaaaatgtatctgggagaggaaggaagcaaaggacatttttcttcttaaaaaaattttggtttaaaattttcttaaaaaaattatgtctttgaaaattcattcattcataactgatagctggtttttactactcagtatagtttctagaatctgtataattaaggaaaaatcttaaacagaataatccaagacattatacattccttgacaacagaaacaatgtttatttatcaaagagtagactcactgcagagaacccacctagaataggtagagaaaatgcaagcccactaaatatctagagtctttggttcttgttaactcaaaacttggtttgaccagcatcactggcattacctggaggcttgttagaaatgcagcatggttgaacccactccagacctatgggttcattatctccattttaacaagatcttcagaggatttatatgcacgttgaggtctgagaagcactgctgctctagaggacagccttcagtgcaagtgaaaactgcgtttcagtccacaaagggacttactcttgtaagaaaaggaagaattaatgattgtgccatatgtacccttgtttggttaatctagaatcttagccacggaaacagttttagggagcctctaatctaatccgctcatttttacagatgaggaaactgagactcagaatggttaagtgacttgcccagggacacagctcatagttgacagctggaactagaacacaggcatgctgattctcagtccagtgttcttttcgctgcccgagtctgccttctttgttagagaggttagtgaatatgtgtctgtctagaccaggcttccagtggagtgaatgctggcaagagcattatgtcttgattggtagagaaactagcttattctcttgttcaagaaattcaggacatagaagagcaatagtaaagataggacttaattttcatcctttgatctagatgttataaagtatgtaacagctaatcttgtcatagtggctatatttcacctacaagaaatacatataaagtaaaatatgatgaggtagaatgatttttttagtggtttctgaaaagcttattagaaaccctacatgtaaagagcttcacattaaatgaaaaaaataaatcatctaagttcaactgcagaactccctgtagattttaaagccacttagttacttaagttattactgtgttttcatcagactagatttttgttagggcatacttaacaaaaacctctgaagatatatttttctaagtatatttttttcatctgagtacagaagaaaataatgtaaaaatattaagaaaagtgataaagtcacctgactcatactgatgcagttctgttagcactaacttttgatgtaaagatagaagtaggctagcagcaccgctaccgtagttggctgcttaataagacaagtgttattgttacatttagaacctgatgatagaaaggaactttgaataaaaagtgcagttcagaaacatgcggcttcacatagcttatttctgcgcttctctactggtagagatttcttcacacaccataaaagttcaaatctgtctaattgtgaagtttgccaaattgtgaacaaaaatttatgtaaaccgtaaaacttatttctgaccaggcatacctgtagttttcagaagtgtctgataattaaaacattatctaaagaaaattgcaactagagataggtcagaattgagagtgtttaaagttgtattctgtgaacaccaaaaagtttttttcttctcagctcttctaaaaataaatgcctggccgggcgcggtggctcacgcctgtaatcctagcactttgggaggccgaggcgggtgggtcacgaggtcaggagatcgagaccatcctggctaacatggtgaaaacctgtctctactaaaaatacaaaaaattagccaggcgtagtggcaggtgcctgtagtcccagctactcaggaggctgaggcaggagaatggtgtgaacccgggaggcggagcttgcagtgagccaagatctcgccactgtactccagcctgggcgacagagcgagactcaaataaataaataaataaataaatgcctgtgcatttgtttgacaacacgaaatccagttaagtgaggaatgtagaactgtattttattataatgttgaatatttttcctttcataccctcaacaaacattgattgattgcttgtaatatttaggcacattccctcagggaacatacagtctggttgtggagacagacatgtaatcagacaattataacagaagctgagattattgcctgttacaatgttccagtcagtgttctaagtgctgtacatgtggcaatttgaatgtgttttagaatttcatttttaaattgtttgccctgggaatgacaatatacattcataacttttcatgatctactttgagttaatatttgatgtaaaatatagcaactttgcatctgtagaggtctgtttacactgtagttgtcatgtgtattacctctacatacgttataagccccggaggtaatgttacatactttttgttttaaaccctgaatgagcccatctcatctgattttggaatcacatgtgttaatttaatactttaaataggctgtgaggtgcccatgaggtgtaggtgctattatcgtagtcattttattgatgaggaatttgaggcaccaagaggctaatttgcccagtgtcatccagctagaaagtggtagatctgggatttgaactcatgtctgtctgactccacaacttacattcttaaccactcatatcgcagtaccttgtttaaaggtgttatcataataacaaacaagagaatgtgtaattaacaggttgagggatgcttcattgacagtgatattttagctgattactgactgatgtgttcaaactcaaaagggaaaaagtgaacggagcaaaggagccatagggggagaacgttgtaagtagaagtaaatgagtgtgagacctgtaaagtaccggtatagagactgctcaggaactgctagcagtttctggtaactggcagaatggttggaaatgaggttggtaagataggctaaattctgatttgccttgaatgctatgcaaaaactgagaggccacagagcccataggcttagaagcttgtaattccagaagtgtgaattgaattatatgtttgttgtgtattcccttatttacacaatttaatagaggcagtgatatactgtcagaattaactacttgtaatttggtttacaaaataggatttttgagcatttatatcgttttatatatatatctgagttcctgaagataacatcctgacacttgatccaaaaggaaatgataactctaactattaatagatactacagttttttttttaactatttatgtttaaagtagtcatctctttctgtctcccagcctcttttctggttttggagtttttttaaacacgttgaaatcttctctagtctgtcttctctgacttgtgtaccatatgcttttagttgaacctcttcacacaaacctgggagggtgtgcctaggctgcctcctctaagtgtctagttgctctctgtgttctccaattctgattcatttccctctcccttttaaggtggaagctgctgcagtttggatttcttctttcagaaatctgtgctagattgatgagaaaggttttgcaaattcttagggtgggtgagaggaggagaatttgataacaaccctcaaatactgtgttcctcttttttgttaggctgcagaacaagcaaaagcaagcccagctcttgtagccaaggatcctggtactgtggctaacaaaaaagaagaagaagatttagcaaaaggtgcgtttttaagtccctgatggtgggaataacataagcctttattttttctctgagatatttaaaggtaaaataaatagaactttatagcaaaaagctgaaatctgctttgttgccctcctcagtattctttgctttactcttgagaggcaattactgtcacatgtatcctttcagtctatgtttttatgacagttttttactataccgtgtatccaaaaacaatatcaagtgcttttttgtgtctaacaaatttgttttttgtagatagtacacgggaaatgccatttgccacttgcttttctcatgcaacattatgtttgagatctattcgtgtgatatatccattaactgttctataatatccagtgtactaatgagtgtaccatatttttctgtcttcctactgatggacctgtggattatttctgatttttttttactaaaattaagctgcagtgagtattcttgtacatattctctgtgcacatatatgtgaccgtctctattatgtgtgactaaaagcaatattgttggatcatggcattggtacatcttcagttttgttaaatggttgttatgatttccttttccattggcagtgtatgaaagctattattattaatctgacaacacttggtagtcttaaagagtttaactttcatgaatctggtaggtttaaaatgatgtcctgttattttaatttttatttttttgattgctagtgagactgagttctttttttgtatattcactggtcattatgtttttctcttgggtaaattgtcttttgttaaataaaataatgatatgtacaagtctttatttgaaatattagtttgttatctgttgtaattattgtaggtatctactcctggtttttgaccttaaatttgataatggtgtattttatcaagtagaaattttaagttttgtgaaggccagagttgtttgcttttttattatgatttttactttgtaatggcttttgaaaaatattgttccctacctcaaggtcctaaaagatagttttctgtattgacttttagtagctttaaagttttgttttcgtattgtttcttttattactctaaaacaagagcggaagagcagaaagggttctgtgttgaattgaaagcaggataatcaatgcactgatattacatttcagagcctgagtgacatatggtgatggtctgcacttgggaagtagtggtggagatagagacacgtttgagatctattttggaggatttgttaggttgagtctttagactggtaagaattacccttggagcaataaaatctcgattctccaagattgcctttaaggctttgatttattaagtctgcagtgaagcttgatattcttgactttccaggcagttttgatgattattttgaaaaaaaggtcaaggaaaatatctgcagctaaaaaagaaaagtagatttaagagtttgtattttttattacccagaataatttacattgtatttgttcagtaaaaataggagttttcatgctgttccaattttgttaatttatttttaaactttcagttgtgaatgaatgaataaactgacaaaatgatttttgttcaatgtatcaggatatgttctagtttctaactatactattgaaggaagaataccttttatcttgatgtctttttctacttcttcagactgttggatataataacattttgggtctttaaaaactcattgttttctagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacaggtaatgttaatattacatttaaaatttgtatgaaagtgtgtatggcttctgtgtttcatattattcctgttgattgcagttaccaaatacaataataaatattgacccagatgctgctctgtatgacagttggctgatttgcttgtgttatactgggtggattcttattttgttgtttaatttttttcttatttattacttagtttataatttgttttggaggcctagtttaatctattcattttcggttccacctaataatatagatggttacattatttaaaaggttacagttttagaaaaacactgagtatgtatatgtacttaatgcaatttgtaagaaatatataatctattgagttttttttacacagaacagtatagccatagggaacaaatttattttgtatggaattacacatttattcaggaggtgatacagtgcatcagtttatttttttactatagctttgtgatgttttacttgaaaatgaattgttactgatgcttgttactgataatgaagtattaaaatttgcaggtgttttttaaaaatcagttcaaattgatttaaagttcttcctgtagtgtctctcttacttactgccttagtccatttgggctgccgtaacaaactaccgtagactaactggtttataaacaacaggaatttatttctcacagacagattgactgtgtgttgaaggcccactttctggtttgtagaaggctgtcattttgctgtgtcctcccatggcagcaggggcaaatgagccctctggggtctcttttataaggtcgctaatctcattcatgacttaatcgctttccaaagtccccaccttctgataccattgctttgggggttaggatttcaacctgtgaattttgggaagacacaaacattcagacatattttaacatttttttttttttgagtggaagaaaataaagtttgagctggttagctggaaattgcccaaaaccttacgtctgttctttcaaaaacatgtattgagtgcttgctagctttccatatactagagtttacacctaggagtgtactctttgcgaatgttttgcactgtgaacagtgtcatctttgacattcgttctgttgggagaaaaaaaaaaccttgctgctgtgtaccagaaagagcaatgatttaggaatggagactgaaaataagagcctgtctttatagctcattacaaagacttcttactctggagcctgtgaaccatctgaagctgacaattttttcgtattggtgcctctttttttgggagagagtccataactgcagagcatgcattggcagtcaagaagataaacaactgtgtgttgaatagcttcttaccttttctgaggcttcttcttcttttgtaataaaggaagattcattggctttttcagtgggttattgtgagattcaaattttgtaatagtgtaagttgaatactacaaaagataaagatgtacagaaataaatacatttgttatggtaaagcattgttttttgtttgtcatagtgatcctaactggtggaaaggtgaaacccatcaaggcatagggttatttccttctaattttgtgactgcagatctcactgctgaaccagaaatgagtaagtattttccagcctgccaataaatgatgttttctaatccttttcttaatggaagttgagtaaactgaactttttagagcagtgttgcccaggctggagtgcagtggtgcgagctcggatcattgcaacctccgcctcctgggttcaggtgattctcctgcctcagcctcctgagtagctgggattacaggcacccgccgccatgtccagctgtttttgtgtgtgtatgtatttttagtagagacagggtttcaccatgttggccaggctggtcttgaactcctgacctcaggtgatccacccgcctcagtctcccaaagtggtgggattacaggcgtgagccatcgcacctggcctaacttttctttttcatatgtatctatgtagaggtcattgtaaaaatgcaaattcattaagaagtcttacagaatttatacattatatatttttcttaccagttgattacagtgtgacaagtacagtataacctcagggaggatttttcttgttcaaaggttgggaccgtttctctagtgtgtagtcccagacttgaaagcagtgttctccaagcaacatgtcagatattcagaaggagccatttttactaatcatataaaagttttttgtttgatttacaaaccctgctgagtaggataataaactagaaagtggggccgtggagaaaaagtgatactagtggcaggcttaacagtttcaggagacatagctacatagtcggtcaaagtagtgagagacagtttactatatttctacataatattgtgctttaatgaatcttcataatgatgagtttagtcatcaagcaaagtttaagtcataatctcccctctaggaaaacagaaaaatatgttcaaatctagaaagatttgtatttgtaataaaatatttaaaatttttaaagagcttatatatataggttgatatgctacagttatttggcaaaatatctcattatcgttttttaatgctagatagaagggatcaaagaaaattacaaaccacaagatgcttaggtgttttttagtttataagaattttaagaaaaaaaatctttgtcctggtcatctttttatttccagcagctcctaatagtgagtcttataatacatactacatatttatagaataaatgatacagaaatatatatgttaacaataaagagatacttcacttctctttcaagagaaggcttgaacagcaaaccagaaattacagatctttaagaaaatggtgcgctctcatagttattgccagggtgtctggtgtcatttttatagagacagattggtgagacccagtctttcaatgatgttttctatgtctgtgagaattcaaaaacatgtcaaccttgtttaaatggcattgcgtagtgtgctgactttttaataacctgggctggtaatgatgttttgtttgtttttggactatttttttgtcctgaatcagttcctggagaggatagaattgcttggagttctgttcaagataaggtcaaggatctcatgtagatcctggagccatttcatctttttttttttttaagtcatatagcaatgcagcttcaatatgagttttctagtttttctcatgtttttcactctggacgatctaaaagagaaactgaagcatcagagcctatgtagtggggttgtagttctcaagcgtggagaacaggtgcaggtgctagcatgatccccagagcatcattcttttgaggaaatagaagtctatttcacttagcctgtcaaagagaaatagctgccctatttagcttgcttttggtttggagatacagtaaaatattgtgaaatccctttgttatatattgtatataaataatatatttttttacacacacatagtattagttcctgtgagaaaaggggttgcaaacttgcgcgtcaagagctgttagaatatgaagtctgccatgtttttcttatgggtaatggccaatgcagtgctatcccagctttctacttgtaatagctcaagatataaaaagcaaaatgtctgcagcagatgtttcttttcctttataggaaaatgaatcagctgtagaattttgcttttggtgacttgaatggaatgattatatttcttaggttggaaattaagctatttctgtgttatacagaagcacacaacacggagtacccaagtgattggacttcatgttctcggggtaaaatcactggcacaggccagatttcagtagtatgggctagtagagcaagatagattggcattcaaatccaggctttgtcatttattagctttctcttttacaaaagtttttaatctttccaaactaccttatttataaaaagggcatatctcataagattgggagattcattggaggaaatgtaatattccatcaagcatattcaatagtttaataaacattatttcccttccttaaattgccccctcctgtcttcctttccatcatgattcttaatatttttatgaattgattgaccacattgatgcaaggattaaaaatatagaaaggaagtttgtttagtagagttgtatatgcctttcagtagtatttggaggttgttatatagctactgttatgttaaattgtttttaaagattgctttggtgagtaggagaaatctgtgcttctggccaatgaattgttgatccctcaatgaccactttttaatgtcaaatgataatattatataactagaaaatacaggctgatttgttggaagactgagacccctgtcaaggccacctgcaaagttctccactggcatggacggcgctctctaaacgcctacgtggcacgccagataatacatagctgattttcccattcattacattggagtagtgtggattttctgtcaaaccagattttttttttctaccaaatgagattttttcttgaaggattagtaatttaaaaagagggtttattttaaattgcagaattcacttaggccattgtaaaactttgcttttgtcctccagcttactaaactctgatgtgtagtaggtgattaaccttttttcagaaatacaactcttattattagtgaaatctctttttatggaaactgtaaaatgtttacaagagaaaattaagaaatccaatttcataaagtaatgttgtgttattactgccaaaatctgcaactcagttatttcttaaattgcgccttttagcttgctgggagtataagaaaaatccccaaatctctcttggaagttaaagtgctttaaagtagaattttaaatgtattattaaaaaaagataacttttacatatcttacagttaaaacagagaagaagacggtacaatttagtgatgatgttcaggtagagacaatagaaccagagccggaaccagcctttattgatgaagtaagtggtttccatggtgataggagttggtactttgtattgaaatttaaatggttttgctttaagaaaaaattgattacttgagtttttttgttgtaaaaatttttgtatttttttataaaaattcaagcaatatagacgatgcagactgttttttgaaacttcctctccagtcctttgtttgccgtgccagagcctcattattttaaattcctgctgaatattctgtagagtggccttaccatgatttatttaatctattgttgaatgcctaggttgtttacagtttttacagtgtagtagtgagattttttttttttttgaacatctatctttgtgtttctttagggtagatattcaggagtgaaactattgagttgaaggatttgtgtattttccatgttaatagataatgtcaaattgttgagcaaaacaagtttttacactcgtattcatatcatgcgagaactcctgtttcccagcatactcaacaaggatattaagattgtttgcacatgactgaggaagggacactcattgactatctattgaaacaaataaattactgttgtaaaaataaaattgtcattaaattacttctacataaatcattgcataaaagcagtgctaatatattgaatatcattggagatgattcatgattcctccttgtgttgaacactttctagtatttgaggaaaagcttacgctaattttatattaaatgtcttcatatgtcattgtcacacctgaaacaatgtatatttttagtaattatgctcaaaaatataatatcaacttggtgacacaccatactttttggagccacataatggtacccaaattggtattattgggatttaaatttgagatttcttgaattaagttaatcactcctatttagttaagttttatagaaatatctgctgttactgcatataaagaaaagattaaaactggctacctttttcatctttaagcgtgtttatgaaaaaataaaaagtatgtttgtggttgtctttttctactcaaacttattaccatgttttaaaaataacattaacaactgttgagttaataatacattaaattatgcaactagcaaaccattaaggatttttgaagtgtcacattgtatagatcaggagttggcaaactcttaggccaaatttagcctgttgcctgtttattggaacacagataaatttgtttatatattgtttggctgcttttgtgctgcagtggaagaattgagtagtagcaacagagatcatatggcctgcaaagcctgaaatatttactggcgggccattacagaaaaagtttgcttggcccttggtatggataatttaaagagaatcttttccgatcctcagttaccatagcattctttcctaaaattgatctgcccgagaacattctctcctaccattttcgtttttacccccctcctctcccttttcaattcttctctccaactttacggaagaaaggcttaccgcttgcccgtagtgaagattactgtggtacattgcctcagagtataagaattaccagggatgatttcatatactggttttggtattaagaaagtcatggctctaatgactagttaacacagctgagatggttccatattttttgtttttaaaaaataggaccaaaatgaattttcagctagtagatcattaaaaataatttttaatgacagaccactgtcattccattccatctttcagaagataccgaaagaacttaatgaaattgctataatagcttgattatatgaacaaaatttctcctcactttcaactataaaaacaaaaaataggaatagaactggtgctgaatcctggctcattttacttttcaaaacttgaaatatagttaatgttgttttgaccctttgcatattaataataataatcattaccttatacatatgaatgaatctaatactgagagtattatcagtttacatacttttagtgcaaagaaatcccatatggtcatcggtagaaaactttcaagtatattaggataaaattttggaggggaaattgagtagaaatatgataagttcaaggaaaaaaacaatttgaaatacatgacagagactgttgtttgaatggtaatggtgagtgcagattgctgtggtgtttaaattcctttggctatatttaaaggaatttttgactattttattttaaaatgtcaacacttaatgtcctgggaatcttatcctttgtaacattttaaatgtataagaaatgagatgttatctttgaaatatgtgaaggggtttatgggcttttagcaatcttttatgggaggcagaaacaaaatttgaagagcgaaacagactgtggaagactgtgctaagggcaaggaatccacctgggctaggagaagtgatgtttggctgattgcattatataagaaaatgctggccaggcgcagtggctctcgcctgtaatcccagcacttcgggaggccgaggcgggcagatcacgaggtcaggacattgagaccatcctggccaacatggtgaaaccccgtctctactaaaaatacaaagattcgctggacgtggtggtgtgcgcttgtaatcctagctacttgggaggctgaggcaggagaatcgcttgaatctgggaggcggaaggtcgtagtgagccaagatcatgccactgcactccagcctgggagacagagtaagactccatctcaaaaaaaaaaaaaaaaaaagaaaagaaaagaaaagaaaagaaaatacttgcagaagcagactaatcatctatgtagaaaccctacttctttgacactaaataattttaaatattgtatagtattctgtaagcaaacaaaacggaaaccatctgtgtgttaatggactctcactttcatttgacctttttttgtgtgtggtaggcaaactttcttgacatgtgcttttgttttttaagactgcttaaaatgaaaattgtgaataatttacattgaaaattggtatccatttcaaaaaaacagaattattttgacttgggaagagttttttttttttttagcatacttatgtcactttcactctctgatgattaattcgtttctcaagctattttccttttacacagaacatagtttttaaattttaaataattactttgcttaggattagtagtctttatttgccctgcgtacctatatatagtagcataaccatgtaaaaaccatgcatggagaaaggtttgtaattattttagtagtggtcatggtaaagtagatctgtttggattttttaaaaaacataaatacatatatacttatatatcgtatagatgtgtgtatgtaataatggtttcattcattccattggtctgtacaacaaaagattctgaaatagatctgtgtcactggtttgaggtaccttccagcctctcccaaataggaaaatagagaaaccactagtcttcctccttccttttatgaccaactgaaacactggtagaaagaaaatgtggaataaaccctaagagtcccacttagaagagcagctgtgatacagctgagctctgccttactgaaacagctgctgtattcaccatgggcaagtaggaatgacaagttgttagtcataagcaatgccatcttgagatggatagtacacttgttggcatggctaagctaaagctgctccgaaacaaagcaaaatcctctggcatgacataagaggtggaagaactcacgcattgtaagtttaaatgtggcttgatttcttctcgcttaagagaatctctgttagcagttggttggttggtttatttatttatttaaacagggtcttgcactgttgtccagactgaagtgcagtggcgagatcatagctcactgcagccttgacctcctgggctcaagtgattctcccacctcagcctcctgagcagtttcaaaaatatataggaagtactttcaaggctctgacttcatgcagtactagagagaataaatacatgggacactgacaacataaaagcaaaattggagtctccataactatgaatttcaaaagtttgtctagttgataataaagtgaaaacataaagttgcctaaaggttggtagctttttatattaactacttaattcctgtaggataaaatggaccagttgctacagatgctgcaaagtacagaccccagtgatgatcagccagacctaccagagctgcttcatcttgaaggtaaaacttttctatttaccttgcaaataaagagtagttagaggttaataactggtgtcctgttaaagaatgggttttgaggataatattaaaaatggaacatttctcacttctccttgacccaggctcactctcatatgcagttgaaaccttgggtagaatttgaattcttataattttctatccaaacgaagtgttctgttcaacattttagaacctggtaaaatgaaaaatggcactttaagattttcagattaatattttagattaagttgtcaccattatactttaagaaaatcaattttgggttctgtagactaaggttaaagaatgtatatttttattactccaaattaaatcttttattccttaaattatacaaatatctatcaaaggttcacatttttttttcttgtactttcttatatttcttcacatcttgtcattttagcaatgtgtcaccagatgggacctctcattgatgaaaagctggaagatattgataggtaaaagaacatgggtgcatttatgttgtgtaccttctttcctgaagctatcactgtactgcaaagtgggctataactgccttttaaaaaaaaaatattgtggaggaaccaactctcattcacatatcttgtgctagatgtggagaattagactcatttgtccttttttttaaagtgaggatttgatcgacctttgcaatatagtcaaaaggaccagcgtagataggtcgttttaaaaacaagggctagctatgtaattctctttgctgaagtggcattaccagagctcacaaatgacccatatgttagtaactagggaaaccaagatatttctggtacagtcaggtacgataagacggagttcccttagcacagcacgtaaaccttaaacagtttgggttgcttcagggctaaaatgcaggatatttttgttataagtgaaatttttaataatgtctactagtactactttttgccatttttgatattttgatgtatcattatttagagcattatatcattttagtaacagctatgcttcaaattattgtgtcatgtttcagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtaagcttttagaagcccatgttgttttaaattctcaaatgcacagtgaggtgtggtagctcatgcctgtaatctcagcaatttgggaggccaaggcaagaggattgcttgagaccaggagtttaagaccagcctgggtaacatagtgagactctgtctctaccaaaaaaaaaaaaaaaaattagccaggctggggcatgttccttggtccctgctctcgaaaagctgaggtgggaggatagcttgagcccagaaggtcgaggctgcagtgagccgtgttcacaccactgcagtctagcctgggcaacagcgacaccctgtctctaaaataaataaataaataaataaattctcaaatgcatttgagattatttggaatagctgtttgaaactttctaaaactaatgtttaaaattaaaataaagtttaacggaatttttttacttggcagttacagcatataatatactaattatgctaatagttttttgttgttgttgttgtttaaaggaaatagcttttatacagggttatgcagcagaatcagccatcacacttttgaaaaaaattacagatatatccatcccactccagacctattgaatcagaatcctcagggttgaggccctttttttttttttttttttttttttttgaggcggagtctcactccgtggcccaggctggagtgcagtgctgcaatctcagctcactgcaagctccgccttccgggttctcgccattctcctgcctcagcctcctgagtagctgggactacaggcgcccgtcaccacgccaggctaatttttttgtatttttagtagagacggggtttcgccgtgttagccaggttggccttgatctcctgacctcgtgatccacccgcctcggcctcccaaagtgctgggattccaggtgtgagccatcgcgcccggccgaggcccatatttttaaagcttcgtatgtaattatttacttaagaaccttagttcttcatcaggttgtgtacactcaatatgtatagccttttgcaggtcagacatatctcaataaagtagtttcgtaaaaaacacaaaatgcttttagagctaagaaaactctcttaaatatctaatgaacttctagttatccttaaaaggaaaacttaaatgcagtgaaaaaaaaatgaggtaaaaacctgtttttattattacaaaccaacaaaatatatttccataatttaaaaactgctttaatctggaattttccctgctttacatgagaatgcatgcaatgcagtgtagagccgtttgctttcttttcaccccaagcaactatttcaaggacccccttttcacaaactcatcacggtgaggtgaggttatagggaataactagccagatactggccgggtgcggtggctcatacctgtaatcccagcacgttgggaggccgaggcgggtggatcacgaggtcaggagatggagaccatcctggctaacatggtgaaaccctgtctctgctcaaaatacaaaaaatttagcctggcgtggtggtgggtgcctatagtcccagctacttgggagcctgaggcaggagaatggcatgaacccgggaggcggaggttgcagtgagccgagatcgtgccattgcactccagcctgggcgacagagcaagactccacctcaaaaaataataataataataataataaataaaaacaaaactagccagatactccattttttccatgtaaagtgggcacggactgtgttcagattaacgtttagcagaatgaggggccagcaccctgtagatgaacagctaggcccaagaaacttggggctagagggcacctgctttagagtcttgatcaccagtttgagacaaggaagcaaaaaaccttcatgttcaattttcgaagaatgacaaaataaagttaggaggactggtatagctgtgtttataatgaagaccctttggatccctgtgtgggtctgtcgtttaacagaagtgctaaatggaaggatctaatgaatactgcagaaaattaggacattatgtgttttagactttgggtagttaagacttcaatctctttagattaaaaaaatgcattttgaaatacagaagtagacaaatccagcctgttgcctgttttttttttttttaataaacttttttttgagacggagtcttgctttgtcgcccaggctggagtgcagtggcgcgatctcagctcgctgccagctccgcctcctgggttcaggccattctcctgcctcagcctcccgagtagctgggactgcaggcgcccgccaccacgcctggctaattttttgtatttttagtagagacggggtttcactgtgttagccaggatggtctcgatctcctgacctcgtgatctgcctgcctcggcctcccaaagtgctgggattacaggcatgagccaccatgcctggcggctttaaataaacttttatcagaacacagccactctgatttactgacagagccgagtagttgtgtcagagactacatggtccacaaaacttaaaatatttacgtcaggccctttacaaaaaagtttgctgacccctgctttagaaagttagcttgctctattgttcaataaactgcagtttaggaaatgtgacttgtatccattgcagtctatggctacaaaacaatgagttcaaatacactttctaaatatcctttgggattccttaaaaaataccaacatgcagaatattaaaatatatttaatgtaaagggagattagtataaagtttcaggataagtttctttaatgcttcagtatggagataacatgagtttagcatatgtttaactaaaaatgaaaaccatcaacagcctatttcattgaaaagcgtttttcaaaatgcccgttgacagaaataactttgaaaaaaggattccagagtggtgatttttcttgtttttgtaactgaatacctctacagagaaagttcagtatgcttattaaaattttagaattgaatatgatttctctttaaccatcgcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaagtaattttactgttgattcttgtttggagttagtgctgttacagctgtttaagtgcccccagttatctataactataaaatctggctaataaatatctgtggtcagcgtcatgcggccgccccatttgtgctaatgagtggtggagcctctgtggtattccagtaccagccagcaagctggtcctctgctcccgactcgctcaactcatgtaatctggtttcagccttatatttttaatactactctaaccataagtttttattgttgtttttatttgcatctatgatatttgataatgtctttaatgaaatttatgtttagtgactataatttgtcatttttccacacattttgtataaaatctaaattccgttattttaaaatatatagttctgagctgtctctttaagacaaatattttcttatttttgccctgttttggaatttagtttatattatatcaaggtaccccatttgaaacaagaagataataagaaggtaagcacccttgtttctcaggaggcagatggctgaatatgtgatgacagaggcccatttactttgccatttacttacagtgctgtctgtcatgtagttaaatgattattgtgtgttttttctgctttaatgggactctgagctgaaatcttttccttgaagcaaataaaggataggcttttaagagtttaccaacgtgtattctagaagttacgacattctagctggcaacagaagtttctaggtagcacaggcacaacttctagaaacctttccagcagtgttaggattgcccaggaatgctcctgcactgccctctcttgcactactcatcctcaaagagttacatgttagagatgcttggggattttcaagcattattcggttgtcagatctagtatcccgaagtgaccttaagggggatgatggcaaggcccacatgtcagaaaacagggcattccctagtgggttctgtatcttagaaaaaagtgttaagtgtagcttgcactcttgcaggatttttttttaagttgaaatctggtggaaatgaatacccttctggaaaataaacagctgttcttagagtagcatgttgctttacaactagatacaaaggggctagaaggtaggaattgttgagaagacactagggttcctgacttaataggaccctgcagctattttagtattagccggaactgccacttttcccctgctagtcctctgtttgactatgtcacatgctgctctaccttccttgttactagagattacttgagactcattcttcaaggtcggggccttgggaaattatccttgtgaatgagataacctgttggtaggtgctttaacagtgaagttctgtagcgctgtggtaccctgctgctgttctctgtgtgtgactctgcttctgcattcgggatgtgaaatccctggcataggcccaaccctacccatagagtgtagctattaatgtcacctctcaaggaacacatgtttatttcaacaggtgtcttttgaagaacattttcttgaaatatttagccctctcgtcctggctcattcctgcatattctttagttgttagcttagctgcatttttactgggacatcttccttgcttttccacctctcagcactgttcctcctgtgtgctgtcagaggactgtgtgtgtacttccgtttcctggctggtagttgcctttttacttgtttgtatccccactgaagacagtatcttgagagctggcactgtctttcacctctatagccatcctatgtagcacacagttttacactggctaggaactcagtaaatattttatgaatacatgttttagtgttaatgacaatttcaagtgctatattagaccagttaggtgtattttttaaaaattccttgcaaaggcttcacaaaggcttagaggccatttaaatatctatatataaaggtacaatatgtaatatctgtttatcaatatataaaaacagatgtgtgtttgtgtgtttcaacggggaaatgaggaattgctggtagagcaaatgtaggatgaggaaattggaaggagcgagggccagggttagaaatttccttactagaggtgtcctgcgtatttgactcgagctttctagcggcaaatcaaggtcagtgaggattgttgttgtttttggtaggcaggttttttagcactcctcagtttatatatatctgagaggctatctcttgttacataaaattttggtgttaaagctcactgtttttcagacttctgtcatcctaggacagtcttattgttagttggggaaggtgtcactgatgacggttttctaaagctacctgtagcgatggtagtattataaggtgataataagtgacaattactgttagtattttgagaccactgaagcttatgtatttatttgtctctgattttagtttactacagtcagcatgtgccaggcactgtgttagacacctgagagtcttctttagcttcaaggtgcttactgagtagtaggggcaaacacataaaaaaatataattttatacaacatgatttataaataaagaagatatatgccttgtaccttaggagcctcagggtttgaggaagttttccaagagggttattcttagccagtagaaaaaaagtgaggaagatgttctgtcacgtcagagatgtggtagcctggaatggcatggtacccatggagtgagcaaagatgggaggtgtgaaaggcgtggtatgtatcggcattccagcagcacacttaccaagggttgaaagcgtgtaggggagcagcgagagacatacttgaagacactgccaaggtcgaagaatgcttgttctagataccatcttagggataatgaaaaagttcagaaagggctttaaatggcagtagcgtagatggattcataggggcaagattagaagctgggagaccatggatattaggcaagaaattatgagtatttgttggcaagatacagtgctattaattggaaagagttatttaggagattagcaaataattacacattgggtgacatggttgggagacagctcagtgcagagataagagaaagaagtattggtgaattgcatggttttgccccaggcaactgggtggacggtggaactgtaaattgagaatgattacaataatgctaacatttaaggggtatttagtatgttccaagcactgtgctgtatgctttacacaaagtaacttattcctcataataacctgtgaagtcggtaaactattacccccattttatagatggggaagctgagacctggagacaaaacggaagtcccacttagctaagattctaaaccagacattctgactccagaacccagcgcatagactctatattacggcaatattatagcccataccattgtcaataatagtatgaaatttgacatctcctaatcaactttatatctcacacatatggagtgatgacaaataatgccttaggtcaccacattagttggagaaatgtagcattaaattaccgtctcttataataaattaccatcaaataatgaatttgtgccaagtacaagagcactgaatttcccaacaatagatttataaataacaattggaggaaagtttagaagtaggcagtattttgaaaatttggcagttgctttttatattgcttgttttacatttttaatacaaatgtagggggaattctcagcatcttagtacttctcttcacatagctaacctagtgtcttacagtggaaacgcatgtattccgttggaaacaggaagacaggaagtagaggcagtggataaagacaaccctttgaagaatttttttctttctttttttaatgggagcagtgcacaagtgcagggacttgagatgggagtactggcagcggagcggtgggagcggtagggaagctcagtacgtgaggggtgcagctgcagagagttgatcagtgtggtgttggagcgtgtgcttccgtattttcaaggaaataaaagaaatgaggttatgaggccttcccttccactagtcctttgggaccgttcttgtcaagaaccctggtgatgcccatactgctagactcccggtcagttcaccattctcctcctcctccatttgacagttcgtgattccctcctcttttctgaaatgctttcttcacttgctggtgaccattctcttttcccttctgcctcaccgccacttcttctcagcctcatttgcctcttgcctctttatcttctggacttcaaggtccagtgcacagtagatggactgcctttttctctgtttgcagccgctccccaggggacctcatgaagcccggtgattctgaatgccgtggatctgccgaggattcccagatgcgtatttctcctccgtacttccccacaggacagcaggcttgaatagctgattgcctatgcaggacaacaggcttgaatagctgactgcctatgcattctctttgcttgccagttttttggacatcaaacttgacagatccaagattattactttgatcttccccacacccctcccacccccgagtctactatggtcccatcatagtattctgaaaatcagtgaatggccactctaccagttatttctaccagtttttaggttctaaacctcaggcattctggactcttctgttcattatcatattttgaaggcattatcttcaaaatctatctagactctgaccctttctcccatctccaccattactgccgtggctcttctgctggtcggctctctcctggtggatcgtaataacctgcagtcagctatcctggtccagagggagcccgttaaaccctgtggaatcttatcacgcttctgctcagaacgagccagtgtctttctgtctcactcagagtgtaagctacagtccttattgtggccatcaggtgctgtgtgttctccagccccctccccaccaccgcagtcctgccggtgatcttagctgctctcccctcggcaccccctgcggccccctctgccgcagcactcgtggcctgctgttccttgaacatgcttggtgttttctctcctcaaaggcttctttctgtttacctgaaatgtactttcctagggaatctatctggctcactcgcttactttttccacatctttgcttaagtattgccttattggagaggcaccctaccataaactagaatcccttgccccagctgctctttgtcctccgtattgggctttgtttttgttcttaccagttagaaccacttgacacacgatacatgtgtttgttacccttttctaccactagaacagacgctccatggtggtatagacttatttccgcaaaccaccccccccaactttttttacacaatggttaaataacacacatatttttaatgcaatgcctgatatcacaaagcctaaaataacaatgtttggcacattatagctgtttagtaaaaggttattaaatgaattgactatatgaatgaatgcttagtaaatagcttttccatttatctgtagttgctctataaatcagtattgatgtaattgagtgtttttcttcctccacagtacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagtaatctacattcctggctttgcttaacgtttatataggtattgttttctttcacactggatttttgggttgctctttctggccttttaaaattctaatggaattattttggcttcttacttgggaatattttcaaatgaatgcttttcttttaattcatgcgaaaaatgttttccactgacattgtaatcttaaatatttacgatttccctggttgggctatactattattttagcactatttaaacaacggaaaagttgagtcgaacatcatatttaatgaattgatgtaacaggtttcatactataaatgaaaatttcatttttattttctaagactgttgtaatcaggtagcttgtttattttctttttgagagaagattaaatctttagccagtaatcttaaggtgtacgatattgaaagtcaggcatggtggctcacccctataatcccagcacgttgggaagccaaggcagaaaaatcacttgagctccggaaggcaagaccagcaaaacccccgtctctaacaaaaataccaaaaatcagcctgacgctatgggacaagccctgtggtctcaacctgccttggaagccgaaagccggaggaacatttgacccggggaggttaaatgtgcccgggagacaaacccaaaccccctggcgctccaaacttgggtgaaaaaaatgaaaatctccttttaagaaaaaaaaaaaaaaaaaaatcctcttaaaaagcctcgggagaggttttgacccgctcctccccttgtttccaagcttaaaaattttttatgccccaacgtccgcggaaaaacacacagtgcgaatattgacgggccctaattttctccttttcaaagaaatagagaaatttgtctccaacaacgacttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13301 - DNA, 23929 bp, Human
gattgcctatcctcgccaccagctgaaggcaaggccgttctgctacgagcgcctcttaatctctacaaaatgaaaagaaaaaaagagaggattattagcccattactcagaggaatggggaggctgcaaaaatcgtcgatgggcagaggtgaagatgtctttctcggactgcactttccggtgtcctgtaactagagttcagttgtgggacttgttgaagaaatttgattttcttgcctcggcgagatttcaaaaaccagaaatagaaattctcagagtcagagaggaaatacaattaaacagcacgtgggcattttccccctcatttctctccccttaaataacactgctttgagtttccactgggtaaagagagaaagtttgagttttcacggatgttacgtggaggttagaaatggcttaaaatgtagatctctaatcagttttcttcgtggctgaagaggctaaccctttccataaaatgagtccatctgtcgactgttagctatttcaaagtgaagggatttagcactcaaaacaaattgagcaagtttgtttgcctgtttttactgctaactcaaatgaattcaaaacacggagtaattcaagaaaacacataacatgttccagacagcccccaaaagtagggaaagcccagcacctatatagtgactagggttagttttaagcgccaagcttttttaaacgtatctattttatgcacattctcccgagtcactatatatttctaaaattgcgagtattggtatattgatttaggaagagcaatacaacttttagagggaactttattctcaattagggaccaaagagatgtctttttaatagcgggcctgagttttgctctcaagcaggaattaatattggtgggaaaatccgaatccaggagcaatggctgtgttccggcactttccaaaaacatacattaacaggatgcccttgagattgaaaaaacattgtcccatatgcctggcagaagccttcacacctggtcctccaggcgaattatatttatagtccttccactcagaggcaggacagagccaaaatattctgctcactaccaaaatacacatctttgctcaagtcaagaaatcagaaaatcagggttcagaagtaaggcacacttttcgagtgagaatatgccctgtaatttcacatactctttgctttgcaggagcaaatgtggacttgagggaaactctctcccccacccccacttctatcccgtgcaatttaataccatcctcgccaggaaccttaacctcgtcattttaaaaaatgagatatccgtgacccagggtgaacttgttgaatgtaggtacagcagaggaaattctagactctatgagcgtctgagccttgtccagtgcaaacccttcgtgaacactgggtcagtgcgtggccgtgcccacctgtgcgccgacactctcagcatgcctggtccacccgccttgacctcgggcgcggtgtcccagctaagctgggcccagcgtcccggccttccccagctgacaagcctagctcgttcgctcccggctgtggccctcccaccctctcccactagctcactccattcttctagatttctcttcactcatcctctcccatccccaccgcgcccacctccactcccgccctctaccggtctctcactttcctccctccgcagtccctctttgctgtgacctctttcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggccggctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccggtaagtggaggccatctatcccgcagggatgtgagataatgcgagtctggaaatttgttccacttcggagaatcttcaccgtaggtgatttgtggcttttggggctaagtttcgcccaaggtaacgcagtcggcaaacagaccttgcaaagccctgttcctttcgtcccccgccacagacactaacaatctacagggtgctgaagtcgagagggaagccagaccgtggctggcatttaaaacgaggtatcttcccttaaatctcggtgccaacactgcaggaacaaatcctcgggccaaggattagcattctcaagataaagggctgggtacaaagtttcagctactggaagattagcccccttcccattgttatccattgggaaaaaaaagaaaagaaaaagattccatcttaactggcagttagtgacctctcaggcccaagcgaattacctgggagccaggcctggatgccaagctctcaccatttctttggattgtaactcctttaaattgatcaccagtcaactccaatctggcacttcaggagatacactttaaatggatgcagagaattattttccagctggagattaagaaaaaaattttcgattctaaacctccgaaatatgttcctcttttccagtttaaccactttactttcttaagcaatttagaaatcaaactatcataaggtggtgtgatttttttttactcttttgtgtgagtattgtcttactaaactaaacggaaaaaacttttaccattataaatgtaaatatcagaattcatacattctaaaatatttttatgaaaaattaatctgatttaaagaaatttccttgcatttgttttagtctatcaatcaaaactaaagatgcttttatcacacaaaatatcattttggcagaaatccacctaaaattcaaataccaataatatcaagaaaacaaagcacataagcaaaataaattgaagatttttgttgatgtaacatgagcatacaacatttcaataaccaaactttccctaaaaaattaaatagccacttcatttgtggaatgttttactttaactcagcaaaattacacttaaattatttaggtgctttgttccttaagttaagcgtgtttgtcttcaaatgttcctaaagcacttatattaattggttgtaaagaacgcatacacatggtaaaatacagaactgaactgagcagtattttaatttccttaaataattacttactacaaattaatttactggctaatttcacaatttagttcatttaaaacacatgttcctgtgctgtttatttttaaactttccattaaagattttgttatggggtaacaaagtgtatgaaaaggggggaaatgtgaaaggatctgggattattcgaactgtatttttcctgcactttcagtcttgcggtagtcatcagaaattattttttagcaaattgttttatttcttagggcttgcctgcctgctttgccatggttcctcgtcctccattagccgtgtagtgctttttgtgtgctcacaatataaaacccaagttggccaaaacaagagtccttggcatatacattccaactagaacatgaactttgggggtgagaactacctcccatcaggaaaagtctcccatctcaatttgtgagattagccattgaagccagttccgaagtctggcagccaaatttctcacagaagacttgtcttgatagggcaagtttaaggatcagcaggcgggaattggaggtctctttttaaaaaattatcttccccagttatttagactcagttcttctagtaggcctggtcattaaatgaagcataaaaatgcaagtctcaaggctcattttgactgcaaaataaatctccaagtcacaaggacatgtaggagtgagctaaggaacacgccttgaccttcttttcagtccttagagtggagctctatgagttcttgaagatttgttttgtattgctttgtttggtcttcagcactgaagcacggggaagtggggggaagaatgtgtaataattgactgactttacaccaagcaacgcaatctttttcttttgtatatttcattctttaaaaaaaataaataaataaaaactatttgcagttaccatctgcagtgctccggctaccagctaataatgcagccagttcagacatataaaaaaaaaagattatcgaaatgatgatgacatgcaaatttcctccgaaattatcataagtaaacatttgaagtctggactaataaaatcccatctgtgttacttcatatcgagttagtagaaagctgtgataatgaattttgtaatatctcacgaacagacatctcaatcagggactaatcctgtgattttactgcagaatcactaaatctggagccgccaaactgctacttctgggcccacgggcccacaaggatcgaatcggcagagtccccgcccgcgttctcgctagcgggtgggggaaccgcctggccgtccccaccctggatccccacgccacagcgccgggcagcccctcctgtaggcagcgaccttggccagaggctccccagggcccagctcccttcaggagaggccgagacgcagggaaacggtactcaggccagaggcaggcccgcagctccctgccccgcctctgtgcctccgccaacccgacaacgcttgctcccaccccgatccccgcacccgcgcgaagtgggccctccggtcgtcggcgtaccctggttagcgtggagagaggcaggcgctgagatcgaaggggcctagggagccctggaccttcttttcttgtctttaaagcaaccgcggctcttctacccacccggtggagcccctcgagacccacctctcccggcttgcctgtggcagagaagggggagcgcgttaaatgcttggctcgctgcgttgcggttgaaaacgtgaaaaagatttggctcgcccgggagagaaagggggagaactgggtagcagttataccagagctatttctccgtccttggcgggcagtaaaccctccaagaacgtttgccctgctctcctcagtctcgctcagtccacccagtgtctctcctctgcgatcttaaatcatactttagggtaattatttgtagtaagtaaataaatggccgggttagtatctctaggagaaagtgtggctaaatatggaaaagtggctcctgatggatgagaggcccgaagtcagctcgctcctgaaacaccctaggccaagagcccgttcgtttcagaattacagaaaaccgagggaaactgctgtctaggacaggggcacgttggcgctgatgttctacaaatgtttaccgagctccaactaatggacaagcactgaagggtggtctttgcatacagcttcccaaagagaaaagtcctctccacccacccactcccgctgccattgcgttcagatgagttcttaaccccggcaccgagattcttgaaagtaggtccacagcctccccagcacactgtggctttatagtcctctaacctctgggcacttttgcggcaactctggagggagatcccctcttgataaataaatgtcctgggcccgaggctaggctggagatgctgctgcacagccagaggctgtcaggtcggaaaaacacgcctgaagcctagcacacagtaggcgcctaacagctagtgtaacgtagtctcatctgagccctgctcactcgacggccgccgcttcttacagccttccttctcttctgttttgcagataacggggaatggagaccaactgccgcaaactggtgtcggcgtgtgtgcaattaggtaagaacccccttctcctgcccgggtcatcggacgggaggccgcgccacgtgagggcggcaagagggcactggccctgcggcgaggccccagcgaggggcgcttccccgaggggccagcctgggcaggaaggaaatcagaaccaaatcgccagtggcctctccctgtggcggggcggtggactaggaagcagcggcgcgctgtgtaccgaagccccccagcctactcctcccggctggaaccgccggcaaccggggaggcgcagaaagagtacgccatcctgccccgggttgccagagggtccgggggacggggatgccgtcagctctttcctctaactgggtctttgctctttgtccctctttctcctccggcctgcctcgcccctccccctcctcccgtccccggctcctttcggccgcggtccgggacgcctctctccgcacgtggggcgggcgcgcgcgtggcccaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatggtaaggccgggagggaagcgcaggccgcgcgctgggcacccgcctccgggactctgggcctcgggcgaagcgcaagaaggcgaggccgccagacctgacgcgcctgctgcttgaacttagacactccgcctctgggtgggacgggaagcagccgtcccagggacgttaattcctttccccaaattatactgcactcctgagacccaacacctctctctccctctcgctcgctccctgtggtctgatcccctgcgcacgctccagcaaacctcggcgtctaggctggcgtggaaaagtggtccaacagcgacctctgtcgctcgttatatcccgctgcgcgcagcaccaccagggcccactcagtccctcaggctctcagccacgccccacccagacttgtgggtgcgcggttcatcgcgggaggcaagcaagggaaacttgagttggcgaaggtttgctttggctggttgggggaggggcggggggccgacaacatccctgaagagctggagggcagccactgtgcttagcagcccagggtagaatggaggtttgcccctgtcgacgcgaacctgcctgaagtactggttgccaggccttgggttttggcgatgtcgttgcttgattggctggtttcactctggaggaatcgagggacattgccagaggaggtctacaggcttatgtaaaaagttaaaaagtctccaacctacgccacaggcctttcctgaattgaagcttgttctatggggcggaggggggggtgtaagggatggaggagggaagatgcctttcttttcaaatacatggaaaaaaacccctcagatttactgttcctctattttcctggctccgtagtaaataagtgcctagccttaggaggctattgacctttgataatgtgagcagataaagccccccccccccacagccctcggcccctaaccccctctttccggattaaagtgtaagaatacaaatgtaatatgggatggaggggggcgatttgggaccccggtcaaaaaaacaaaccgtattactaagaagaaaacaaaggtcttgcattggagtttccccgtgaatctgagagaaaatgatcgtttgttgaaatgaagcgtctaaagcgatccagtgcttcacgcccggacactgcactacaccgccagtcgccctgctgggccagttaaacgctcacttgtccgggattaaccccatggggttaaatgggggcaatgcagagataacgtcgcgtgatttctgtcatttagattgtgttaaattcttcttctgtttgataatcggtagtaaaaataaattattagaccgtagtatgtttgggatatggttaaaaatcaagagcagcgatgacttctggggagaatgctttgcgcgggctcagcctggctccggccagactagaggagctccccaatctcgcttcgcgcgggcggcggctcgcagtcgccaagccgaggctgacatttcttattgtgctgggagccagagagacgcaaaatgtctccttcccccagtccctaccccaggtttcctagacatggggaatgcattctgaggacaggtggagaagcctacggtaggatggggtcctcgtaggtgagcaggaaacggctaagagcagaggagttctgcttgcgccagtcacaagccgcgcaggcgcccctggtcgttcgcttttgataactagcacataaagaactagaaataatgaatgattgctttcttaaccattactttcaggcccgcattgttttagtgcacgtgaaaggctcttcccctacactcaatatgtctttttctactttttgaccgaaaagaaaaattgctgcctaaacacgtttaatgccattaattaagaaaaggcatgtaatgggaagaaatgctgaaaatcttgatttaattggcttttaaggaactagtagacgacaaaaaaaaaatcacacgagtgggcaaagctatagcactgctgaaggatagagcacctatccttccctgattttaagttaacttatggaatatccaaagtcctggccacagcctgcttgtaaaacaaaaggatttatttcttgtgtttttttaaagtttttctttgcttttaaagagaaaaaaagttcacaatgacatatgacttcttcaaaaggccgtgatagtctattacgctaccctctccgcctctgcccccaacgccgcccaaaaataccatgtcctcgttaaagactaaacgttctgtataggcagagtccacctctaagcagtccaggctctgccttccttccctagtgagtcccattctccttggtatccattgggcggatgcccagcctggatagaaccccgaaacgggggtagcacgagagcgactggagacccctaaaagccagaggtttgagagagggtggacgcagctagcagaagatggtgtagaagccagctgagaacgaccccctagagcaaagagacctttctttggcttttcttgctttgggggtcctgaaaggaactcataaaatggtcttcaccctcaggaggaggacggactgaccctcctctgtcactggcttaaaaagtttcagggcggcggctctgggttccgtgctgaaatcggactgcactgcagcccctttggacctgacgcctggctttgcgtcccgacaaggggcgggtacttcccccggcctcccccaggaacgcattaattgttaaatagctttggcccagtggatgggctgaaagtgttcgacccaagtcgctggtgtgcaaagacttcctccctctgggaggtgggctccatggcccgttgtggcacccccagccgcgacacacaccttcacacgcggcagcagctcggtcccaaccttcttcgaaggacctgggttaaccctggcggccttggcggccgcagacccctctccgccgccccgcccccgcgcctctcattcaatcagcgaatgtttgcggagcatatactacgtggactcctaatgtaccccctgaaagcaaataatacagttttcctcgccgtcatgaagggattttaatcctaacatggacaccagcgagatcagcccagaccgtctctagcaaaacgcaaaatggtggtgcgtggggtggtgaccaaggtcctgagccttgtcagaaagaaggggatgtgtagagaaaggtggagaactctagctgtggctagcgcggaagggacaggtgcttgccgaagggggcatgaggcttgaggaaaaagcaacgaaataggggtaaggagagttttccattttctttcctccgcccgacctccgccatcccattctcccctcccctcccccaccccccgcgccaatcaaatctgcagctcacttgaaaggtgccccgccgcgttgtggtttttcacccccaggggaaattgtaccagttgtccgaaagtagtcagtccctgcggatccctgcccgcaaaagtggtcttcacaggtcgcgttcctcgctgctgactcggtacacaaagtttcttaaggctggttcggctgttattcctcaccgcccgctgctaatatatgcagcagttgttagagcggctcgggggaaaaggaaatgtataacgaaagcttattcgtgagcaggaatatactaatggaacaatctgatgtcttcttaatcctatgtaaaaagctttgtcgtcttcctaatattgactgaatgggtaattaatggctcttcatctaggcgaataccctgtaatccaagataggcaaaagacaacaagcccaaggtagaagacaaaaggcccaactgcagcggcgtttgcccgcctcctaccccccagggtctctgactaggaaagttttctctcagaggagaaaaaggcaggagtgggagaatatatacctatcatttcggggctagacttcaccgcagcacctgaccacccagctcagttttctgttactctgtctttccacctccagtccttctccctgcatttttttttcttcttaactcctctaggatgacctcctaccaccaccgccattatggtcctaataacctttccccctaaaccccacatctttcacttcagcaaccaatgaggctgttttctgatccaggaggagattcttttcttttagaacccaatgcgtagagtctttgagaactaaagtagttggtaggggaggaagaaattaatagaaagggagagagcatacagaattgtgtgtgtatgttaaagagcgaccaggaatgacagagtcaacttctttgtgaggatctgacgggaagagtgtccaagactctaccagcatgtttttaacaggctgacattttaatttaaacctttagaagtaatatattacttgggttactacaatgaggtgggttcctttttttttgtcagctgacagcttttaaaatattatttcgctagggaaataaaagcttcatctcagattataggtgggtatttttggatttaggtgatttatggtcaccatgacaactaatgctgaatgttagctaccagcatgtctgggagagagaaaacagaaagaagggagagcaaaagaaatagaaaagggagatggacataagctggagagggaagaaaagagaaaaagaggaagacagatgagtgtttaatccaactgttgtttaaaaaagtggcgggggggtgggacttcatttagccccttgccacttccttctttcctgacctggatatctatgctcaatttcatattccacccttccttccccttctccaaacacatgtgctataccattctccttattttacttagttcggcaagtagttgctttctggagactcagtgacacctaggaaaactgtggcagtaacatgcaaatgtgaggaagcattaacagcatgttcgttgagtgattttagcaaatgccccctcctctaatctctttctcttctcttccccaggccactgtgaggtggtaactcccactgccatctgaacactgttcccccaggtagttaccccaaatctcaaatggttgagcagctagagctgtgggttggaaaaatgggtaccatttgcagggacccagagagggtggctgttgctcaatatatctacagacttccaattcagaaaataatcttccccttttgacaagccagagctttttaaattccatttaggaaatggggaaaaggacagctacagtgaagcttttaatttctgggttatttggttccatagctatgaggggtggtgggtagtggactgttttcagcttggtttgtatgcagagaaaagccagatattggagggggtggggcacttctcgggcaggatgcaaggtctccatctgacctctgcgccttaccaggagctcacacactcacgcccatcacgtggctccaagctgagtccaggcgggcctcgtccttgagctagcttgggcagggcaggactcccacccgtctaaggcctaacagctcagggagatgtctaattaagccatcttctgggtgaactctgaagacagactctttccaaaagtcagagatcacttggttgagtcccaggccagattgatacggagagtttggcggcacagcccaaccgctcactgccatggccagagggactttgcacaactaacactgaagagtgtgaaattaaataagactttaagactggtaatcggtggcaaataccagcacaaaacacggctgaccccatgtcacacatttccctcctctagggtctttctttgaaagaataagcaagaaaccccaatcgagacaacccctgatgtctcccagactcaaaacctcacgccggcactgggctttccttctttgccccacgtgagccatgcagcacctctagtttccctaccaggatcccaccaatgttctccgtattggaaatttctgtgttagaggctgaactcatagtaatttctaaaaccaattaagaagaacttagccagaggtcacagtaatgctggaatcacaaaatgcataagatttattttcttctggcccctttctcatccatgctgcctatgcctgtgcacccacaagtcttatgtacattaaatctccaaaatcaaccaccaccatgccacagagttttcactggacagtgtttcttagttcccaccacatacctccttttccccatgcagacttatcatgttggtgtcctgccacacagggggcctgagaagaatgtcacccaatcgccgctgctgtgagtgtgtaaagtgattaggagattaggagaatgttgaaactcctgctggaaaaatgcaaagaaaatcctcactttgagtcagttgtttacagagccagtgtgtgtgtgcgtgtgtgtgtctgtaatataaaatggatgtgaatatatatatacaaatagatatggttttgcttttactttaatctgaattatctagataattgtctttattcaccacttgacttcaatgggtccacacaaattaggacaccttatctttttaggcatctaggctgctgctgatccccagtgcttccaacatctcgcacacgttggcactatgaggagcagtcacgtgcccttgggtttttcaaccactttggaggctgattgaggtccttcatacatgtatatttgtcgtgatgaaagttccatcggtagagtggagccaccagagcttttatcaaaattctgtgggtttatgagagatgggtttagaaatctatatggctctgtggggcttctcggctttctaaaataaggcattaacacccaagcttccaaaaatatttgcagctctggggtttgaatcttgaaaaacaaggagtgaggggctgtgtatactaactacagtggagatttttttcattctttaatgtgatggagtcccttcatgaaatgaagctttaaggggcatggtattgtggggaccacagctattctgaggtttaaaagaagaaactggaatatgattagtaaacacattcagcagaaaagagctggattcttattgacttagttataggtcatcggctggcagtgcaatgggaggaaatatttactttacacatatactttatgatcttgggggaattagaggaaattcaataagaaaacggctagaaacatttaaaacccttatttaaaagacttaagcaaattagagtcttatcagattaaaaaccactacaaatgtaagagcattgtcttcagtgaaacgctgtggggtctgagaaggagattctccgccaaatctccgggataaaatgcgtcatttaagcaccagataatgagcagaatgtaaattaatttaaccttctttaccaacaggctgctagtgtaatgtgtataatttagtgataagattgcaggacctaatatagctggatgtatgagcctcagctaatgcagacctgtcacatgaggatgtgttttactctgagcaggtgtctgtatgtgtggaatggggtaaagtggaataaaaggttaaaagcagaaatgctgatttaaagcttactatgaagaaattcctcccttgcagctaaattattcttaaagtgggatgatactggtgaagaaagactgaaaaacaattctcatgtgcgtctttggactgcaagtttaaaatggggaggagttgcagatagggtttgggggtggtcagggcaaaggagagacacataagttgcaaatatatttgtagtctgcttcatccactttgttccacatcgaataagtttcccaatcttgtgaacaaggacaaggagggagtgttttaaagatacttcatgctggcattgcaaatcattgactgtaatgtcaaacaaatacacattcagagatgataacactaactccatagtaaaacaatcgcccatgcagaaacccagaggagattagtttgtcctctccagctgacctatgctgggggacaaaaggactttcaaaaattattttgaatatgtttggatttctttctttaatttctttggaaattaaatttgcttggaaacagtgctataaagagttgatgtctccaaaggtgattttttttgttttatataaataaggttttgcttttgctagttgagcgcagttctaggcttttcgcccttagctcacacacaccccttctgcctgcttggactttaatggctcaagacagccttgagctcaccgggaaaagaaaatgactgttaaaaattatccttgaaattggttatttggcaacattcttaattgtatggaaattcattaaggcatatttcatatataattagctcaaggttgttgattctacaggctttatggatttaaatctgattgataataaagtaaacaagagagtcgaatttaaagcgtggctctctcgggttaggacgagcttaatacagtgtacaaggaatttgaaagatctaggatatgtgtcttaatcaacgttaagtagaatggataagctttcagcattttgaaaacgctgggttagggtttctcttctattgtgtgttttctgtctggggactaataagcatcacagagaacgtgatctgaggcgactttttattcttgtataaatccagagtgaaccaccaaacagttgttcgtttaaagtcaaggtaattttcttttgacgggtccatttgcttctcgatttctaatttattagcctgccttttcagggctctgtcttctttgcaattaaagcttcttcagattagcgcagcattcacttgacaggctgtttggaaaatttaagatcggagaggtgatttgttgctgtttttcaaattttctagttttaagtaacgtgtctcctttttatatggggtgggggattggaaatggatgtagtgagacacaaagagtgggtgtcttgttgatccttgtacctttctcttcttgaccattccactctcttctcccaagccttcgactcctagcctcatctcttcacctttgggttcgtactaaaagccggatcgccttgggctgggcaggagctgaattcccgggagcttgcctgtgtagacccagtgcgcacggcgaggcagtagcccggccccgcactgctgataggtgcaggcaggacagtccctccaccgcggctcggggcgtcctgattggtgcggagccacgtcagtcgcacccggagaagggtctgggaggaggcggaggcggagagggctggggagggccgcggcggagtgacgtctcggcaccaggaagcccgcctctggttttaagatgttaggccaacagggaagcgcggagccgcagatctggtccgtcgctcgcctgggtgcctggagctgagctgcggcaaggcccggctcctgttcgaccgcccgaggggtgtgcgtgtgcgcgttgcggagggtgcgctcagagggccgcgtcgtggctgcagcggctgctgccgccgcaggggatctaatatcacctacctgtccctgtcactcttgacacttctctgtcagggctgccgcgtgggggggggcgggcagagcgcggtcggcgttagctttccttattggaggggttcttgggggagggagggagagaagaagggggtctttgcccactcttgtttcgctttggagcttggaagcctgctccctaaagacgctctgagtggtgcccttctgcccacatcccatgtcttcgtttgcccgctgactttccgtctccggactttttcgcttgagccttccggaggagacgggggcagcttggcttgagaactcggcgggggttgcgtcccctggctctccccgcagcggggaaactccgcgcctagagcgcgacccggagcgggcagcggcggctacgggggctcggcggggcagtagccaaggactagtagagcgtcgcgctccctcgtccatgaactgcatgaaaggcccgcttcacttggagcaccgagcagcggggaccaagctgtcggccgtctcctcatcttcctgtcaccatccccagccgttagccatggcttcggttctggctcccggtcagccccggtcgctggactcctccaagcacaggctggaggtgcacaccatctccgacacctccagcccggaggccgcaggtaaggcgccgcgccgccctgcagacattcccgctcagctgctctgcgccacccgctccctctcgccccaaggaagtcagcccctccggggggaggcgtggtgggagtggtcgttcgcctggctccccgcagaacttccgggagccggaattttgactaccccgcatccctttagttctccctcgaccggcccggctcctggggcgctaagggcgcgagcaattctgccgccctctctattcgtaccctggcctcccttctgtttcctgggtcacaaaaatcccagcatcttgattcgaggaccttcagaggccgccgacctctgtccctgttttcctctcggctttcagctcccgaggagctccactcgttaggaaattgcctgaaaccactcagaaatgcccttcgcgaagaggcatttttttttttttttgggaaagggccggcgaacttcggtgcccaaccgaatccccacatcttttcctagccttcccaaaccgcatggaaatctgagctttctgcgagggggaggggggtctgtaaaccacgcgcgtgtgcgcgtcccaggagatttggtgtgtctgcgcagaggtgtataaatatacttgaaagcacaggctataaaagtgaatgtgccgctgcagtgagataaacatgtaaataaaacgtgcggcgctgggggaggggaggaaatggggcgcggacacccacacttgcgcctgcacaccccacaggcgcagcgctcctcgcggcccggagccgccgcgcgcaccctcctccggcgccaggcagcccagctcttccacggcttctgccgccggtccagttggcgtccgcgttgcaggtgggcatgctgacgggaaagtgtgtgtgtttcgttttcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtaggagccagcacggagtctgggagggatggggggaggatgttgtggaggtacaggccaagtagaccaggagagaatgtggaaggcagcgccgcctgggagggcgccggtggggcgcagctttgcaaaggcagaaggcctcgcggcggcctggttgcgagattacagttccctctccgaggccgacaggactgccgccctggctcaggctcccagagcggcaccggctcactgccccgccatcccgcgatctcacgagctgggctgcatgggcaatcccctgcacaggacattgtgttcctggcttgcagttgccagagcagagctaataaaatccctaccaggccaagagccgcgaacaggctccaacctgtgagcctttaacaaggaaaacccgccagagacacggaagagttggccctccctgggaaacctttgtcccggccctggcccagctttttccctcctgggctcgcgcttcttacaccttctttacggttgtttcggccattcaggtctctcccacacaccctatttcctagttttgtgatctccgggagcaaagttttaatacacaactactagtcctcttagaaggagaaagaaaaaaagaagaaagacttttctgcttggtttatttatcttctctcaggagttgaactctggaaattgaaactcacaccccctcttctaaattataatcatagttttgtaaaaagggcttaccttaactttgtagcaaatctgtactttatggattggcaaaaatgagctcaaataaataacccaatagcaacgtcctggtttatgctggtcggtggaagattccaaatttgttaggattctggaagcagaaaacagaatcaagcaaatcaagcggcatccagaggctttgctgttaaaaaaaaaaaattaagtgctctgggtagaaaaaataaagcccccggttagagcagagcaaacaaaaagaagaaaacaacgataaaaagaataaagaccaaaatgctctcccaaatcagagggaatgaagacactctctgggtggcatttgtgcaaggcatgaggctatgctggtggataaaaggccgggaagaagttgaaaatggttttagtttaactgtccagagccagagctgggtcctgggcggcgtggttttgagcaaggtcagtctttcattagctctcttgcacatcaagggaacgggcctctcacgtactcttctcgcctgagcaaagtttagatggcctagggtagaaatggcaagtaattaaagacagagtctatgggttttctgggatccttcgaaaacgccctcccaccccgcccgctattccgcagctccaccctagtgctttgtagccgcggcgctgggctctccttgcagctgcctctccttccagggcggctgcttgtcgagccaagtgggagtgaggcgtgctttttatagcagtcgggtgcaaagaggaagggggataaaaaggaaatcaagaatgaaaggaaaaagagaaaaagcggattacacggctgggcccggcggagatgtgtaatgtgaaacatcactggtgtcagctcggatatctcaggccaggcctctctccaatacacaaaagccgccgtctggggcgacagggaggcccgatgtggattgggatcggggttgcggctgggccaccggacacgggtggaagccggccggcctgggtggccgcctgcaaagccaaacgacccggctgggcctggcgcgcggacaggcctgtggtgggcttagggtaaagaagaggcagagcgaaagaagggggaatctccaaaactaccctttccgggttcccggagtttaatatgccaagctcctggagttaacgagctgacgaagaggtggtcttttgctctttatttggttgttttgctaggcgagaaagagtgttggcggcctagtccctgttaagggagcacgtaccagggggtgggggacgacagtggaggtcagggaaggaagggaggaattgcgtgggagaaagagcgatcctctagtgcccttccagccccttctcctcatccgtgggtctgtggctttggaatggaagcaagtttgcaaggtgccccgggaagggttggaaaagcctgctgccccgcgtttgttttacattaagtgtttttggacctggagaaacgcctggctgagtgatcaaaccgtccgcaggtctccatgcgttcggctgaggtttgtggcgtagctccgagtcccagctcgcaggccagagcagaccaggtctcctgcgcttggtggagacccgggccagtaactgaaagctggccctggtatcttggtgtgcagggcggtgcagtgaagcgaggccagggtgtgtgagtgcgctagcgtgtgtgtcgggggaaggcgggggttggcctccgatggaagttttagtaatctgcactgtggcatctgtttgctcccttgccccaaccgcccccaggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaattggtctggattctttctcccctcctctgtcactaacttggccaggacatctcagtcactgcttcctaaacaaaccagttccctctgcctgcctagttaaacatacaaggcagcagtccttatttaaatttggtagaaataaatgatagccattcatcagaaactaaaaagaaaaaaaaaggcattcccgggggggaaaagggctacaaaatctaattttgtctctccaatttttctttggcttaaacctagaggattccattatggctagcaaataatatgaaaaagaaaaaagaagaaagaaatttagcaagtccatcagcttaaaatgactctcaagtttactcctttacggggaaacctacacctctagcaaattgttctggagaaatatttgtgcatgtatacatgtatagtttatatgcatttctctcaggaggaatacatctataataaatttacagggaaacatctccagttcaaaatatttaggcttccacgtttatcttcaggcttaagtagagagatccttcatgttatattgcattactatttccaaatcctttggagacattaaaagaaacaaagatgatttctaataactacagcccttcagtttctcaaagaactcaggggttgagaggttagagtggagtttcctgagtcttgtcgagcaatatgtagttgaggcaaaggtcatgctcccggtgttttgttttaaataatattgacccattaattctaaacctgcttgttcctgaaattatacaggattatagtttgcaaactgcaggacaatgaagcaaatcaagatgaattacagccctggccctccctgccatcctctgacatctaaacagggaatgagttcggtgtgagtgtttaaatgaactttaagcacccgatccttctttatccgcgattttcagctttaaaaaaatgtgaaatttgatttcataacaaatagaaacaaataccacttagtcccagagaattcatcctcatggcgctaggagggtcgttgtggaggtggggggagggatgtgctgagatcttttgttatgcttgtcaaccccccgcacaaccaaagtgggcgagaacaaacaccacgctggggaacttagagcaaaaagtaaccgccgattttctggagccgacaatatcattgttttttcgccttagttgctttcatctgaatgaaactttacctagaagcttttggagctcgaacactgagtctttgttctgcaagaaactgctgctgccacttaaagagatcgcagataatgtccccgatttaagatcagtgctcaacgcacactttctttctttttaaagctctgcctccgacttgcggagggatcacgcagcagtggggggcagataaaagccctttggacgagggtcacctcccaccatgttgttcacttgagagcagtggagaggaaaacggtccccacgggcggactttggcttctggagccgcagggcccagcggtcccggcctctccgcctctcagcctggtagggggcggggagggccaaagggcggaggggaaggaaggagctagaagaggggatttggggatgggggctggaagcgctaacgagacctgcccggaggatttaggtctcctgcaggttggtgagtgatttgggagctctgggtagaagaggtgtacctcggcctagtttggttgctgaactagaacaacgcgaggacatcaatcaatctgcaggaaacaaaaaatggaagtcgaggtttaggaagagttgtcacttccccgacttgagtggtgcaggctgggggcggagacttgggacctaagagaggccatttctctcacctcagctcccttcccttggacttccaaaaggaataattttactctctcctccgttctccccacaactctcatccccgctagcccgcaggccgcctgcccctttccgcacctccttttcccatccagcgagagaaacctagctcccagagccggt

SEQ ID NO: 13302 - DNA, 90544 bp, Human
cattcttccaaatactttttgcttttcctttcactatgtttaggtaaatttgagccacatttttgcctttcattcctaagaaacatatcaaaatatttgacccatcaaacatttattgaaatgtcagatgatcttttcaataaaaagagggtttcaagggctaaaattcaggaagttaatgtgccaaacttaaacatactgtgatctcaagaagtttaggattgcttcagaatgtaaaattaatcaatacaagatgggcctacaatttagaaaaacatatccctttttcctttaattctttttctgttactactattttgtgagaaaaacagcagaaatgttacagagtaaaatggacccgtttgcttttaaagttttgttttttgtttgtttgtttagtttgtaatttagaaccgtttgaaacaacgtttctcagagtgtgctctgtggaacagagggccctcaaaaggtacctcaccagaaaaagctgtcttgtcaactaaatggggaaagtactccgtcgtgtttcctctctgggaggctcacaatgtgtgtcaccatctggaggctctgcaagaatggagagtagtaaaagaagatttttcactttaacccagcattgtttgcttggcaagtagatctgttaatatccatggattgtatgctggggaaataccaagtttttcatagttacttaacccttgaatatttatcctcctcagagcatggaagcaagcagtagaatgcgatcgttgatatatggactttaattttttaaattttatttatttatttatttattttgagatggagtcttgctctgtcacacaggctggagtacaatggcacggtctctgctcactgcaacctccgcctcccagcttcaagcaattctcctgcctcagcctcctgagtagctgggattacagatgtgttccaccacgcctggctaatttttgtatctttaggagagacagggtttcaccacgttggccaggctggtctcaaactcccgaccgcaggtgatccacctgcctcagcctcccaaagtgttgagattacaggcgtgaaccaccacacctggccagatatatggactttagactcagacaacgtgggttcaaaccccagttctgctatttgccaggtgtgtgaccttgagcaatagcttaacctctctaaatgtcagtccatagctaagctgccagtaaatatgaagttcattgcgatttttcttcctgagcttgtcattcagaaacaaaatgatagatttgcatggatgatggatttcccaacaggtcaattttcacatctggaatctactttaaacgtgctctaccacatcaaagtctaaggaagtcaatctcacttggaggcacactgcagagacaagtaggccttcttccttgtccctctgtcctttcagacttctccccctcttgttccctctctcttcttaagctttccagctccactactgctttggctaatttctttgggttccccctctctcattcacccagcaccagctgaactgatttaggtttacctggctatgctttccaaatctaattcgacaaatatttactgagtacctaggtggtccttgaatcaccctgagcacccaattccaggatatgacttcttcaaaggacagaattggaatgtttacataatatgagggaaaaaaaataaaagaaaacacttagcttctttagcaagctatctgataaaatagctgaaattcaagaagccctttagttaggagggagagattgcgaacacaacaggaagaagccccaggctgagtggcaaaggttgagattttctatcgtaagcacacctcacccaaacgcttgctccctgaaagctgctgacggagctttggcgagggctcatcctcccgttggctgataagcgaagccctgttttatatttaactcgctgcagtgcaggaggggtaggggtggagatgcgtcgtttataaggggagctgtgacaatcttcttgccagccctcttcctcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagtaaatattaatttttgctttacctcccttaagctcacatatctgctttccatttcttttcctttccttttcactttccgcttttaattattttgttggtctgatattgatcggctcttggtttcaattctggctgtccatctgggaagccaaaattgttgccctattgtatttccaaaccctgtcataaaacttgaaagtagtgaatgagcttcgtagagtcaaaagtcagtgtaagtcttttattccatcaggagaaatcataatatactgcaccctatcttgaagatttccataaattatctcaggtttgagaactgcctttggtaaatttcactagtgatattcccaggctatgtagcaatatatatacagcaatatatatgaacttttaaagtggtattacactaaatttacgtgaaacatcagtaaatttcagttattattttgtccattttttttttgtccaatgtctcttttttggagaagagagacattgaaaaatcacatgtgatccacagaattgtctttgtgtcttcatctggaaaggaagacaggactgtgtttttttctgtctccgatggccaggaccatgctttacacataggctttcaggaaatattcattgagtccacacatcagtggcataggtaaatttggaggcttgttgctcatgatacaatgtgcaaacataatgctaagccttttacaacataaaagatatattaagtagttaaatacatacaaatatttgtatacaaatatctatctagatagataggtatttattccactttcccacctatttgtctagcctttgtattgatcagtggctactaccagagctatgttaaaggcataaactctctcattgaactccaaaaacttccttcacactgtggatatagcccttgcatcagggaggaaggctacactacaccttgtgttgtgtctggactgctttgacctttgctggcttagattctgaagaggtaaatgattaagaaagcttcttgtcacagtttagagatgtgagtcttgggccagtccacccacaaatatccctttttttctgttgttttaagcatcttacagagcaagcaaattttttggtcaaaattctttctattgtttgtcagacagacccacggactaaaacaaaacatttaaatattcctatattcctgtgtggtaaactgataaattgagtagaagtgatagtttgaagaaaatatctgtaggggtcatgcttatatagatcttatatcttaatactgctagcaaaaaaacactcttaccatttacgtattttttctgttcataagaattacatcattgaaagcataaaaattatcaaaaaggataatcaaaataatctgtaagtaatttcactgcccagtggtaatccctgctagcatattaatgtatattctaatgtttttctaggcaatcaaacctttaattgcattatatctgtctatctatatgccttttttacttaatgtcttgagaagttccccttattcttacatgttttcaagaatctgttttttgttctttattgagacagggtcttgctatgttgcccaggctggtcttgaactcctggactcaagcaatcctcctgccaccacttcccaaagtgctgggattataggcatgagccactgcacacagccaagaatctgattttaaagatgtgaaatattccattgtttgaatacattgtaattttttaaaacaaattatattgttgagcatttgagttgtttctagtattttattattataaacaaatcatcaaataacatacttctaaatacctctttgtatgtgcatctgtttatttccttaggttaggatatagtcctaaaaatagaattgctgggtcaaagtgtacaaatataccaagatattgtaatagttactttgtttattgataacataaataatacacgtttattgaaggaaactcagaaaacagagaaaattataggaaaacataaattcatccataaattctttacccaagtatagccattgttaacatttaggcagagactcttttagtacttttctggacatagatagctgtggcataattatattatacatagtaatgtgtaacatgcttttccaatatagcatcaatgctttaagatgtcatttgatgttcttccacaaatgattcgatggatacatggtaggccattgtatgactacaatgtagttgattcacttttccattaaatatgagtatttaagttgctcctattttttcacctataaggatctagaagaaggcgcatccttatattgactatccttgtaaataactatttatggacattttctaatatttaagaaaattcctagaagatgggccaaaactacctgtgtataaatgcatgtatgtctgtgtatatatgtgtacatgcatatacatatatatgcatgaacatgtgtatgcatgtgtgtgtgtctccaaactgacttccaaaaaatatgtcccaaactccatttccaccaacaatgtatgaaagcgactattcctctgagccttactaacaatacaatgattttttaaaagtgtttgccaatggtcgagggaagggcaatattctgaagaatatccaccttaaagagattctaaaaattcattgaagtgaaagcgagtcaagactttttaaatattattgctaaaactttaaaactgcttcttagatcataaagacaagagaaattttatctgaataaaaccatcaaaatatttataaaataataaaataaaattttacacatattaggaaggccaaaaattggaactatgtagtctccattaataagtttctattatgtactttataagtctaaaaaaagcattatatacacaaatactctcactctttgagttattttagtgtaccagttaattttgccataaaatatataccagagagctgcccttctgaagctcagttgacttaacttttgattggagattacgaaatgatggcaacatcggtgaggaaggctgatgctcagttcagttctcactgaggattggtgttcccaagtttgtatgtttcattgggagcagttgaagctctcacattacaaaagatgctgccagttctgtactgcacacacatggttttggaacagatctggcgtcagctcaataacctcatttaggctaaatggaatactttttgttatccttgtctgaaatatttcaagcatatgagaaaagtgcatcatgcttttttttctagcctgtgagtaatattttggcaatgcagcctctaggagttctcatccacaggctccatataagggccaccagagggagttcactgggggcagtgcctttctttcatactatagagtgagcttcgtcatatgtgacgtttgtatcattttaaacgtcatcatagtaatacatttgaagtacggagtcaaaattatattttctgaccttaacgtaaaatgtaactccaggattgagtattagtagttagggatattaatgtgacaaccacaatgcaaactaaacaggattgcactcagtagtaaccaaaattacttaatttctgcaaatacaatcaggactttgagcttcacaaacttcacagctacccaagttgctttctctcaagattgagacatggggaagaaaggggacaaaatttagaattccacattgtctttctggggacagagttgtagtggggcgtggaaggagaaagtttgagaaacatccagtcgcttttcctttatcgatctacctcttcctactcgctagtctattcttcagggtctgaggaaaaccacttggaaggattggaacctttggaatgtttctctgaccacaccctccttcttcccattttctcaccgtgttacgtaggatttccagctgttcccttccctaaaagagtttccctctactcaaactccaaagtatatattttcttctctccaagatttggcttttccttgtcagcatttggattatgcttacttagcacttcccaaagtatgtactgcagaattctagttgcatggggatcttagtagatattaccagaaaaatagcaggggagagattctgtggctaaatcagtttgtgcaataatactaaatacaaaatgatctgttttggattttgtttttaattatggaacttttcagagacttttttttttttaaagagatgagatccaggctggggtagaactcctggcttgaactcatgagttcatgagttcaagtgatcctcccacctcagctttccgagtagctgggattacagggttttcagaggcttttatatgataatgtcctctatgtagtttcccaactctctgtgactatggattcttctgtggggttcctaagagtagggatatatgtctttcctttactgtttggcacacagtgagcactcaaatattctcaaatggaataaatgaaaatattatcatataagctctcacatgactagtatcctctggcaaatgctgggacacattgcattaccacagcttctctcccataaacgagcctaacttccaccaataacatctctacattcccacttagggtgaaaattttcccttggttccttttctgcctaccctgtggaagggaagagtttatatgtgtatgtatatatatttgtacttaggaatgcaatctccgtagtttaaaggcagagaaacagtggaattgacaggaagtacaaccggaattttagagatcatttctagtttgggctgccaaggtgttcttcgtagcgctagtaggatttaagctgaattttgatgttctggtgggagttcagcagcagagacaagtgagaaactaaaagcaggcaaaaaggaaaggcaccaagtcagaaaagcagagtggggacaagaaaattagtttgtaggggaagtttatatgaacaggctagctagatatcactgaggaaaacccttacggaggaaaaggaaaaatagccatgataggcattatgaaggagaaattaccccatgactttttggatacagatggcaaaagaaagagttaactcaaccatccacttggatatatgaaagatattgcagcaatccaggaaagagaagataaggatcagataggaaacgtgatttcaggatagagaagagagggcacagtagagaaaatagtttggaggtaaagtagtcaagatttgacgattgcttgactatgaggaagggtgagttaaagttatgggtctaggataccccagctagccttcacctcaattgatattggaaataggtgggaagtagccaggttagaagggaaggtcgtaagttcagtgtcagatgtgttgatggcttgtcagacatctaggaagagatgactagtaggcacttgcataagtatgtctgaagcacaaggttagagcttgtaataaagatttaggagttgagtggaaacatcggtgagataatcatcattaagtgtgtgtgtgtaatgtattcttacctgcatggatgtgtatgtatactcaagcacatgtagttttgatcttgaaatttttgtcgtatgtcagtttgttcattatattcttagattagtatgctgagctattatcccattgtcaataaaaatgtcaataaagaatagattttaggttgggcgaggtggctcatgcctgtaatcccagcattttggaaggctgaggtgggcggatcacctgaggtcaggagttcgagagcagcctggctaacatggtgaaaccccgcctctactaaaaatacaaaaattagccgggggtagtggcacatgcctgtaatcccagctactctggaggctgaggcaggagaattgcttgaacccaggaggcggaggttgtagtgagtcaagatcgcgccactgcactctagcctgggtgacagagtgagactccatctcaaacaaacaaaaaaagaatacattttctttttggtcttgtttacttgttgcaggaggctaagtaaatttcttttattttggaagcaagaaaacaaaaagaaattttacttgaccttgaatatcttctacatagaaaaaaaaaattggaaaataaagttaaataactaactggttcattcaaaccaccataaaaatacatagaggtctgaacaatctagaggggttgtttttcaccaagctgctcctctatgtaattctggaaccctttatttagtctatatagacccctagcaattgtgactacctgtcccgaatcagaagctctgtgtttaaggatttcacccaaaacttgctgtttattttgctggttcaacttataaaattgctcagcacagccagagagtcttcactggaaacagcatgccagatgatttatgagataattaggtaccttttttggttttttttttagagtcaattcagagtgatccaagccataacttgtgccatcgccccttctccctcagttttcttaaagtcaccttgatctgatccactcagagatgccagagaaatgctcttcccttttggaaacgactaaattgcatagactatcattttattgtgctaggtctagtaagtgacttattaatgtggcatagggaggcccttgtgggaaggtggtttactccaacacatttgcctggcgcgataattattcaggacgtacccacaagtcactcctgaacatattgtgctattagtcagcctttttctcttaatttgcaagacaagtcatctgattttaatcactgaataaaatcttcccaaagaagttgtgatctagaattgttttgtattgttatctcttattccttgttttcaactttgcacacacttagaaaagtttagggccaactgatggaatttaggatatataaaaaggagcttttgagttattctgaagttcatgagaaaaagaacaggttaccattttaaaaatgcttacattgcctatagtgtatatacaccaagtaattttgttccagtatatattgcagtcaaatgaaaggatttgaaatatttcagattgtgaaagtgctatgtcagaaagcactagcattctagatttataagatgtagaatgaggtatatcctaaccacattatgtaaattttaagggagtttcaaatgtattactacatgtaatctacgccttctcacttccccataacgctgtgaggaggctatacatgctctggtgaccaggttttacagatgaggacactaaaagtctggggttttgtgacttggtcaagatcacactttagtagctgaagtggattagaatgtaagaatgtttgctcttagaaaagggttttccccataaaatcatattggctctgaactttaaaaaagaaaaagaaaataaacattatatagctcttcgggttgatgaatgtcactgtatctatatctgggtcactgtgattgagttagacttgctgtgactgacatttgctgagaggaccactgagctgggccaaacacaccgcacagagaaatctcccacactgttctgttccatgtccgttggcaagctcaggaatacgctagtttaggaaggtagtttttgcctacaatcaagcagaatgtcttttaaagagagaaggtgagaaaaggattgaaaattattttctttcctgggatcttaggaatatatattatatatattatattatattttatatatatattatattatatatatatatatattcatattctggcatccagccaagagtaaaatagagtatttgaaaacataccccatggctatagcttaggaaagtgtaattccacttcctccttcctctcacctcccacacacgaagatgtgtgtggtgcgcgcatgcacgcacgcacactcacacacactcatcttctcaaattagttagctggcctatttctgaggtgtgactcagaggagacattcttgcaaggagtgacttttccttttcccctgcctctggaagacatcagaagtcagaagaattcagaaggaaaaggcagctgactaaacatggggttggagcttggtggatcttataaaactttcaaactctgggaaagtgtacaggcttttttagagtctgatatacttgcaattaactacaatctgcaagatgtttagaaacttcaattgactaaactgttaatgtcacaaaactaatcaatgattgttctattgcagaatgaattcttaactgaggcttttcttgggtaactttattgtgacataatttcagactcataggaaagttataagaacggtactaggaattcctagaaatacttaacctagattcaccaattgtttacgttttagcctgtaccccttccccttcctttccagagcacatggaaacatcctctccctttaccccttaacatcagagcatatttcttaagcacgggggcattctctaaaataaacatagtacagtcatcaaaatcaagaaatttaacattaatacaactatctaattcacagtctgtaatagaattttatcaactaacctaatgatgtctttttgaatgttttttcccccagtgcagtacccagtctggaatgctgcattgcacttagtgtcatgcccttttagactcctttaaactgaaaccagtcccttagtccttctttgtctttctaaagttaatatttttgaagaatacaggctggctattttgagaatgtccctcagttgtagtttgtctgattttcctcatgatttaaaaatgcaagttaagttttttgtttttttttttctgtcaggactatcacagaagtgatgtgtctctctcaggaaatcacattagagacacattgtgctggtttgaactattattactgatgcttcctttgatagcttgcttaaggtagtgtccaccaagcgtctccattgtaaagttacaaggtttctctttaggtaactttcagggagtttttgaaaccttgcaaatatcccttcctcaccaaactttcaccccctggatttggcatccactgatgattttttaaaataattttttccttcaaatattattagtaggcaatctactggaaggaataactttcccttctcacccatttatttattcattttaaaaaatcagagtaaggactcagagattgttaatttgttcaatgagttattatcccgttgtttattgtgatgttccaatactcccataatttgccaaaggcagtcaaatccttggctgtagtaagtccttgaatcaaaataaaatgcacgctcttctcatgatctctgatattttcctgatctggcctctgctgacctcatgtcaaacttatctctggctccagtccgtctggttcagtgttctttagccacactggacacctttcaattcttcaaccacagcaggttctttttcatcttagggactttgcacttacggttccttctacttgaacatgtttccctgaacctccacttgcctggctttttctcattattcagatctcggcaaaccaagagattgtgaccactctacctaatgttgtttaccacttttcctagtcattctctgtctcttccagtgttttattttctatgtagctgtcatcactctcctaagttatttatttatttgtgtgtctcttgtctaacactctgtaagcagtctggaatcttatctatacatgtaactgcccagtgggttcaccttgcccgctgcctagacagagccgatttatcaagatggggggaattgaaatggagaaagagtaattcacacagatccggctgtgcaggagactggaattttattattactcaactttgtctccccgaacatttggggatcagagtttttaagataatttggcgggtaggggcttgggaagtggggagtgctgattggtcaagttggagatggagtcatagagggtcgaagtgagtttttcttgctgttttctgttcctgggtgggatggcagaactggttgagccagatactggtctgggtggtgtcagctgatccatcaagtacggagtctgcaaaatatctcaagcattaatcttaggttttacagtagtaatgttatcccccatgaggaatttgtggaggttgagactcttgcagccagaggctgcatgacccctaaactgtaatttctaatcttgtagctaatttgttagtcctgcaaaggcagactggtccccagggaagaaggaggtcttttcaggaaagtgctattatcaattttgtttcagagtcaaaccataaactgaattccttcccaaaattagttcggcctatgctcaggaatgaacaagtgcagcttaaaggttaaaagcaagatggagtcagttaggtctgacttttttcactgtcataatttcctctgttataattttgcaaaggcggtttcatacagcagctagaaaaatgtctgcaaatgtgtgcatgcatgcataggtgcttgtgtgcgcacgtgtgtgtgtgtggaagggactcaattaatgtttcttggatgaatggatgatataataatttagcctgatattctttatgatatgtctttcttagtttccagaatcctgaaggacaaaatttttgtttgtacaaattattaatgaatggaaattaccatttctttacttttatactttttactttgcttcattttctaataagccaatatacaatattcttttactgtaatatgtttacatgtaaaaagtgtatgctattgatttttttgagcaattactcagaaaataatattttcaccttgaaattatgaaaatactaaacattaacattttagtttacaccagcatatgcctagttagagccataaaaaaaaatgctgctctctctttttaagagtgagctttaaactaggacaaaggttacttcacctaggagattactcagcactgcctttacatgaaaatgaaactgggggttttgtccctgttgtaacataaataacaaagaatgtgccattagggacagggactggggactctggaataacctccactctgtgacagaagacagctgttcacttcccataagggcagttagacacaagcttttaagtttggctttgtgtttatctacttgttgctcaatgggcttggggtggagagagtactagctcataattggatttatttttgctcctccacagagttttagttatggcaccaaaatagctgttaggttgatgcaaaagtaactgtggtttttgacaaataaatatgtgaatgaaatatctgaagcaatctgactcagaattttttaaaaatttgttaagctaaaaattccaggaaaacctttgacaaatatttgatagtcttctagatggaacctcatttttagaaatgtaatagttataattgcatagctgatttttttttcccctaggaatagagacataggggttgtcagaagaggcagcatgcatttcgtttgtttgtttgtttgtttctaaggagcatagtggccaccgatcatgaaccaacagatgccaggaaatcttttccttgttttgatgagcccaacaaaaaggcaacttatacaatatctatcacccatcccaaagaatacggagcactttcaaatatgccagtggcggtaagtattttttaaatgttttgtttatgcagagagtctgttgacaacattaggccagttacctgattttctgtgaaagagaacccattgaattctaaaactaaatgtgcactaatagtttatttagctgagtgaaatacattttggcaatctttttctttgagtcctagaagtctgtaaggtatcacagtccagtaagaaagccagattggtgtttctgtgcaagagacaatgccatagacacacacatcagcttgggctctgcttagctgccaggatccctgagtcgtgacagattacagtaatggcaaactaatggaattacagacttgaaaatatttgagggctactcactatttagttttcaggtgaatataaatccagtttttgttttgtttttttgaaaaagataaagctactatttaaaaaaatcatcacttaaatagtgggttgtggaagcaaactccagggaacactttgcccatagactcctttggtgagtgggaagtgcttgttaaatgtctggagaaaaaaaaaaaacaggctataaaaaaggatgagttcatgtcctttgcatgaacgtggatgaagctggaaaccatcattctcagcaaactaacacaggaacagaaaaccaaacaccacatgttctcactcgtaagtggaaattgaacaacaagaacacatggacacaaggaggggaacatcaacaccaaggcctgtcaaggggtggggggctaggggagcgacagcatttggagaaatacctaacgtagatgacaggttgatgggtgcagcaaaccacagtggcacgtgtatacctatgtaacaaacctgcacattctgcacatgtatcccagaacttaaagtgtaataaacaaataaataaataaataaaattaaaaaaagaaaaaagagaaaaaattttaaaaggctgataatttctgctgtataaattatttgttaacataaaacacttctctctgttattgtgtctcatccctataatggataatgttgttacctagagtttcattgcctcaaagttgaggtttacatactttacacattcgacatgtaaaagggtcagcctcatctttaggtataataatcagaaggacaccagccccaaattatgtctcccatctttctgatccactatttgaaatattgtcattaaaattcatctttttaaatgataaaatattccttgaaaaagcaacaacaaaataaagcaaataaacacttaagaggattaaaatatactcttagcagccatccatgcctcagtgagaattaattatcaatttgttttcttctaaggtttgattggagaagaaagaggaaaggataaacttaaagtatgacacaccaatctagatgaaggtggggggaaaaaatggcaaagtcaccaacttctgcttaagaacttcccttatggccttttcactgtgcagagttacactttaccttctactagatccagatagtagtcctggaagaaggagaatattctgggttcttaggccatcaaaactaacactactaggtttttatggtagagtaatgtagcctggagccccaccacgattatacaagggcatgcacacccgtgcttgaagtgtcagccgcacccattctaatccagcctccctcgcttaatctctttttaaaccatcccaaatagagtggctgcaggagatgtggaaatgtttaataatggaagcaggagttgggcaagtattcgtggttgaagtgttaggattggtgatcgacagtgaggacagcagagctggcatggacagaacaagccagataggtcagtagttgtgtcaagcaatagaatcctcctctctgtccatggagaccgagccactgactttggtgaccatacctttggtgtttgatgtagacaaccaaagacggaaaagagaagccaatgttccgctacaccaggtacagcaattgccctactgccagtcgaatcagcaaatatctgagcacgagtctgtttttcattaggagattgcagtactctgaaatattatggtcagcatgatgtgtttagtgtagacagataaactcctatttaactgatagtccactcaaaattttatttctccctgaaaaacctgatacagtgtgtaattcagtcagtctttaacagttctaaaaacaaagtaaattttcctgtagtcttttcaacatcaccacaaacaatttgacctctaagctttgacaaaggacttctggctagaaagcaaggtttggggcaaccgtttatttgtttgtcttgcatatatatgattgatattttgatcgataaaagtttatcttttcttttcaatagaaagaagagtcagtggatgataaatggactcgaacaacttttgagaagtctgtccccatgagcacgtacctggtgtgctttgctgtacatcaatttgactctgtaaagagaatatcaaatagtggaaaacctgtgagtctcattatattttaaaaatttaccacctatgcatttgtaattaattatctacctttttgggtagtttttttttttttttttcaaacaacatgcctgaaaagccctttagtccccagggtctgtggacttgataatacatagaaaaatgtaggctgaaaggatacaggtaaaaaataaaccaacacaacagacatagatatttatggccttaaattatttcaagggaaacatgtgctgtaagtcaaaagctagctcctaagtataccagcacaaatatattaaaatgtttgggtatgcccaatgtaataaaatgtttgggtatatgtgtacctctcccagatatagactagagagagaggaggaaacctgaggtaaaggaacatccttcgaatgacaaggcactgaaaagtttatggctccattcctatatgtaatcaaaataggtagcaacaaagtatccaaaagcattttttaaaagtatgataaaatataaataagctttttttaaaaatatcaagacgactagttcaatagttttctttctttcttttttttttttttttttttgagacggagtctggctctgtcacccaggctagggtgcagtgacacgatctcagctcactgcaacctccacctcccgggttcaagtgattctcttgcctcagcctcctgagtagctgggactacaggcacccgccaccacgcctggctaatttttgtatttttagtagagacggggtttcaccatattggccagccttgtctctaactcctgacctcaggtgacccactggccttggccccctgaagtgctgggattacaggcatgagccaccgagcctggcccaatcgttttcttttgaagaaccacatacttttacctaattaattttttcattttggaggcccccattttgcttatatcctgaacatatgtttaggttgtctagtaagccagttaattcacctctgtgccatatatgtcatatatataaagcctcatcatctttgcaatataattttataaggaggaaatcatcacccccattttagagatgagaaaaattgaagtttaataaatttaggctatttattcaagattacccagctggcaagtggtagaaacttaaattccaaactccttccagatactgtatcttgcttagccttctgatgtgtgatattctgaaaatatctttacctcttcatcagtcactggaggagaggggatgggttcctctatttctgtgaaatgaacaaagggaaaatttgcctttgctttggtgtggtaggagttgatattcagatgtcctcaacctgggttgccagcatgctgcctataccgtatacaaattatagcgagtgggggatgtccacagaccttttcaaaggggctgcatatcatgaggactcatccgtattctaacttttccttgacacataggttgctttgatgcaaccttcagtcgtggtaaagggaactactagtggctgatagataatactggtatgaaaaggaaatggcatcagaaataggaagttgttttttctagattgtgctgagtgcagtcgatggcattcctcttgcttaatatagaggtgagaacattagtcaagcttggttttttctttccgtctcataacaaacatgcaattttcatctgaagctgctttcttcatcattgacaattcaattgcatgactgtctttcatcatgtgcaggtgtttcccataccaagttttaaaaattattattacattctgagcaaatttttctatttgaggtagaaataccaagaggaaacagaaaggctaagcaattgtactaaagatgacaaagtctcataggtaagaacaatgcatttaaccaatcagcagaggacatagtacttggagttattttctaatagtgacagtgagcttgaatttccaatatgactctatcaccaggtcctctgaccaaggacatttacttgtaatattatactaactaggtaaatcactagagcctgtaccagttagttagctgggttcttaggatggattttatataaaggatttgaagtgatataatgaaaaaatacagttttgcaaaagatcccaaaatgtcctgtaggtggtaattatttcttaaatggttcttctatgaaaactaagagcataacattttgttttaaataagtgatgcattccatcatttgggagggaaacaaacataatattgttttaatacattactgtccaatcatctattttataagagatcaacagaagccaaattcccttttgaaacttctcagaggctctgagccagaaaaattacaagaaaatgagatatgccactttccccttcctccaacccttccatagaagacaggcagccagagtttcccctcctgaaaaaacagtggggccgtttcctttaaaagttgaacagaacctaatgggagaaatttaaggcatctagtgtgaatgcaaatgctccacagtgagttcctcctctttggcatttgggaggttcccctcctggctccctacccacttactgtaagttgaaatctaatagttgacacccacccaagtacaaactgctcctggtatgatttcccactccagagagttacagaaaaaccaacctacttaaatctattgaaatgtaacatcagaggaaactcacaccagcctcagagtcctacattcttagaacttaacagacaagctaagaataaccaggtatatgaggaaaacaagtaacataaaagaaaaacatccaagacaaatagaaacaccgtgggagtaaatagtgataactggagaaacaaaagagaatcccgaaaaagtcataacaaaattaaacatgcacacacacaacctttaattaatgtattcaaaaattcaagaatatgatagtcataaaagaaaaaccaaaaagtgacgagaaaacgatcagaaatagtagtcagagttttagaacgtgatttccaaagcatggcttgggtctgatccccaggaacctgtttccgacccattccttccaaaactggagctcaatatgcttatagcttccgatccttatgtcttgttcccatttttatattttatcactaatttctgagtattaggattagtggggtgcatcaaagcatccctttactgtaccacctgtacccaaagtcctttattacttttttagtaaaaaacaaaaataaaaaatgaagccatgtatttgttatgtacaccattaataggtgactattcttatccattcttcttctgacagtattattctggtacattaaccacctgctattcataatcagattatactatgcaatctaagaatctataatgccctgattcaacttgcttgggtatattcacctctctgacaatagttcctttatatcaataaacacagaatcaatgcctgcattcttaatagtttagttggagagagtacagcagactttagagttgagccattcattatgtttaaaatatccttgtcgctcatgagaaaaattaaattggttttggaggtagctcagaagtcttttcactcttcatattttctttttaaattaattgcattgcattttgattcaatgctaaacagagtaacatgaagagttacttagaatagtttagcaacaattgaagccagccactgatggaaggaattttttacaattctgcaagaaatctactcctgaggtcttcttcaggtttagttgattgattagggttttaaagtaaatgaaatcactgaatttcaccccagaaaaacaaacaagtggacacaccctgaactgtgcatagtatagagagattatatgactttttagttatgtgaacaaactgttgagttattgtttaaaaaaaatgtaatcctattgttcctgcaggagtcatcagagaggaaacaatatccccaataagcatgtcatgaacctgagagttcggcacaaagttccccattggaatttattgcaattcattttcaaaccaagaacaatgtacattataaatatatttttgagtttttaaaattataggtttaattcatgtacattattgaaaatttggaaaacgcaaagtaggaaaaaggaaaatcccccgtattagtatatataaaatcatttgaagttgttaggtttgtgttgctttctgaggtacagttgacctacagtaactttcccagaatgctttcgctctgcatgattctttaaggaatcaaattcaggacgagttaaatggcaatggtggccgggcgcggtggctcatgcctataatcccagcactttgggaggctgaggtgtgcagattacttgaggtcaggagtttgagaacagcctggccaaaatggtgaaaccctgtctctactaaaaatacaaaaatcagccgggcgtgatggtgtgtgcctgtaatcccagctactcgggaggctcaggcaggagaatcgcttgaacccaggaggcagaggttgcggtgagccgagatggtgccactgcactccagcctgggtgacagagcaagactcggtctcaaaagtatacataaataaataagtaaataaataataaatggcacgagtgatttcgttcctgagaaacaaaaatctcaggagcccttgaatttctttgggggcatttggcatctgtattttataaagaagtatgtgcaaaaacaagaaattaccttgttggagattatttcaactctagtcaagttttccttggctttcctgaacagagggggaagctgggaggaattattcactaagggaatgctggtggaagatattatccatttaattaggtttgtactatgaccatattaattctaatatatcagtagaagggattatgttgtactttcttccaaaaatcttacaggatgatcgctgaataattgcatctaggattctctctgtgaatgggttcttcctactgtctgtgtcttcttacttgcttccatcttagtccgttgtttgcctggattagaaagataggctgaaggcagagtatgtatgtatatatgccatggatttttaaaaacagcctatctttataacagttttaggttttgtgccatagactttgatttatgtatttctcttcatagaaataatcttattttttaagtttcattgctttaatgctcagagatatatttttaaacttcttattttgaaataattttagatttacagagagttgcaaagacacaagagtctccatgtaaccttcccttaatgttaatatcttatataaccatttatcaaacattcgtcaaatctaagaaatcaatgtaatacaatactattaactaaacaacagtctttacttggatttcaccagttttttcactaatgtgccttttctattccaaaatccaatagatgatacatctacattatacttagcaatgctgtctccttaattcattctgatatatgacatttctcagtttttttcttttttatgatcctgacactttttaagagtactgttcaggtatttcgtagaaagtttctcagtttgggtttgtgtgatgtttcctcaagattagactgaggctttggattttggagaataccacagaggtgaagggtccttttcatcacatcctatcagggggtacatgacatcctcatgacttattcctggtgatgctaactttgatcacttggttgagatggtgtctgctaggtttctctgcttcagtttactagttttttattccaatcttctgttttttagaagcaatcgctaaatgcagtccacacccaaggggaagagagttaagctctacttcctggagggaggagtcacaaagaatttatggatatacattatgaccaccacagtgattaataaatatttagggagtgataattaaaggctatgtgaatatcctgttagttcttcaggttttgaccacttattgtagcattccccagtggatgtccacaacaactgttattgtggtgttctaaaggtgatttttctgttttcctcagaattatttttgacatatggtcatttcattattttaaaaacttattttggctgtggctttgctaagttttcagaatgaatttgatttctagaacattttaattagttttttttaattaatttctttactggaagggttatctttaaatggaaggttattaatctcccttgaaggaaactgtttaatttagtaagccacggaggattgctaatgattcttattttttatttaaatttacaaaaatataaacaaaataataaaaataatgtaagattttatggggtaatttagattttttaatgttcattttttaatttcttaaaaattatactgcagtaataatcactaagcatcagacaacttaaattttaacttaaatggaaagtaagtggccaataaatgctttgtgtaacctaatggccgtgctgagtttcttcttaaacagcaattcatagcaggtgagttccgactcagagtccgaacatgttttgaaccagcatagctacagcggaaaaaaaggtgttttttcacctaaacttcaaaccaaggttttgcatattcatactaatttatctatgaggaaggagcaaactaaaatttagaaagaatatatcacattgataaggcagaacttaaaaagaaaaaaactgatgtatcactattcctttcaactaagtaccctcctctgctaactttccacctactactggaagaatatttaaaagaacataaactttataaaatttaacacattaatggcatgttcagtaataccagctatgtaccttaaatatgcatttatatatttaaaaacaatatagatttattttctctttctcatcctggctacctcagtattgataatgaaacagtttcttcaaactgattattgtgtacatttttattgagcatctactatgtgcactggaggatgctaaaccctgaagagagtgaaatatgctgatatctgtacttcaattaagatgtgcaccagatacagtcaccactgccctgtgccacccaagtgtgttttcaggtctttcttggtgttactagccctgagtgccaaggatctcagcttgtttttgggggatcctttaagcatgctcgtcatttaaaatgatgtggctctttggaacagctcagatgagaccttgcaaaaaaaacctcaagaggtaaatggtgctacttctgcgggatgatcagcagtgaaaagtcaggctgctgtcaataagtagagtgaccatataatttatcatctataaatatatatataataaataatagaggaggtgttattaattaagctggaacaagacgtataaacaggtaagcaacagatttacattccagggacattcctgggcaaacctgaatgtatggtcacctctatcaatagaaaacactcaatagacaaggacaataaggatgtggatccagggcacagcggggctgcggcactttccaggtggaatcatgcagggccctgcctggcttctgacccaggtgacggtggcagtggtaacgggcagtctgtttaagctgattcttttctgttccatggtctttccaagttcaaggttctcatctcagtcccctcacactctttcagggtctgtttcaggtcttgtcccttcaaccttccctcaccttccctggcccaggtaaattttgtctagttttttgagacagagtagcctggacatctctttattctcttttcaattattattagagttaaaaaccctgtggtttgcttttttcctggccttctgtttttattgctaaaagtcttttgaaaccaggcccttacaatccaaaaagtttgggcttttaaatgtgttgtgtgggcatcaagagcctattttgaaagtcaaaaccataacatttatttttttcccctgcatttttcaatgttcttactggcaatgtggacaccatagtgtaagtatcaatcacatataaggaagtacgcacacagaaaattacagaggttaataattcagtgtattatctctaatgatactaacacttttgatgggacacatagaactattacatgtcaaacattgcttatgtgttatttaatactcgaaataaccctatgacataagtgctgttgttatatctattttacagctggggaggtcaagattcagtcttataagtagagaaaataggcagcatgatatgtgaaaacaaactttgtcctgaactctagcgtcagtcctgtcttagacttcatttttctcatgtatacaatgaggaagtttattttcaaatcaccttcaaactctaaaattataaatagaggtctacaatccttgtcccaaaccctcatggccagttgtatgttggaattcagaaattttcagatttgtgaaaggtaatgtagtttgaatactatatgttaatgattaactacagtgggatttggggcaatgtcttataatcagtgatacttctgcagcaattttttatagtgagaaaaataaagatttttgaaaaactcttaacagttcaggtcatatgatattgccaaattagtttgcttaaacatataaaaagttttagaactcattggatttattagtgtggattaggggttgtgggaactggaccagtgaacggattggggtaattatcagtgatgcaaaatattttttctattattattaataattctggattcatagaattgacgtgtggagtaaaagaaatgttgcatggaaaatgcttatcacattccttgaaaaaatttaagttctcaataataagactaataagtaatcataatactatcgctgagctttgtgcttggttttggttgcagggacataaataatcattgaagataaagatggtgcacagcctcattaaattgttcaaggaagattgatctaatgcatctagtcatgattgtcaagtgaagtcaagtgtggcaaagggacacgtaaaggaagtaatggtaatcaaccaggaatcgattctcatggacttaagttctatctctcaaatggtttgagacacttgaatgaaagggataacattaagaactctaagagcctacattacagcaggctccaatatgataagggaaaagcaaaagctatgttaaagcagatatgtcttacctcccaaaagaatatcagctgaataaggctgtataaagcccaaagtttttccactgatactagctccatagattcagtgctttgaaagacgactaatggtatccaacagtagtataccaggtaatttaatttgcctagggaagttactgtcttcaaaaagtaaatatatgcatgaaagttaggttcttgaagacttataaacttcatatttatgtttatatataatgtttacatataaagtgataaagtagacatacgaactttatatttaaacgttaatagggttcttaaatttaaaaagtcatatatgactcttttaaaagataaagaagaaagaaaatacatgtatgcatccctcctcactccatgttatttcagtatgggttgtcacacgcttaaaaaatcatctcagtaaagcaagcacataaactagaaaaatgtcaattattaaataatgatgacgagtcaggggtaattgcctgaactttatcatgtacagaagtgctgaggcttagcagatgataggggagagtcagtcacctctgccaaagcccagagagaggagaaggagatgcagatggagcatacattaaaggtggggtcagagagcgggaaaagtgtggtgaggatgagtgaaggcatcagcacaagggaggatgctttcaaaatcaccaaatccaagcatcacagatgttctgttgttacacggattacagaaaccatgttggagctttaaatgacagaaaatgttggcatgttggtagagtctttaatataaaaatgtttgtgatatatggtagttaagacacagttatgctttggcttaatatgttacaaaattaatgggctgtagctatatattctctgattgtttggctctgttgatcaaagtagcagttatagaataaaatctatgacctgatttttttatggtaacttctgtaaaatatttcttttttaagcttttattttaggttcaggggtatatgtacgggtttgctatatagtaaattgcatgtcataggggtttggtgtacagattgtttcacttctcaggtaataagcatagtgcccgataggtggttttctcattctcaccctcctccctctctactttcaagtaggccttgatgtctattgcttccttcttggggtccatgagtactcaatgtttaggtcccacttataagtgagaagatgtggtatttggttctctgctgctatgctagttctcttaggataaaagactccagctttatccatgatgctgcaaaggacatgatctcattcttttttatggctgtgaagtagtccatgctgtatatataccacattttatttatccagtctactgttgatgaaaataagttgattccatccacgtctttgctactgtgaatagtgctgtgatgaacgtatggaggcctgtgtctttacggcagaacagtttatatttccttgggtatatatatcctgtaataagatggctggatcatttggtaattctgctttagttctttgagaaattgccaaactgctttccacaatggataaactaatttgcattcccaccaacagtgtataagtgttcctttttctctacaagtttgccagcatgttattttttgaccttttaataatagccattctgactgggtgagatagtatctcattgtggttttgatttgcagttctctaatgattagtcatgttgagcattttttcatatgcttgtgggccatatgtgaaaagtgtcttttgaaaagtgtctgttcacatcctttgcccattgtttaatagggttgtttgtttttgcttgctgatttaagttctttacagattctggatattttaccttagttggatgcatagtttgcaaatattttctctcattctgtatgttgtctgtttactctattgatagttccttttgctgtgcagaagctctttagtttaagtccatttgcctacttatggttttgttgcagtttcttttggcatctttgtcatgaaatctttgccaggtcctatgtctggaatggtatttcctaggttatcttccagggtttttatagttttaggttttacactttttaacctgtcttgagttgacttttgtatatggtgtaaggaaggggtccagtttcaatcttctgcatacggctagtcagttatcccagcatcatttattgaatagagagtcttatccctattgcttctttctgtcaactttgttgaagatcagatggttgcaggtgtatggcattatttctgggctctctattctgtgtcattggtctgtgtgtctatttttgtcttagtaccatgctgttttggttactataggcttgtagtatagtttaaagtcaggtaatgtgattcctccagctttttctttttgcttaaaattaccttggcaattatatttttggtgccatataaattttaaaatagtttttttctaattctgtcaaaactatcactggttgtttgataggaacaccactgaatctgtgaattgctttgggcagtatggccattttaacaatattgattcttcttattcgatgttttctttttttttaattattatactttaagttctagggtgcatgtacacaacgtgcaggtttgttacatatgtatacatgtgccatgttggtgtgctgcacccattaactcgtcatttacattaggtatatctcctaatgccatccctccccgctccccccaccccacgacaggccctggtgtgtgatgttctccttcctgtgtccaagtgttctcattgttcaattcccacctatgagtgagaatatgcggtgtttggttttttgtccttgtgacagtttgctgagaatgatggtttccagcttcatccatgtccctacaaaggacatgaactcgatgttttctttatttttgtcggactgagttagtttgggaagccagtttttgagctctgagattctttcttcagcttggcctattctgctgttaataattgtgatttcattatgaaattcctgtagtgtgttttttttagctctgtcaggtcattttggttctttcttataacggttattttgtctttcagttcctgtactgttatattgtaatccttagtttccttggattggtttcaactttctcaatggttctcaatggaatctcaatgatcttccttcctatccatattctgaattctattgctatcatttcagtcgtttcagtctggttaagaacccttgctgtggaactagtgtggttctttggaggaaacaaggcagtctggctttttgagctgccagagatcctgcactagttctttctcatctgtgtgggctgactttccctcaactgtggtggctgatgttccctcaactgtgctgtaatttgagtacagtcagttgatttctttcctggatgttttcagaggacgaagtgtttgtgctgggtcattatttgcgctgaattcatgtcctttgtttctcaggggcgttatgttagcaaagtatttttggtgctgaagtttgggctatgatccagtagatggtgcttaagcataatggccagtagttaggctcttgctcagccacaaggctcctctgtgtttcctcctaattgcagctgtgctctctctcagtgctctgaaactgcctgctcctctccaactcaagtactggctgcagatctcagcttggcactcctgggctgctcaccacagccttggagcaagctcaggctttatgctccttctgcagcctggaggcagcaggggaagggaccttggcagttgctgtagcagagggcttttcaccggtcttttggaactccaccccagagaaatgcagagccactaccaattggtgcaatcagcccggggtcaggtggttgtattgtgggcccaagccaagggcctgcctggtgatgagcaggggtaacagggggttgtggctgggacaaactggcttcttttccttagggtggctgcagcttactggagatatgattaaagcactcagggtctttgatccatacctagtccaagggcagcaagggcagtaccattgcagcagccatggcagaggggctttcagttgcctctgggagatccaccttagagaaatgcagagctgctgctactgggaatgttcagccaggggatggggccactgcactgctggcctgagctgaggtccctgcttggtgaagagctgaccctgattatgaagggtcatagatcacagatgatctgcagactgaccaggctgcaaagacagagcatatttctatggacttgagtttctcagaaacaaaagaggaagggactgcttttattttgattgaatttacattaacatcaatcttctttaaacactgccttccactgtcaccaacagaaatacaaaaaaagaaaaatgaattacattgtctcagaagcatactgcttaaagggagttcatttactgacatgggaaatgagaaaatattagtggaaagaacacattgagtctgtctccttcccattgctccacctacggtgggagacctcaccatgatctttcaacttcttttacaattctctttcgctcaccaaatgttgtgtgcagcaccaaagcactgaatatgtagacaacagtggagcgggtcaagaggactgcccttcctgaagtttttaatgcagagaacagatgtgatagaaaatctgagagttttgacacaccaattagttcacagaagaaaaattctgagactcttggtttatgacatggcaatcctgtacgaacgtgatgacttttattttagacggttaattccctttactctgttcaatggccaaaaactggagcctcagtttcactcaacttcttggaaaaatacctgtcattgttcacaaagaggacaggagggtaatccaaacagtttcactttttgattgcttaacaactattagagaaaatgtatcatcacttctgtaagaaaaaaaaaaaacttctaagagtattgagatgattgagtgagttgtgccgtcttcggaggtgaagacgaacacatctttatttatgcaaataaagcaagaatgccagttacctagtggatgtgagaatagtgagccagcactggtaatttaagggatgctctttcagaatgtgttctttatattcgtgaatcattccagtgttctttgcttctaggaaaaggtggttcaagatgtgtgcctaagtgaataccaaaactagcaacgcattgggaataataaagagagtgggcaatattttctttttttcttgtttaaatcctgagtcagctgttctaattaggtaaatggtcttgaacttactaaatgattacatcttttgctttccttgagggttttgaatcaggttgtaggcttagcaggtatattttatttgaatttctcacaaacttttagcagacactagttgtctgaggtactgcttcctctttcagatattgagaaatgcctaaacacctgtaatattcttttccagagaccacatctactttcacgacactatgttgaagaggattcttgaaaattttttataaagtcagacatgcttagaattggggacaaaaatctgtacttggtttgatttataaattatgtcataaggacacaaagtagtgacttagagaattgatgtagcttaccaagatgactttctctcagggaaagtttggatcattatattttaggttctggagctgaatagttggaatatcaaaagggttatttcgaaataactagatagaaaagcacaagtagataacacgtattcaggggctctttgcatgagaaaaatcccattaattcaattcctctaggacaaatgacacagagagaaagagacagagacagagaaagagaaagagaaagagcgcgcaagagagaaattgataggtgggtatatggatggatgaatagataaattcatagattttaagaagataatatatgttctaagtagaaaaaattaataacatttttcaaatgtctgggacatcatgccaaccattgtgtcttacattatttctagtcattaaaatcacttagtgagttgtgaagttttattaacattttacataaaattcctccagagtctcagagatgtgaagtgatttatgagacaacacgctagtatgaggcagaattggaattcaaattagacatatctggctccaaagcccactttctttcaagtatgttatgcatcacagtttttgtattttgttgaatgaagaataattttcactgaattttttgtgttttgtttaatagcttacaatttatgtccagccagagcaaaagcacacagccgaatatgctgcaaacataactaaaagtgtgtttgattattttgaagaatactttgctatgaattattctcttcctaaattaggtgaggatcattttttaattttcttatttttaatattgcctttgtttttatctaagttaactcatttcttctaattatgtcaccatcagttaacagttatccttaagtccttttattctatgccgacaatatcttgggctcaagtaagcctcctgcctcggcctcccaaaatgctaggattacaggcctaatcaaccatgcccagcctgtactgtgttcttatctgatgaatatataatcttgtgtttccaaataaagatgaaagtatgtgcacaaaatggcagagcttggtagtgatggagccacaaatagcaacgtagatcagttgatttcaaaatcggcattcatcccaatacttgctctgcctccctgtcatcagcgagttaaaaaataatagggataaatgatgttgtaagagccccatgtgcttccagtctttccattgttgtacaaggcaaattctagattccccagcagtttaatgaaatactggtgctccttccagcaataattttttctaatacagagggagacatgcattcttcataaagcaaaagtggggctacaaccaaaatggtgtgcatatgacatttctatcaatagtggaaatgctttattaataagctcgagagctattaacaaagactttaaatataacacccatatagatgtttgtagggatgaaatgaaggcagtaagaaaacaaattagccaacagttggcctccctgtatctgtttctgcctttactttaataacttatcaatgcacacaaggggaatgcaaaattctctgcatgggaatggctgtggctcagagcaagcttgtagatgctgcatgtctcttcaatggatacaattctattttttgattgcttaacaaatgttagagaaggagctggaaaaagaaacaagttttcatcaaaatcagaatattgggccaggtgcagtggctcacgcctgtaatcccaacattttgggaggcccaggcgggcggatcgcttgagcccagaggttcaagaccagcctggcaacatggtgaaaccccatcgctacaagaaatacaaaaattagccaggtgttgtggcacacacctgtagtctcagctactcaggaggctgaggtgggaggatcacttgagcccaggaggttgaggctgcagtgagccatgattgtgtcactgcagtctaggtgacagaagacctcatctcaatttaaaaatatcagaataatatttaataaaatattgtacacatgaatttaaagatcctttgccttttatctcagttgtagcacccaggataacctgagaagtggaaatctcacaaatttattactctcttctcctctctttctttctccctctccccaactcctttattctgttttatgtgcattttcaaccctctcagaattaattatatcttagactccttagaggtgacttctgcatttattagactccaaagagttaaatatacaagaattagttagttacaatgccagtactgaccaaaaaaaaaaaaaaaaaaatgagattgcaaaaaattccttttgttcaaggattaagtgcaaactgcactccacaacattatgaaaaatattggcccttgggggagatacttctctacttttgaaatgactgtcttgtgataaaataaccaaacctaaaaatgagataacatgaaaaggaaactactattgtaatcttgacctctacttaagatacatccctcttcattcttttataaaaagctctaagaatatttattttggctgggtgcggtggctcacgcctgtaatcccagcactttgggaggccgaggcgggtggatcacgaggtcaggagatggagaccatcctggctaacacggtgaatccccgtctctactaaaaattcaaaaaattagccaggcgcggtggcgggcgcctgtagtcccagctactcaggaggccgaggctggagaatggcgtgaacccaggaggcagagcttgcagtgagccgagatcgcaccactgccctccagtttgggcaacagagcgagactctgtctcaaaaaaaaagaaagaatatttattttaaccagaaagaaagggccttctcttatatgttaagtgaaaaatcaatttgttttcatttctgtgcctcatttaaattatacataataataaagaaattacattctgtttacagttcattaactggggaagctgtattttggccactaatcatctgagcattttctgtcttgggatttaacatagaactgatcaacactgcctcctcctgtcagatattatgtgtaagactatagaaactcctgtccaacattttagaactgtaagggaatctagagagaatatagtcaactccatgtttctccaaccaatttaatacataaaagcggatgataagctattagattggtatttctatcaatattttatagaattagagaaaaatggagttttatattcttgaataatctgtgtctttggatggaaaactgtatctatacacttggaagctcagaacttctaaatactaatttgaaaacttctctttttcctcacggcttatcccctaaaacacatgtagctaataaaaatgaaatacagagagaaacaaaagacataaaattatagaggcattgccattagtgtccttctttaaaacaaaaacaaagcattgatatctggagccagcagggaatgctctatggaaattttgagtgcattaggactgaaatgttcgcacacatgattacagttctttactctaagaaattatttttaggcttttaaaaaacattcatccaaataacttaatttggtaagaaaagctatgaacaaatggaaagaatgtatttctcactggactctttcttcttctatagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcaggtacagaatcttagcactgaatcagcttgtttttttaaagtggcttaagaccacaggaataattcaaattatttatgacttagcaaataaaaaatagccaactcagaaaaacttgcatgaaaatctttcttggtactaataaacatttagccataaagagactttgaaccacattgttttgcctttaggaaatatgcacgaggccttcatataaatttatgtaccccagtaataactaaataaaggcaataaactaaagacaatttaatatcatttaaataatcagaataaagcaggaaataaatgttaagtacaatgcctgccacttctgtcacagtgacaacattggcacggacaaataaatgttttgacattttctaggcctctctaccatacccataagaatgtaattatctctttattgcttataatttcagtggtttggaaatattgtgaccatggactggtgggaagacttgtggctaaatgaaggatttgcttctttctttgagtttctgggagtaaaccatgcagaaacagactggcaaatggtgagtcctaaacacataaacttgaaatctctcttttcctcatgcaaagcagatggaagcctttggactatgataatggtcccgagtcagatggcaagtacagtggtgagcggggaattccactgtgaggatagggtggagccagctgacttccactgactacaccttgccccagtacctagaagggcagctgatcatcacaatctggggatatccttgacagagtcactcaaaacacattatcaaggcaggaaaaaaaaaaaaaaaacaggtggcatagaaaatgttaactctgtgttccagaaagtatctatagcactaaccctttgaaaaaatgtcggagtctcatttgtgaacgacttactttatttcagacagattgcagaaacagtgtgatgaagagataacataaatttagtagttagattagttagattgaagttcaaatcctgaacacatcatttcttagatgcatgacagggaatatgaccttgagcaagttacataatatctgagtccattttctcctttatgaaatagaacattattttctatcttgtaagcttaaaagctcccaaatgtgcatgtaatgactattaacaggtagtgtgtccctcagaggcctggaatagaaacttttatgaaccctaaaattttttttcagaaaagctaggtatagttgttatttatatttatatcatgggagtattcttgattgcatatatgaatgtgcaaataggtggatgtgtctaattacaagaggttttgtactgtgtaaaatactgccctctactggacagaacaaaaaagttaaatgcttgaagcccttacagtttctgtagcctgctttacaaagcgaaaagcctaatttacaacaattacttctttaaaaatcttatctacatctggatttttttcaactatggaactattgacattttggagtagataattctttttttgtgcgggactttcctgtgcgttataggatacttagcatcccagacttctattaactaaatgccagtaacctgccagcccctgttgtgacaactaaaaatgtctccacatatttccagctgtctcgtgggggacaaaaatctcctccagttgaaaactactcatctacatggaaaattgctgattttataatttattgaaaataaactgtataaatggaaaattgtgttgtcctttattttctcccatacagtatactgaggcccttatagcaaactgttataagaaattataacattttaatattgtctaatattccaagtactgtgtttcaaaagcaatggctaaattccagaagaatttgctgtgcacttcttaagtgaaatttaatcacatcgttcaacacaacaattaattcattccttcatctattcattcattcctttttttttttttcctttttgagatggagtctcactctgtcacccagactggagtgcagtggagcaatctcgggtcactgcatcctccacctcctgggttcaagcaattctcctgcctcagcctcctgagtagctgggactataggccctcgccaccactcctggctaatttttatatttttagtagagatggggttttgccatgatggccaggctgatcttgaactccttacctcaggtgatctgcctgccttggcctcccaaaatgctgggattacaggcgtgagccaccgagcccaacccattcattcattcttcattcagcaaatggaggactccaaaatgaataatgaataaaatacacttcttgcccttaaggagttctcaatttaaggtcttgtggatggaagggtcagatagataaagatattttataagcgagctcaataaataccacaatcatggaatacctcgtttcactggtgaaaaatcggaaggccaggaaaatgatagaattttccaacatcacagagataggtggtagcaaaatccaaaatcacacacacagctggtagcaaaatccaaaatcacacacacagctggtatagtcaatcttcctcacactgagaacaggatctttctactcaccatacttaaacttcctaggtatacaaaaatcaaaatgcaagtcaaaattatcttgattggcagtcatcacttgacagcagtacctttcctgttataaatgaaacccgcataattggaaaatgtaagccaatacaacatactcctgttttggaaatatttttaattaagtagagccaatgaaatttttaaagttagtagtgatttagcagagttagatttcagaatcttactgcttaagagtcaaaataactatagcagctaatgggttaggttctcattctgtgccaggtactatgccaagtactaaccatgaattttatcactgagtcctgtgcacagttccaaaaagtacaggccataattacttctatttaatgggtgaggaaacttgcttaaacttatatatctagaaagtaaaaagactgagctttgaaccaaggaaatctgacagtactgctaggcctgtcaaccagtctgtattgctgacaagacctaggagggaaacgagaggtgattagaactaaaggataaactgccaatattttctttcattaattatgaagtatccaaattccaataacaagttaatattagaaaaacctgaacatcaatatttggcaaattgatatgcaacctctcttaattcttagaccaaatctgtggagtgatgtcatcattctcattgcacagatatagaaatagggcttgaaaagtttggcacatatccaaaagtcacacagaagtcgcagaagcagaattcacagaagttgatgtcttctcggcctgtcatctgggggaaaattaaaaggaattagaagtagaagaagggcatgaaatcaatatagctcaatcagtgcaaagtatgattaatttgaagacctaatgtttaagtaacttaagtcatttatatttattttcctccaatttttcttatatatggtattttagtttataaactagtataaaggaaatactatattcctttggctcattctttcatttcagcgtgaccaaatgttacttgaagatgtattacctgttcaagaggatgattctttgatgtcttcgcatccaattattgtgactgtgacaacccctgatgaaataacatctgtttttgatggaatatcctatagcaaggtgggagaaatagaacattgttttgaacatcttcctgtttagtgacttttcttttagtggatacctaaaaatggtaagaatggtcacactgtgccagtgagctttggaaaacagtgtagaagttattctgagtgctgaatattcaatagtttgtacttttcagtataatttagtgctggtcattgtcacagaattttaaaagagatttttaagaatttctctttacacatttgtatataattattttcattctgataatttaatatttagacttgaagcatcacatttcaaattgttttatttgattttttaaaagacaataaatctttttcttctatgtggtcaacaagaaatgctgtatatgtgcacagctttcctagtagaacattttaatgcctgcaataaacatttaaatccaactcagaaggaaatacttttattcctttttagaagatgtaaagatgaatttgttagcatattgtaggtgaggattttttcttcactaatattttatgaaaagttgctggaaatctgtaactccaagatttatgtgacacattctgtcccacaatatttcatatagtctctccttcaaacatattccacatctgtatgtaacataatttaaattttattttagtcattttctacttcagcttctcatgggtttcccactacactgagatgcttagaagctactgcatgctaatacattttgttatcctgagtaatacctaaagtcttatttgagtcaaaaatattataattattaaaatgaatacttgagtgaaaaagcttctatgtattagcatttgaaattcttagcatcatatttttgactttccctctcatatgattcccatggtgtatgttcagccttcttgtattcatttttctttgatattatgaatgattccttttatctttatgtcgaaatgaaaatttcgaatccacttatagcctattctaattattcacatgggagaagtttaaatttattcaatcatttttccccttagtcctagatactcctcaggtttaagatattatgtccaagataaataaatgtttctaggcctttagctttctaaataggtataaaattaatttagaatgcttaataacttacaataaaaattactaatttaagtgggggcagtgttcttttttcattcagttacttgaaaattgatttaaaatattacaaattgtgcatttcagtactaaccttataacacataaaaagaaagtacagagccaagatgttcatcagattcttcagatgaaaggaaagcaaatgagatagactactgagaagagaaagattatatgcctaaattatgtatccatgtatattaagctatttgaccagataattccttgactatctacttccctctgctaaatataattcttattttcaaatatgaaaatatatttaataagttggcagaattttaccctgaaactactttcctcattcatcaaagaatgtgattttttagactatttctctttcattaagaaagccccatctgctggtttatttggggaagtgcaataattatttgaatctgaagtccctgaaatgatggccattttagcaatttctctttaccttttagttattttagatgcatagatacagggactgtgccaagtggtattttcatcctaaaatcatagagccatataatttagcagaatcatcttgaggaactaatctcacaaatatgatcatgaaatactagttgcaagagtaataactgatcattgttccttacatagcctttattagtttcatttgtctttttatccccattgtagggatcttctattttgagaatgcttgaagactggataaaaccagagaattttcaaaaaggatgtcaggtatgatttattacttttagtgatatcaaaattaaactacattgatatgtggctggtgaatgttaagatatgtgattaatcaaggataatttcctttttaatctctttactgaggcatagataatatagcaaaagataaaaacatgattttacatccaattgagtacctacattgtatctgtaatgatcatttagcagaagtctcatggagaagttgaaacagattacttagttatttttgaaactccttacatgtgtcttagtcagcttgggctgccataaggaaataccatagactgggtggcttaaacaatagaaatgcatttttcttgcagttatggaggctggaaagtccaagatcaaagtgctggctgattccgtttctggtgaagcctctcttccgggcttgcagatggtagacttcccactgtgtcctcatagcagagagagagagagggagagagagagagcactctggtgtctcttataaggatactggttccatcataagagtcccagcctcacgatatcatctaaatgtgacagctcccaaaggcttcgtttctaaatactatcacactgggggttagggcttatatgaatttcagggaatacgattctttccatagcaacatgatataaacatctaaatttatctataaaggtcattccttatactgagtacaagacttttcccttattattagattagaaaagatcaatattagtatgcttattacaatggagtcagtgaataaagaggcttgcttccttttggtaacagaaatgacaataaactttctgaaacatttcacacatcccacttaagcgtattattccaggagatgtttctgtttcattttcgtttttctaacagaccctaagccaatcgtcccaggtttgtttttatttttaattttatcaaagtagctacaatgtgtccctataactgccgtctctgcaggttggccccattccagcctagaaatgaagttctcttcctactctttcccttccacctacatcctgcctgctgcgataacccaggtagtcaggagtagcagtgctgacggtattcatcccagagagcagaaaacaggttggagaaatgccccctgctggctgccacagaaagtacttcttctgtatgtgattccccaggagaaggtcaccattcacatagatctcactcccatcaagccttcttatgtggcatttagccctctctacactactctaaaagaaaacggcccccttctacccaatagtgaaacatctaggtgattattaaagtaagaaataaagtcaagatttcggaaatatttggaagtatatcagtatattttaaccctttgtctattagtaaaatattttgtagagacattaggtgcaaagagagaagctatgtgcttgtgcttctgcatcatgagaacatcttgtaacttttccataagtttcaaactcaaatgttatcatatattccctcactgtaagcattattattattattattgttattgagacagagtctcgctctgtcgccaaggctggagtgcagtggcgtgatcttggctcattgcaacctctgcctcccgggttcaagcgattctcatgtctcagtctcccgagtagctggaattacaggcaccaccacacccggctaatttttatatttttagtagagacggggtgtcgccacgttgcccaggctggtcttgaacttgtgagctcaagagatccgcccgcctcggcctcccaaagtgctgggattacagccatgaaccactgtgccctgcccattgtaagcatctttaatcagggactctgtcttctatatctttacccatactgcagggcctagtttaattacacatgttacgtcatcctgaaaatgtttgttaaatgaatgaatgagtgaatagcctataataaattatacaggacatagaaataaagaagattcattttcaaaaattaagttaaaattcagtttgtatagttttgattctaaattaaattgtaattaataaataacaattttggcatcttcagagctggcttcaaattaaataatctttcatattgactttgatagagaagtactaagattccttgaaaatgaatagctatcctaataattccataaaactctcatatttcctttaacctagtatctatgttataattaatttaaaaaaccggttttgtctaaaattaataattcttaagttaaaagtcttcctttaactgtgatcacagatggtgctaaaaactgaactatgaagaatagatattaatatttcatgccattatagtgctatggaatgaatttacacaaaacacccaaacacccttttccttcaatcttcaaacactagctaatatctgaaaatagtatatgatcgatatggaccacatcgaataaaccctcagaccaactggaacatagttccatagttcacatagtttgagcatcccaacaatatcctccttgagttgtcatcatcactctatgattgttgccctgaaatcccacaggctatgaatgggagttcaaggtatttctgttgcaaatactaactttctgcccaaagtgactctttattagctaacctggtgtggaactaaatctggggctggccatttgtctattctctttcatgctcatcaccttgccccaaactcaacctcaaacagcaaaataggtgcaggatgggggaaataagagcaaaattatcaactggaaaatctttaaggctatacatgtacataaaagatgtaatagagaaggggacattcataacaatatgtggtcatgaaatagaaaccgagaatatattcttcctttctttttcttctagtatcagtagtactgtcaataagacaggaatgggtcagctggaaaatgtcttttcccttcttgggatactagtaacagaaacattgttcgtttccttttgtgctcactgattccaactaataatgaactgtgacctaggtcatcgtgtaattttgacttgaatgattacatgattattcaaggtgaagagggaagtgtcttaatatagaatattcaaaagcactaatctagacaatataaaattagtaccttttaatatgctgattacataaatttccattcagcctgtggttcatgagaagcaagaaactgcaattttaaaagcagtaacaacaataacagtgatgaaaaccacacacactgatccagggttcagaattctcctcatcataatctcaggcaaatctcttcacctctgaaggcacccaggtagttagggagagcagtttccttcacctcaaaatgtgggagctttattaaataatatttaaagtcccttccagttccacgattgcatggttctaagctcaagaccttgtagtagtcaaactcctctaaattaattttaaaagatattcaatagaaattgtcatcaaaacacagctatggttataactattactatgccaagtattcaattattattatttaaaaatattagacatttgatttaccaaatattcaattattttattaagatatgatgaatgatttgtgcaactttctgtaatgaatacctaaaagtgattgctgcttctcccttcctttgcctgccctctggtggtagtgccaagaagtgaattaaccaaaagaacaaatatggaggcagcattccaaagtggcttcatccctcttccaggcttcttggagtccttctaatactgttttatctctatgtctgaaaagaagaggaatttaggaggtaacgtgatttaggtacagcacctactgaaaattatagcaacttagagtgaaaatgatatgtgcaaagttaacattaagaacactgaagatggttccattttctatcaaagacctccactttcagtcaggacaattctagaaagcaacagaggagtgatacagcaggaacttaggaaagtttactggcaaactccaagtggctcccagttacgggattagaagactgggaattttttctggggataaatcacactatatttgaaaactcacatatagaaagaggttttgtaaagaaaattgccaaaagaagcttaaatctaaaagacttgtactttaaaatatttgaagagtgaagacttatgctttacagtgaataatgtccccaattcatccaccaccaccaccaccaccaccatcatcatcattattattcaaaaggttgtatatttatttccttagagcagagatcagcaagctactgtctgctggccaaatctggcccaccatccatgtattttttttaaggctcataaactaaatatggtttccacattattaaatagttgaaaaaaatcaaaagaagaagaatattttatgatacatgaacattgtatggaattcaaatatcaatgcaacagccgtgctcattcatgtacatgttatctatggctggttttgcgcaatggaggtagaattgagtagcaggggttcagttcatcttgtgaaagtatgagaaaagcaaacattgacttctaacatgctgattattttttacacacagatgtacttggaaaaataccaattcaagaatgcaaaaacttctgatttttgggcagcactggaagaggtaaggaagagtatatgtccccaaatatttctttgtctgatttacaaatggcttaccaatcattttctaatctaactattctatccttttattttctcatatttgttaattaattaatctccattttgttttcaatcttaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttgggtaaggctctataatgcattgaaaaaaacacagaaatttggcagaaatattggtaatttgtttatatcctattgttgagtacatgatggatgagtgatatacaagtataaagccacagtgcctttaggggaacaaggaattcaaaaatagccaagtgatttccaggtttgaaatggtgggcagagcacatccatccgcatcctgttctttacagatattgaagagaggaatggaattacctaaagaaataaacctacaagaataaagaaaataaagggaggggctgtaagtgtcacagagttctgaagaagtaaagcagaaggagaaatacagactgaggaaaatacaaccagataataataagggaacttccctatccctagacaggttctaggtacagtgttagcatgaagactgaagggtaagagtgagaagtgaggctggaaataggacaatgaattgaaagtctagtctcaggacaatttgtgccagctggacccacccctcacccctactttctctccgccacctaccatttctttctctgcacacagctctcagaaatctggcaatggctccaggaaaaaatacagtgggcttgtttcctaaagaaattgactaaaacagtagaggagagctaaggatttccatttggttgagactctcagagtaaagcctccctcattatgttatttgcaggatgggtgggctggagctgacagcacccctcatacacacaggcagagctcccagtcagaccttctgctcagcagagaaacttacttcaaaaatacaactcccttcagcctgggcaacataacaagagcctgtctctacaaaaaatttttaaaaaggcactggagtatggtagttcatgcttgtagtcctagctagtcaggaggctgaggcatgaagacgacttgagtcatctcaagtcaggagtttgaggcttcagtgagccatgatcacaacactgcactccagcctaggtgacagagcaagagctcatccctaaaaataataaaataaaataaaataaataattatatatatacacatatatgtatgtataaaatcccttctcgataatagagagagtacacgccagctactagaatcaatttaactctttcttaaatatgaatgacaaagatcacaagatacatgaaaaaatttggaaggataaaaggttaaaatttcatgtgaacaaacaactcctgactttataagatgcataattaaggaaacaaaataaatgtatgagatgcattcagagatgaagaactattacaccaatgaaccaggagcagaatgtcttagaaaggacaaattgagaacacaaaagaacctgaaagattagatttctgattctcaaaagaattaatagaccaactaaaaataaatttggcaaatcctccaaaaatacagggcaaacacacatagagctagcaaatataaaagagaagacaaatatgaacagtctagcacccaacagataggtgtttttattttttggcttttttttttttcgagacagagtctcactctgtcacccaggttggagtgcagtggcgcaatgtcagcccactgcaacctgtgcctcctgggttcaagcaattctcctgcctcaacctcccaagtagctgggattacaggtgcatgccaccacacccggctaatttttgtatttttagtgaaggcggagtttcaccgagttgaccaggctggtcttaaactcttgacctcgggtgatccacccactcagcctcccaaagtgctgggattacaggcgtgagccactgtgcctggactagataggattctttttttttttgagacaaactctcactctgtcgccaggctggagtgcaatggcaggatgttcgctcactgcaacctctgcttctcgggttcaagccgttctcctccctcagcctcctgagtaactgaaactgtaggtacacgccactacacccagctaagttttgtattttttagtagagatggggtttcaccatgttggccaggatggtcttgatcttctgatctcatgatccatgcacattggccttccaaactcctgggattacaggtgtgagccaccgtgctcagccaataggcgttctttaaaaggaaaacagagaaacttggaggcaaataatatcaaatacataatagaggacacaaggattctgattaacagaccccacttagtaaacagtacaaacaggaaaaaccaaaaccccaaaacatacatagatacaccctcacaaaatttcagaaaacagagacataagttagtgtggcattagacttctccacatcaaccctgaatgcaagaagcgaatgaggcaatgcttccaaaacactgaagcaaaaaatattttcagcctctagttctatacccagtaaaattaaaccaagtgtgaaagtacattaaagacgctttcagaaatgcagccccagaaaatgatttccacataacacttttttgaaagttacttaaggctgcactttagaaagggttttgggggttggaggagaaagagaaagaaaagaagggaggatatgaataaataaaaaaaaagtgaaatacatgggacacaggatccaggaaacggtacatccaacctaggaaaaccacgaaaggaaatgctcagggtgctgtgagtgcctgtaagggcaggatgactggagctgaggtaggcgatctccaggaaaaagagaaattctctccagtgggtagtgcggttgggaagatgaaaaaaacttgaggatttggtgaaagcccatccgtttggtcaactataaaaaagaaaattagaaaaaacccaaatcaaagactatatataaaaattatgatccaaaaatatgaagcggagttctcacaagatctgatggttttataaggccattttccctgctcttgcttgctctctctcacctgccgccatgtaaaatgtccctctcccccttctgccatgattgtaagtttcctgaggctgccccagtcgtacaaaactgtgagtaaattaaacctctcttctttattaaaaaataacaaaaatatgaagcagatagaatgattttatgccattgatacagtataagaaaaggctctgatattagagaaattttacttaagtggctcaggggccatgaaattggaccatggtgtaagaaatagatctccccacactccttgaccaacactatatacaatatacatgctataatttcataaatattaggtattgacttttaactttataatcagccaatggaaaatgtaaacatttttgttatggtggcagaataaattgcaaatataaagtcttgacattgtaacaagaaaaatcaactgacaaaaaaaggacatggaagagggagaaaaggtgggagaaagtgttgggatactacttcagtggtgtgcaggaacggctgtcttcccaacttagtaacattttcttgtcagtgacatgttggtagcttgaaaatgctcctgatgggagtattacgtggaaatgagcaaatactacgttttgcccatatgaaaactgggtgttaaacatttaccagtactccagtggatatcctcatttaagtcaggagagtagttaagactaaaatttatgaagcaagaaatggcagtatgagtatattatttagaggcacaattacaaactacagaaaatctaaaaataattttattttattaaattttatattaaaagagaaatggaagagaaagtaatatatatataagctcaatcaccctcttttaatgggtaagttaataaatattgtctaaataaaacaacagaggcatttaaagtccaattagactacaaaagcactaaaaccagatcacttaataggggatgcttccgagcagggctggcctgtgggaagggtgagtaaggagatggtggtttttcaacactaactttttaagtttttgagtagtgatgaatttatctacaaattgcacacattaaattctcctgagcatttaaacagcacttacaaacttaatcaagtcctcttaaggatatatcacttacaagaaacttataaatgtaaccaaattcttctaaacaacactagctaaaattttaccgaattcatttacaatttcaaaatacaaacaccaccaaagaagcagatttataagtctaattaaaattttttctatatattttatgaatccaacaaattaaaactcaaatatagtgtatcaaatttcttgcacattttcattatgttaaaaatcaaacccttaacaggatttttctagacatttaaatatggctactgagttaagattttctaagtatttcaattaaaacaattccagtatgtcattttctctactttgccaaatgtatttatttatttaatttattttctgagacagggtcttgctgtatcacataggctggagtgcattggtgaaatcatagcttactgcagcctcaatctcctgagctcaagtgattttctcacctcagcctcccaagtaactgggactacaggtgctcaccaacatgcccagctaatgtgtaaaaaagtttttgtagagaaaaggttgttcaggctggtctcaaactcctgagctcaagcgatcctcctgccttggcctctcaaagtgttaggattacaagtgtgagccatcgcagatgacctcaaattttaaaaaatgttttatatattgtaaaggctgataaagcatgcaaagcacagctgaggatttcaaaacttatcacacctgcatgaatacaacttgcacaaaaatcttaatactataaacatttctgcataactaaatcgttattttcgtatgtatttcttgggtgccagctgctcccatctgaaggaaacaaattcaaaatctcaggaactccagtcccgggcctggccccaggagctgggatgtaccactctggggacatcttcctagcccgggttacccagctgagcccctcctagagtggatactggcagcgtagcacatcactagtcctctggacgttgttcccatttcacccatgcccagtttttattgccccctctttcaacatttgaatgctttgcttgagcagagagaatcttcacccgttcccacccacgtgtcctctaatctccactgcctgattgtcactgaagagacactttgtcttctttttctccttaatgacttcattgacattattttatagtcacatatataaattattgtaagatcaattatcttgtagcaattagaataacacaaaaagatgttttagaaagtctttaactctaaactggttcctttatagttactggtctatgttctagcaaattaggttggccaactctaataaccactggaatatttggatattaaatctaaaaatatgtctcttgtcaaacaagcttccatttggaaagtttcacagtaattattctctcttactatatgagtccactgatttgctgagcctcaattaattgggagagggaagcaggaggtggagtagggcagggagggtcacagaaggctttcttttccagggatgtgatatttaaggtgagcaaattggtgtggggaagtgactgctctggatgttcaaaatagaaactatggccgggcgtggtggttcatgcctgtaagcccagcactttgggaggcctaggtgggtggatcacttgaggtcaggagtttgagaccagcctggccaacatgatgaaaccccatctctactgaaaatacaaaaattagccgggcatggtagcacacacctgtaatcccagctactcgggaggctgaggcaggagactcgcttgaacctgggaggcagaggctgcagtgagccaagatcatgctactgcactccagcctgggtgatagagtgagactctgtctgaaaaaaacagaacaaaccccccgccccaaaacagaaattacagcgtatatgaaagcccaaagtcttatacacatgatttacaacacttattgaacattgaccaagtggttggcactattttaagcacttcagatgcattttattttatagtaaatgaggaatttgtggtaaaagtgattaagtaatttcaaggtcacacagtgtaaataatggaggcttgatgtaaacccaggcagtctggttccaagaaacgggatagcagagagtgactgggaaaagtggtgtgaggtgaagacgaagaggaaggcaggaaccaggtatgcagaccatgttaaagattttgaaaatagtatgcaaatttaaggattttaaggagagaattggcagggtcacatttacatttttcaaagctctcctcttgctgcactgtggagaactgatcacagatcctgggcagttggggaggagtggaggcagggagaccagttaggacaatattgcaatgagcagcccacgtgatagttgatggaaacaataagcctgggctaggtaggagtggctgtgggctggagggcatggcagatgttccaaagattttattgagctaaaattcctaattaaagaacaatgtggaaggaattcaatcaggtgaattggcggagaacaatctccttttagaatattgttctcatcttgcaccacagtgatcgtagccatatttattcagaagagaaagatctttatagtctcatttcatgatgggtactctataaggggggtaacagagcctgtttcctggattacaattcagggcttggggaaataagtcacactacagcacactcaggtgtttccaaaaattaaaattgccgaagcacttgactttccaaggcatcagagaatgatgaactctcagaattattaaattagctgcttccaagatgccagttgacacctgaactggagaagcattgagaaagccgttgtactcaactcgttgaggctcatttccggcctctcttcctggaaacctcagacacccagcctcccacactaagtgacattcagagaaactgggtatcctgctataatgcgagttctgaaaatcaataggtcacaccacaacaaaggaaaatttgactacttagaccaatatgaggtcccttcagggagtgtctgtatactccctgaactctgcaggtaagtgtactccttacctttattttagaaaggaaagattagatgatgatggagaaaacatttgtttttcactttttcctcttcatgatacatgaattgaaacatagatctgacttgttttcaggtgataattcaactacgaaaatcatagaataatctctgtggtagttctgctaacaactataaagtgtttcttttatagttactgttttgtgttctagcaaattagattaactatttaatactgctggagcctctggatattaaaatttaaaaagtatttctctcttgagaaataaacttacactgggaaaatttcccagtaactgttacttcctctcatatgtatccattaatttgttaagccaaagacagtcaacaatttaagccaaagacagtcaacaatttaaactaaggagtttttttaattaatggggttggatttttacaagctgcttgttggttatgaatttctcttcacacaaaccaaacaattttactgccaagtgaactaaatatatcatcacggtataaaatcaatttttgtaacagtaaattttaaaattttattcaccaagacttagaacatagaactgtattcacatttatactgtctttaatatttgtcttcagtttccaccttcagatactattttcattttatttatattcttagttgcatgaatttttttgtgatggcttatcataaagttaatatgttcattctatttttattttttaagaagtcatatatgcataggaaaagagacttagaaaagaggttcttctctgttgagaaagtttgttaaaaatccgtagtagctcctgaacaaataagaaagaaccattatagcaaaaggattcttctttgtttaaaagaagaatttgatcataataaatgccttcatgcacccataaaggaattagctttttttccaatcctaacttccatctactttctgttcagatgtgttcctgtttggtagacagtgtggccagttaagttgtactgtgagttcaatgatcttctataaatattttctcactgtttaaataatccaagattagggaattcttactgactagaacctttttataattcaaatggctcacccatgtataagttattgctttaacaccatgtcctcaaccatctcttagaaatgagccagtttcacatctccatcccgggatgtctctctcaggaaagcatatgtgcctttgatagtccactccatgtaaacaggcagagggaatgggagtaagtgtgtcagcttggtgcaatcaaagtcagtttccttagagaaaattagagtggccatatttcatactgctagaacctcttacatggttagatagtgaagaactatgtctataaaaatgaatcctgatactcctgaatgttagccaatatgtagaaaactcaatcgtttcatttatgtaatttccatttcttcacactttatactctcaagtctgtgattttactcagcttagattacattagatcatgtgattctaaaactataaaattgtatagcctcaactttctatcatttttatcttatgatactcttaaagacctcagagcagtatttttgtacatgagattaggagaacagcttctgcccttttgaggcctggtgtagtcccagaggccatgttttagagaggatagtcaaaataggaaaccttaactgtgggcctaggtcatccagacgctgcctgctctgttgtttcagtcagattggcattggggaaagaagaggaagcataaaatgtgagtttacatggcagcaccaattcagcagaccagtgcaagtgaggtatataggtaagatgtggcatcttaggaatgttctttgtcggtcttctgagaagctgcaagggctcttagtttggtgttcctagaagcagaccccgaaatgatcatgtgtgtgaaagtgacttgttagaaagtgtttccaggaaagatcagtgggggagcaggcagtgggatagagaaggaaaggaagcccagcaaaggtgctgtatgaagcaggtcctgaagagagtaactttgacttagtcctgcaggaaagtcctggagccagtgcagatcatacttcagagtgctcctgatggatggggcaggaagcattctcacacctgtcactcactgttaagggccacatccagaaggacgtaaattcccaggaacttctggctttccttgctcaggtagctggaaggcagtcctctgtcagagagacccaggtattgattgtaggcagggaaagcacactggtatccaaggtgtacaaaaatgacaaagggggccgggcacagtggcttatgcctgtaatcccagcactttgggaggccgaggcaggtggatcacctgaggtcaggagttcgagaccaacctggccaacatagtgaaaccccgtctctactaaaaatacaaaaaaaattggttgggtgtggtggcaggtgcctgtaatcccagctacttgggaggcttaggcaggagaatcacttgaacctggtaggcggaggttgcagtgagccgagtccgtgccattgcactccagcctgggcaacaagaatgaaactccgtctaaaaagaaaaaaaaagagagaaaggggtctaaggagataaggaggaagcactgacagtgtccactataaggcccaagaagcaatttatgtgttggttttatgaaacgtatagccaaaaacattccactgcagtaaaatgctccaaaggagctgattttaaaaaaactcaatcctgtaaaacacttcaatagttataaaacaagggattacttctttcaggtatatagcaaaaatatattctccttgaatgacatacattttgttatatcttgaaaaggtgaaatgttaaccctaattctctgttagggaattgaatgttgacagataaaccaactttgagttgaaacctaaaccagccaatggtacgtagattcaccttctctccagatctgcattttctgatatgagatgatataagaacaaaccaaaaaaaatgagatttcaagacaaaactgttaagtgtatatatcaaaatacaaagttaactcccacctacccactctgcaggaaaatactaagtagctaaagagaagcactgaaaactcctgaaacatgcttacctgatgattcttcccttgagcacttcagttctagttctaaataggggatatttaggggagggtatgagaggctttaggggatgatggtggtggtagactttcagcataatttctaaaatgtgttatttccttcacagagtttactatttgtcttctaatttctaaaaatgttttgtgttccttgatggaaatggtagcatattagactgtgtgcaagtatgtgtgtgaatgttcaatattataataagatgtattatatttgtgtaatttatgcaatatctttattctaaaatgccaaagcatgttattgaaataatctttttcatgcttagctaatttttgatgcaatttctaaattttatagatttatagaaattgaaaacagttacacagcttatcttcatcactaaaatgttgtattaactacattaattgtgtagtatggactagataatcatttaaaagaaaaatatacttgtctattgctttttagtgatttttactcttgaaattttatcttttagtaataaaagttaaatttttctttttaaaaaaattttagttatacatggaatatcccagttaaatggactgaagataatataacaagcagtgtgttatttaataggtcagaaaaagaaggtaaatattattaattgatttatttcttctttgaattgatgtaccacattaaactaatataagtataaagatgcaacagtaaagctggaacttatgtaaacttcagctaagtgatctcttaaataatttattgatgattccaaatcttcatctacaatcagaactgttataccttgagatattcttttcaatgatttatcttgactgactgatttatcataaatacccatatccaaaggagaagggtcgcatgcccaacaattggaagatcaatgtgtaagtttccttccttccttccttcctttttgttttttcttttatcagataagccattgaatttctttaactgttatatgacaagcctgaggatttttttaatgctcccattaaattagaccattttttggaaatatatttgtgttctatctgcactgatttattttttccttacttgaaaaatgttagggttgtataaaaacaagtaaaccttctcacgaaattccagattgatgaaaaaaataatagataaggcaagctttagctgcaatcttggaaagaatccttctttttatattttttccattgtatttgttttggtgtttcaaaactatttcttttctaagacaaaccagactcatctttgccccatttcatgaggacttgatttagaatagtatttggtatggactttcacttgtgtcttcttgaagataaaagtagatcactcattctttatttacatatgcctagttgctcatgtaaaatattttaaaatattaatgaggtatgatttctcctggccaataaatttttactctgtttccagtagattgccttttaagaacagctttactgagatataattcacataccataaaattcacctatttaaagtgtacaatccagtgttttttagtgtattcacagatgtgtaatcatcaccacagtcagttttagaaaccccataccctttagctgtcatgcctgcagcctcccatatgcccagccctaagcaaccactaatgtattccctacctctatagatttgtctcttctggtcatttcacataaataaaagtgtatatgcagtattttgtgacttttcaattagcataacgatttcaaggctcatccatgatatagcatgtaactctacttcattcctttttattgccaaatcatatcccattatatggatataccaccatttgtttatccatttatcagttgatagatatttggatcatttccaccttttgtctgttatgaataatgctgctataaacatttgtgtataagtttttctgtggatccagcatgttttttccacctttgggccttttaaaaaaaaacgtttattgttaacagtttttgtgatttttttttactattactacaaactaccagctttgtcattatagaggtgaaatccttctgaagcccttctgcacagggattgctattacaacaaaactctctcttgcttatttatgttaataattattgtaatatcgtgatcaaaaaaaattctaaatttttgcagaattcccagatcaatgccactttgttttagtattttatgctgtgtttcaatgcgaggctctatcttttgtggtcttctgaccattttcttattcataagtacacttgccagaggaaaagggagaagacagaaaaaaaaaagacattttcaacaatgtgtaacagcactggtaaaaggcataataagaacgttagaattccactggaaggttttcagtggatttggtttaactattactaaatattttccccattggtcaccatagttaattgaggattggaagaatatctcggcagctgtttgatttactgtttacaagtttgaaagcgtgaataattcatctaccctagtacaattcacccagcactttcatggaatgaagtttccatacaagtgaattttccagataactaaagcttactcaagtgctttgtaaaatgcatttcaagagttcacaatagacattgttctaatatgtgttatgtactccttagaatatttggaataataaatttaatccttaattactagattaattctttcaagcacgtattgcttatgtgcaaaacacagagataagaatgggggcagtgctggagcaaaaaaaaaaaaaaaaagcaatcctaacccttgtgtagatggttgtctagggataggtttgcaggcagacataatgctgtgtcctaagtgcctctgtggcaatgcagatcaccaaaagcactcatagaagcatcagcccaggtttgggggttcaggaagcattcctaaaaaatatctaggctgagagttcagaggctaaagatagagtataaatgggtgataaaaattgaatgtagaggagacgtgtgctctggacagaagcatgactgtgaaagtgaaagagcagggagttctcacactccttcgtatccctttgtcaatacatttcacacatttttttgttctaactattgacctatctatgtctcccctccccacagaatattcttagaggaaatggagcttatttgttattgttgttctggatctacagcaggcatctaataattgtttattgaataaatgaatgaataaacaaataaatgaagaggctgatagttacagagctttgatgacaaatctgcctttatctgaaacttcagaatcatgtctggtcactgagccagaagcaaactagaggtctttttctacttcaaagtgtctgctccatttttaggctgtacaataagttcctgtttcctgtttgaggacatcttcagctctcagcttagagcacggatgacgaacatgtcctgagtgtactaaatgggcaaccagctcatgttaccagtcctacctccctcctcttggtttctttgatgattcattagttagaaattcttcaggcaatagtggactctccccaaggtcttttatttacatttctattgtatgtgctattttaggcgttaaaacaacaactaaactcataatttctaacgaaagaagagaacctctattataaaacattttctggctactccagttaccctgaataatctctcctgtcatcatctcctgtcataaaatatagtatattttatcctgtcactttcatcagcccttattcctagtattattactttatattttaaacaaaatcattgttattaagcttcatatgttctctcttttcgttctttcttttttttttttttttttttttgggacagagttttgttcttgttgcccaggccggagtgcagtggagcgatctcagctcattgcaacgtccgccccctgggttcaagtgattctcctgcctcagcctcccatgtagctgggattacaggtgcctgccacctcagctggatatttttttgtatttttagtaaggatggggtttcacaatgttggccaggctggtcttgaactccagacctcaggtgatctacctgcctcagcctcccaaagtgctgggattataggcgtgagccaccgcgcctggcctctcttttttttttctcaactaaattataagcttcttgatgacacaaactacacatatttcttgtctcctgtccaccctattatcaacaaggtgctacgtacattctgagttcagaaagtcctagtttaatgaagggttgtttgccccagaatgctgtacttttagaggttaactgcatatattttagttatgtctccatcttttagtatcagctgctattttggctattgttaatgcatccacatttagtagcataccacctgtttgcatttaatttactgctttctaacatttagaaggattgaaggttgttatatggtgtcaggtaaccaatcttgctaaaacataatattttaaaagagacatttctaagtgcataggatctgggctgggtctaagttctaggaggtggtgcggactctacaatagctgtttttgcaactcttacttccagatttgagggtgtcctctggatggtttggactatccagactgtccagtcagtttctatagaaatagatttactaaacatctgtgataattatacataaatatttaataccaaaataatgatgggcatgtatttttgtatttgatgacaaagagggaagcactttcttcattttttcaagctaagcctcatggaatgtgcaagctttgattggatgattatgggttcagttttgctggtttagaaactcaatttgtcagttcagccctagtcaaccaagtcttggaagatctacttatctaaaccaaacatacaagagattaactaagaatgctaacttgttaatttacacagttaaaatatactagttagtgaatctgaatactcatgtcacctaattaggtatctctttccaggaagcaagttacttagtaagaattaaagggctgggcgcggtggctcacgcctgtaatcccaacactttgggaggccaaggcaggtggatcgcctgaggtcgggagttcgagaccagcctgaccaacatagagaaacaccgtctctactgaaaaaatacaaagttagccaggcatagccatcaacactgaggcaagaccctctatcagtaaaaaagattacaactggctgaaggctcagatgattgttagcatttttagtaataaattattttagttaacatatatacttttttatacatagctgcctgtaatgccagctactcgggaggctgaagcaggagaattgcttgaacccgggaggcggaggttgtagtgagccgagattgcaccattgcactccaacttgggcaacaagagtgaaactctgtctcaaaaaaaaaaaaaaaaaaaaaaaaaagaattaaggaagagttaaggtagattaattattttacagatgtctttaaattgtgatagtgtgatatattgcattagccaggtgagtctaattattgcactttagaaacaatcaatagtggtttggtgcaataaaagtttcttgttcatgcaacagtctaaaggagatattcctgactgtcatctttcctaggtggctctccaccaaataatgacttggaaatcctgtcttcttccttcttatggctttaccatcccctgcatcttggaatccctcactggttcttttgcatctagctcaaagacaggggaagataatgaaggaatcaggcctagaagtgcatctattacttctgcccacattttatagccagttctcaaatcatgtcctgcaaggaaggctaacatagtccaattctgtacccaggaagaaaagggaactgtgtggtaaacaactagtaggtctctgtcacatacactgttttctgtaggaccagacctgtcaaatagcctgaaacacatgttccagctcaatttggcacctacttccatgggcacactggagacacattgacagatcttcactacccaactctcctttgcagttattttttttcaactaccaaaattattgctaattgtaatctttcctcatgataattgggttgcatttttccagtttcctattcattgcatgttacatattaaagccacaggcatacctgagagatactgcagttttggtgccaagccacgcaataaagcaaatatcacaattaagtgagtccatgagttttttggtttcccagtgcatatacaagtgatgtttacactatactgcagtctactaagtgtgcaattgccttatgtgtaaaaaagtatatatgttaactaaaataatttattgctaaaaatgctaacaatcatctaagtcttcagcgagttgtaatcttttttactgataaagggtcttgcctcagtgttgatggctgctagctaattagggtggtggttgctaaagacttgggtggctgtggcaatttcttaaaataagacaacactgaagtttggtgcattaattgacccttcctttcacaaaaggtttctttgaagcatgcgatgctgtttaatagaattttacccacagtagaacttctccaaaaccctggtgctgctttctcaattaagtttatggaatatttttaatccttttttgtcatttcaagatgctcacagcatcttcaccaggagtagattccatctcaagaaaccgctttctttgctcacccataagaagcaactcctcacctattcaagttttatcatgagatagcaacaattcagatacatcttcagggttcacttctaattctagctctcttgctattttcaccactctgcagttacatcctccatataggtcttgaacacctcaaagtcattcctgacggttgcaatcaatttcttccaaactcctgttaatgttgatattttgacctcctcttatgaatcatgaatgttcttaatgccttctagaatggtgaatgctttccagaaggtttctaatgtaccttgtccagatccatcaaaggaatcattatctatgacagctatcaccttacaaaatgtatttcttaaataacaagacttgaaagtcattccttgatccatgggcttcagaatagatactgtgttagcagctgtgaaaacattaatctgcttgtacatttccataagagctcatggatgaccaggcacactgtcaataagcagtactattttgaaaggaatcttttttggtgagcagcaggtctcaacaatgggcataaaatattcagtaaaccattctattaacagacgtgccgtcacccaggctttgttgttccatttatagagcacatgcagagtagatttagcataattcttaagggccttaggatttttggaatggtaaatgagtattggctttaatttaaagttaccagctgcatccacccctaatgagagagtcaacctgtcctttgaagatttaaagccaggcattgacttctctctagctgtgaaagtccttgatggcatcttcttctaatataaagctgtttcatctacactgaaaatgttttttagtgtagctgccttcaaaaatgatcttagttagatcttcttattaacttgctttaacttctatatcaacacttgctgcttcaccttgaacttttatgtttggagatggcttctttccttaaacctcaagaaccaacctttgctagcttccagcttttcttctgtagcttcctcacctctctcaggcttcacagaattgaagagagttagggtccttctctggattaggctttggattaagggaatgttgtggttagtttggccatctatccggagagctagaactttctccatatcagcaatacagatgtttctctttcttatcattcatgtgttcactggagtaggacttttaatttccttcaaggactttttctttatgtttagaacttggctaactgtgtggtacaagaggcctggctttcagcctgtctcagcttttgacatacttaccttactaagcttaatcatttctatattttaatttaaagtgagagatgtttaactcttactttcatctgaacacttgaggccattgaagaatgattgattgggctaatatcgatatggctgtgtctaaaagaatagggagtcccaaggggaaggagagagaaagagagagagagagagagaaagagaaagataaaaagagagacaggggaatggccagctggtggagcagtcataacacacacaacacttaccgattaagttctcacctatatgggtgtggttcgtggctccccaaaacaattgcaatagtaaaatcaaaaatctctgatcacagatcaccctaacagatataataataatgaaaaagtttgaaatattgcaagaatgatcaaaatgtaacctagagacatgaagtgagcacatgttgttcgaaaaatggtgctgatagactggctttgctacaaaccttcaatttgtaaaaaatgcagtatctgcaaagtgcaataaagtgacttctctctagcgcaataaagtaaggtatgcttgtacacctttctttacaggcagattctctaggccacttgctgagatttagaatggaccctgtaattattactaaaacaatgactaatactttcttgaatgggtaatttgttgaaagcattaccataaatggataaccaatccattttattatggatcatgttagctttagtttcagaaattaaaattttcttctatgaccccaaagtctaataatgcattctacttgaaacttttagctcttcaaatatattttgcatgtcattagttaaaaagcattactcgtgtctttcagttgttttttttgctttcttaaataaattgagatgggggtcttgctatgttgaccaggctggtctcaaactggtctcaagcagtcctcctatcttggcctcccaaagtgctgggattacaagtgtgagtcaccgtgcccggcctcagctcttttactatcaaatgatacacaaaatttaataagaggtaaactctgtaattttacattgaaaaataattcacttaaaggattagtgcaacacagcattcatatcacctaagaaaaatgtttttttctctaggaatctcaggctatcataagctgtctacttgtctaaaattttttataattatttataatagatagtaacattaaagaactgttacctgtgctctgttactgaaatctatcagggttgaaattaaagaggctctcgatgaaattttgaaaaggtaattatcgcttttctctatcatctaggcaaataataaaagaaaaaagtaagaattttctagaaagagctcctactcagaaataactcattcaatactttttggcatagatagaactaataagaaacagaataaaacaatttttaagttgatacagcatgatatgtccattaaacttagatttccaaatatataaaatgaaattgcaaggtgtttaaaatataatttcaaatgaaaaaggattgctaatcataaaaacagtagggtcccattatatttgttgtgtgtttgtgcatgtgtgcatatagaagatacacacacacacacaacaggtaaaaaacatgttaactgtggtgggtaatttttatattcttctttatacttttttgcattttccaagtgctccataaagaatacatactattgttataatcagaaaaaaaatagtaaatggagtaacagaaggaaacatacagtatattagtcctgtattttaatcttactagagtattttagttctactcattatgtaactaaacaactgaacagtattttgctattgacaactgttccaaaagtagcatgaacttggaaagtccttaactactgacttcctggatctcagcttcctcatctataaagtgagaaaaatcacagtaactctagacaggcttaactaggtacatataaagcacactaaaatatggcagtatttagatggattgccaggaacttctcaacgttatttatatttgcttcgctatttatagaactggcagcatatcccctttcattataatggggatagctaccatctgttggatacgtagcacataactatgtgaccaacactttacctatgttatcttatttaatcttcacaacagccctgtgagggatttttgtccctgtcttccttggggtgaactgggacacagaggggtcaagtgatctggccaaggtcacacagctagtaagtcacagagcaaggtttttatcctaggtctgtgagactcaaaagttcatgctctttctcctgtaacatatggctttatgcttagcaagcaactctccttctgatacaaacattcaaaatgtacagatgccaaaagattagcttcctttcaacaacttgtccatgggaggatgacaaagaaagagaaattctacatgagtgaggtaagggtttataatttatcaattacctactccgaaagttcctaaagaaacttattgtcttgttggagaggttactcatatattatgaaaaactactgtgtcctggatatcttccagaccttgcaaacacttccaaaatttaaatcatatttcctcccaaactgactcaccttcctctattctctactggcagcaccattattcatccagttgtgcaatccattttcccctcctctgactgtccacatcaagtcagaaaaaggattttattgattttacctgtgataagtctcttgaatgcatcaacttctttctagtttcatcatctccacattagtgtaagccctcatcctctattgccctacatgactacagtggactctaaattagtcttcttgtcgctagaatcgcctccaaaatatctcccataccactattgaaatctttccagaaaatagacttgagcatgctatttttctgcttaaaactcttttcccctctcataagatggattcttaacatggcatgtggctcttcatactggaggccaggcttttatttccagcatcatctcctatttttcaatatcacaacctacattgttggtaccttaaaatatttgaaacttctcaactatactatgttcctataccattatttaaattgtatattgttcatgtaaacaaaagagtgtatgatgtatgaactgaaaaatataggagtaacgctaacgaacatggttatatcaaagcatagctattattttaagtacatatcttttacctaaaacataagtctctgctccttcagccttgggcttctaaaatctatacaatagagcctcacatatatatggatgttgttttagaaagaatgctaatttgataaatccattgatggaaaagtattgttgtaaccaactgaaataggaagtagacggctttacaaagataaataaatcggaagaacaagtgtgaagtcgattacaaaatcaagaacgtttcattcagatctcaattctattgcaggtcttcttgatacagtaacattttaaaagtgttgctgattatcaatgtattatcctgcttagtgatagccatttccatcaacttcaatgttgattttaataaacaaagtattattttgagtatttacatttgtatcccctccccaggctgccctggtgaatattgtttgtgtaatcaatccattatgattagggatctatggactacccctgaaggcatggacttctctgtctcgaggcactgttttcttttattgatggattgaccagcacgaaattatttcgcccatttgacaagcttctgccagtaaaaactatccatcataaattacagtataattatttatattacttatttcttttttagctcactcattatagtggtattctaaagttagacaactaagtaaaaattaggctttgggttttggatccaaatcaaacctgcctccttgagctaatatttcttttcttttattttctttttgccctctgggtctaatttctctgtgttgacagtgcatgcaaacatgttgctcattagtgtttatttactactacaggaatcactttgaactcctctaatcctagtggaaatgcttttctcaaaataaacccagatcatattgggttttatcgtgtaaattatgaagtagcaacttgggactcgatagctacagcgctctccttgaaccacaaggtaagagatagcaatggttggaaacttttatttttgttctaagaacagcatcttaatgatattaatttttttcaacatgctttgccttaagaattgtgtttttatctctctttctccctcttcccagacattttcttcagcagatcgtgcaagtcttattgatgatgcttttgccttggcaaggtgcgttttagaatgagactaaattacttaaaatactgtgggttttctcataaatcttttaaaaatgaattaaacattgcagtattaatcaattttagcttaaaatatccaaagccactatttaaaacattattgttttccttaactctcttttcaaaagttcacatgagcctaatagtcaaaatactgacattagcccttaaggtatacacaaaaacaaacctaacttattgactttgagtatggtttgtctatatcaggatccttgagctaattagaagtgacatttgcaaatgatcaaaaatgtaccttcataatttgatttaatataaagacaaacaatgtattttattaattcagttctgtgagcccgagcccagtgtaagattttatggctagaattgtcaaatcttgttcaggtcactggggtaagaagaatgagctatggtgctttagaactgatcagaattaggggaccatttggaaaatttgactctttttctcatagtctgaaggtaacctgctctttagaaaaagtgtagattggaagaactaagtagtatccatggtacctctattttttttttaattcacatagtctaacaccagtaatttaacaagcatttattgagttcctggcactttgcagaagctgaggacacagccaattttatttctctggctttgtagtcgcctcattctagatatgagcaatgtgctaagaatgaggagccacttccctcagtagcctcccatggcctctttctctgggttgggtatccttcttatgggaccctatatttcctcataatattttattgttattgtttattaattgtgcatttcacccatcaaactgaaggttcatgagggtaggcacccaaacccagctcctgactgtacgttgccaataacagttgataataaatactgactaaatagagaggtggaagaatagtatagtagtactaaaggcatggggaaactattttacacagagttcctagatagtatattaaaagtcagaaaaccttgacatatttcaaggaaggaattatggggttcgaaaacaggctcttgaaccccattaaaatcctggttccatatagtcttaagtaagtctcttaacttctctctggctcaattttcttatcaccaaggtagagatgaccttataagacttctgtgaggaataaatgagataatggacataaaacacttaaaagattatctggcatgtagaaactcaatacattgtattacatgaccaaaatgcatccaccgttaattagtagtgaagatgcgtttagaagagctcttctgaatttgtaatctacactcgttttgtagctaatagaaaatatgatgttctagtgaatctccaagtttaacctcctggatatgtaatagattattttcactatattacagtataccactcactcatttaataaataaacattggcgacttactatgtgccaggcactgtgtagaatagaatctgggaaattaaatgatgaaataagatgatcaataagtatttttaaacagaatcatttagtttttatttttaaattgtcctgttccaaagctcagcttcttcactgttagaaattacaaagaactgtactatctctacagtttaatttgcaccacaatgtaggaggtcctttctattccaagatgaagtgaaagaaagcctcttgaacagctctctctgaggaactgagtataaagcaaataacttacactactgaaagacttgctcacatttgctcagctccttggccacagccccataaaattgtgaagagctgtggagaggaagaaaatgaaacaaatttgaaattcaaaacatatgtaggatcacacaagagagctagaaaatacctgtgctatcacctggctcaatgaggttctgcagcacatgaggaaaatgggactcggagagaaacagattcaacgagcattggttagagccaagagggcagcttcaaagaccacataagctaagaccattatgaaactttggtggagggggtggaagagagaagaaatgcgtagttaaataggtgagcaactgtggcaggattagaatttaaacaagtctactgaggtattcaaaggaatgtagtaaccattatatttaataatcagaactaaatgatacatctgaaaataaatgaattttttattcccctgtctcttccaacttgatgtgaagaggtagtactcctactgccctggctgggcatatgactcttttcaaggtaagaaatttacccatcaccactagttcatccaaaccctctcaattccataattttctcagtcaagtaaaatcatcaaagctttctacttcatttaaagcttctccctgcccccagcttaggccaggttcaggccagtcacctgcaatgggaatggggtgattgatttcctcttcgtttctctgcttggaacttctatgtctcccgagtcaccgtgctgcctctggtttctccaaagttaaggcaaagagaacagggtgggagagtaggtgagagggagaaaaatcctgatgtgctgcctacttttggtcctctctgaactttgttgatgtttaatgctgatttttttccttgtgttgtgtttttatgggatttttgttacccatatccattccattgagaaggatctttctcctgcagtttccttgaggtgggcaggtggacacttctgacccacttctggtccataggaggttgtcatgtatgctttgtcctgacaatatttggaagaacaggccaccccatgcagtcccatctcttcactctgaggccagagcagcagccaaatagcctctcatcttttagatttctcagggtgtcagacaccaagccacggtgcctccaagttccaggagacacaggtaaacctcttcaagtggtcccactgaaacctctctcctgagtcttaattagacagaaaaacatctggtgccctagcccttggaggggagagcatttacagtgtactcagtatactgacagcactctttgaaaggcctccactaaaatgtctcaccttagtttctccaacctcttttataggctggtggtgggctatcagcaaagagccacacagtcttgttcttgaccatgttagtcctgctttggggtcctgcgtctttctttggagcattggagcataggacttagtcttggggccttgccaaaacagacacagaaacaattcttccccccaccccgccccctgcttgttacaatagtttttgttgttttttgttttctgtttgcaattactttatattgtcctcttcagcccacttcttgctacagccaggagagggtgggtaataacataagggaaagcagagtatgctggctgacaaggctgcgtgggggcaggagtcactaggtaagggacgaatggcaaagagaacagctgaaaggaccacctaagctaatgatctaagcagaatttcagccaggtttcaaggaccactggctccaaggatatgcaaggtaatggccacgttagcaaataagaaccagcaggtgaacatcagtcaagccaaaatcatggaccttagatacaaacatttttgtaagtgtttgcagagatgaccagagaacaacacagaactctataagcaacttttcccatcctctcatggacttcccttaaaggaagtgagaagatggggaatgggaaaagaatccaaaggtgatttagttaattgcaaaatgactgttttaagccagaaacctgaatttaattggcaagttcagttgagtgactagacagctgggaactttatgcccttcacaccacctgaaaaactagccaaagaacccaagcacatggggtcagttttactcccccaggtacctctcaacaatttttattgtccctttagggagccatgtttgacaagacactatacttaactacttaactcaggcttctctaagcaggactgtgcagtctttccaaattacactcaggaaaacaaaaaacaaaccttctgctgtaagagtcccccaaccttcctaggtgccttagctcaatatagaagagcaagaatgctctcatatgacctttgtcctcttcttcattttatttggtggaaattttaagctatagcttccaacctctctacactatagaatatagtaaacttctataatttaagtcccccaggctgggctctcactatataaacagaatatttttgaacaaagaaaattctcaatcaagtctggccttcagaattgctgtttgtctatggacttaaatggagtttgagacccaaagttgagtaagaatgctagcagtcttgagttgagttccctagacgtagagtcagaaatagaggttcttgtactagtggtttcttgagagagtaatttcatgagacagggaatacaaaaaacaggacagggaagtggggaaagctgagctgatttcaaaaggttctaaaattcttttgaaaggggaagaaagtggattctttaacctttaaaatatcaacagtgtcttcaaattttctagaagagaaaaatttacttttttaatgaatattactgggaaatgtgtaagaagatgttataaaggacaataaaagttcaatttgaatgttttaagcattcaggattaataagaactgttacttatatttcttcttcataagcaaatgtaaataatttcaacaaaatacatttatagtagtgcctttatgtgttaaaatccacttgggaacctaaaatttaaaagtttctatttgtcaatattaactgtacagctaaatggcttttgttttatttgaaattttgctgttgtgctttttcaaatgtacatcttaatgcctttcttcctccttactattgaatgtatgaaagccctactgtataatttcggacaaaactttttgattgggcttcaaccaataaatgcaatttcttgattgttgaatggaagaatcctcattaacatggaatgctttgatcgccaaaactttcagttaaatggaaactaaagtctgtggtttttaattaactgtgagtttttttttttttttttttttttgtctttctcagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggtgacgttaatgctatggtatcttatgaaagtaaatgtttagccattagtagaataggatgctttctgagagaaggagctcttggggacctaaaccatgtttgcttgccaggtggaatcaaaagaaagtgcaatgacttgactaatcaaagcaaagctatgccgtctattctttttcaatttgaagtacatcagaatttgttgttctgcatacataccacttaggtgcattttagtgttagaagaaatacaacaattaatattttacttaaaatatacaacattttaaacaataaatactaattagatcttttttaaaatggactttatctatgttaaagtgaattattcttctaaaatataatattatatcttcttattcttactgctggtatttccacattgagattttatcatatgtagtcattctaaataccgtttctttgctttgtgatttctgtagcacgtaagtaggacacttgtaattttagacaaattctggattcaaatctctagctcttctatttacaaaatgaaagatcttgaacaaatgatttaacatttgtgagtcttaatttcctttgtacattaggaatgccagcacttgcctgcttacggtaatgggattgtgaggatcaaataatatgaaagtgctttgtaaaacctaaagcaatatcagttatttttattatttcatatatgcttaaacaatcttagtgcagaaagtaggttgagtgttttcctatttattacatatgttaactaagaaataggggttaaaagggccttacccaaagttttataaaacattacaggaaggtccgggatggtttatattttcaggattgaaaaaaattgcaatgtgataaaaattaaatacattgtttttctaaggacaagcgcaaagttctctgaattagtaggaaaacagattataacaggggctgctgagtataataattgggatactactgatatgtagtaaattgttacttattgtacataatacttttatttcaggaatacttccaaggtcaagtgaagcctattgcagattctctgggatggaatgatgctggagaccatgtcacaaagttattctcactttttaacaactaaaattcatttaacatttgttttttgttttaagacttgttgaaaagtgcttaaggccctggatttgtgtttgtttgttttttaaggttactccgttcctccgtgttagggtttgcgtgcaagatgggagacagagaagccttgaacaatgcttcctcgttatttgagcagtggctaaatgggactgtaaggtgattactcacattgttatgcttagaagacacatttgagaaaagagtagttgaaatctctgaaacactgtttcttcttctagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtaagttgggcttttatttcacatatataaatagtatttaatagtttatgtgtcacagtctctttaagagtctgattaaagtatgatgttttgtttccaaaaaaatccattaaaagttattttccctgcaagaaacaaaatatccatgtaagactggcctaaacaataaggaaatgtaatctcatatgaacacattctggaggtaggtagcttccagttgtgtgcagcggctcaacattttcacccaggacccaggctcttctctttctgattttcaatgatcgacatgttggatgtctcatgacttccagagcttgaaacattttgtttttacacaaacatgtgtaatggaggtaggacaggagcaaaagagtttcctgacaaggctctgtctcttatgccaacaggacaattgtctccaattctcctcataatccagaactgggtcacccttcatcattgtgagtcacactctgggtctgctacttgatcctttgctcactagggtgaacttgaattcctttggctgatttgagccaattagaattatctgggactggggtagaagtctgttttacctaagatcaaggatatctaatggtatcagagcaaaactgggctctgtgagtagagaaagaggagtgtctgccgcaaatgcatttacactttactcagaaggcacaaagctcatctatgactcatttcccactctgcatttatacttgaaatcaacaggcttcttccttaattcattttttgcttagttatagtgtctgagttatttacttcatttatttaaccaacacttatggtgtcctttctatgtatagatatatagattgtggaaataaaaatgaataaaacatgaataaaaatgacatctatccttgagatacttacagcttcatgggagaggcagaatgtaaacagtaaattacaatgcaataccaatttaaaaggacgaccagaagcagtttgcttttaccaggtagagccaataatataccttcagcctctttcctcagggctatatattaattctcctgctctctgccatgacagttcatcaagaactcgatcatcttggctgggcacagtggctcatgcctataatcccagcactttgggaggccgaggcaggaggttttcttgagcccaggagttcaagaccaacctgggcaacatagtgagacctcgtatctatttaaaaaaaaaaaaaaaaaaagaacttgatcattttcacatttcacaaaacatcactaattcattactttgatggcattgtgctgattgtatctggtaagaaaattagcaagaactttagatgccttagtaagaaccttgtgaactaggggatgaaataaattcaggatcccacgactttagtgcaatttctggaagttcaatagtttaaagcatatcacaacattccctccaaaggaaaagaaatttgttgcaccttgactgacatgccacagaaaaagattattttagtggacttagtaaactttttttaaattttggaagcaacatatctcacatttgagtgtgttactttaaccatttacagagtcttccagtttcaaataatgactggagtaaaagaagattctgcagcaagtccaggctgcagtacgagcttccttggaatccctttcttatttgaaacatgtgattgatatgttgtattttcataaaagtagatttacccacacaactgcaagtgcaaagaaaatgtaggaccttgattttctatctgattattcccaagagttctcacactgctgagtgatgagccagtgagagggagaacaactgatgttgactatctttgtctgccagtctagtttttaaatgagttgttaaactagaattctcattgaaatagtctcttggagtaaatgttcagtcttctagagttccttcccttcctcatggtccttctgcacagggagacatgccacccttgtggtgatggagaaagagacctctgatttttgctgctttggccttaaggtgtttacctattttggtctgggacagagtctgctgagttttcattgatcatattttaccttctggtgcactatctgtcatccagagatgaaagcagtggtcccagtcacttgcttctgttcatgaagtacctgtgctgtatgtatggtatttttgttttcccatcaggtcttccagtgtccctgcctcttattgctaggctgaagaaactgatagcttcccataaacaggacccacaagtcgaaggaaccaggatcattaccttaaactcagtcatatattcacctcaccttgcctacgatgtactatcactctcccatgccattttggcatagcacaaaagtacatgctgaactatagacctgttcttaaggggttgtgttttccagtttcacatgtggcatggactttatttaagcttgagttttctccagtctcatttagggtaaatttctacttcaagtatgctaagggtcttgatatattaataaaagcatacataatttagaaataccttttctgtttgacaaaggctgactctcaaaggctcacaactcaagttgaacagtgatccctttgttgtagttattatctcaatatcttcctaaagatataaatgaattaagccaatgggtaggatgccatggggcagcaagacttgagtaacatgaaaatacatctaatctatcagtagtagacatctatttttgaggttcccttgtcacagtgaacaaaatgtgtgctgaccttttttggaaacactttttcaatacaatatacacttgtaagatcttgggctagaaacgctactctaggtatagccatggcatacaattaaacctatccatttagtcatttaatttatcttgtacttatttgtattcttaattattgccaactaatataaccatataggttacattataggattatttcttacaatctagggaagagcaaacaactgctttcctatagaatataagagcatagatacattctcttaatttactggcttcttttaaaaatccagtgggataatgggaaagtgtgtgaagtactctattcaataaatgctgttttaaaatattaatggttaaaattaacattttaatttttaaattaaaaacaatgtgttttaaaattgtttttggtgcttctaaaataatttaattttaaatgttttatagtttacattccactagtctttaaaatcataggttggtcttttaaaacagttaaacatatcagaaaattttaagttgtctttcatcatttgtcatatttaattaactttgtcagttgatacctcaagaattgaattgctggcatgaaaactattttgtattggaatttagctaagggtgaacattaaaagttcactttgaattgtttttctgtttggcttctcttaggtatttggatttgctcaaggacacgaaccttattaaaactcaggatgtgtttacagtcattcgatatatctcatataacagctatgggaagaacatggcctggaattggatacaactcaactgggactatctagtcaacaggtgggatgatctgatgatggtctgctgttttctttgtttcatactatctactggttccttcatttttctttgggccactgtctctgacatctatacaatatctaaaatggcattattagaggtaaaggatcatggtattatccttccagggaagcaatgtactagttaattttaagaacaatttttttctggaaattattgtttcaactgacctataggattctgagatctggaagactaaattgcattatttttagtttggttaaaacaagttaatacaattctgcctgttgtgctagtacctagcataatgccaggcacatatttagttctcaattaatgtttgattaaagctaggtaaaaattattggacctgggttcaaattagagttctatatcatactgagcttatgtgggtgataactattacctatcctgaccagataatgaaatttcaagtattttgaatgtttcttaaaagggaattatatttcctaggcaatagaacttttaaaatgggaaatagcaaggacaagagcaaaatcagttaaagagatgcctttccaaacttcgtatttcctcaggcccgtgcagaagaaagattgctgctcttggttctgatactctaaatataatgcacaatttccatccaaaaggcagttctttgatagagtacaaaatagaatatagaataaacgtatgtcccaaataaacatataaacattgatgaaaagacctttaccatctgtaatccctacattaggaaatagcctgtgttatctcctcttaatctctcctgtcaatccagcggcactgtctcattgataatgactgccttgtgagaaataccaactctaattataacttttaattattttctcttttctaccccacagctcaccagagtgctattatgtccatttacatttcttttcctgctgagattcagattctacctctagctcccaaccaaaatacactacattgcttctgcctgcttgtgataaatttttaccttttctattcttgtaactattgagtgtcactgttcacccatctctatgaagattggttggtgtgcatgtgagtgtgtgtgtgtgtgtgcatgcacatatgtgcattgttcatcttttatgattgtttaaatgaaatgcttaatttagaatgaatgaatatacctattaagaatatgttattatctagatgtaacagtttatatcatgcaaggtaataccctccattttgaaaaatatatggctagtgataaatactgcatattttgttttagttgaaaagaccatacaactatctctttttctgtggtgtatggtgcaggaaacctatgtagatgaagcataaaagttacttttgagttactatgaaaagacaagtaaataatggtttattttgcataaaatggccattaacttattgtttattgaataaatatttctcaaggcctatttgagtagctatgctgtgatttatttcaaataatgcatttttcatttttaaaaattagttgtttcacttcaggaaaattaagaagtagaaaaaaataggttttgccttgtcataaaattcataagtgtctggccttaaaataaatgtattaggcctggtaaattgattatttttcaagataaaaaaagaagataaactatttccagaagtactccaaaactcttgcccaaggctttagcatttcttcataatctaatgatctaattctcatgagacattatttcaaatggccccaaatgtaaaattgctaataaccacatgtctaatacacacaaacacccaatattaattgtacttggcttgaataaacagaacttccctatgaaaattggataataaaaattaaacaaaaatgagccaaactttatccaaataatcccaaacacttgaacattttccaaatttcaggatgaatagttttactatctccatttctgaacaatttatggtcatcctgaaataaataatcttctatttaaataaagcttttgtcatgtgatttttatgacaactgatggccacactgctaatgtccttgccagtttgagacttagccacaaagtcccaaagatacttcagaaattattctttgcttttgtttcttccaataaactcttagatgaaactgtgaagttgagttgacccaataataaggtggtgtgattttagtttatgacagtagatgaaaaactaagtcattaggacatgattgaaacccttcaaatactacctcataaaccaaacaatttaataagcacttaaaagttttgtgtgtattaaaattatttctttggataacataataatacttgtataaatattgaatccaagaagacaatatttgtaaatttttttcaaattatttaaaatataattaaatccttattttagtttttaaaaataaccaatatgataagcatgcagtatattttcccttattttctatactttatatgatattagtttcctggggtgtacatattttgttctggcatttctggtatttaaacaagtagttgcagttttcactcagcatattcattgctagtttctaaatatgtcctttagacaaaacagaaataaatattacagaaattatagaaggtcactgaaaacattgttttattagctgcaattagcagactttctttgaatctatagaatctcatcaaagcaactcagtgtgatttgcttttttaaattcctgttttcttattgtgaaactggtatgtgttttttgcacaaaatgcatacaaacaaaaataagagtacaaaaattacctgtaatgcaaccaccaagaaataactcctattgtcatattactgtttctccttgagtttttccatggctgtttacttaatttacagaaatggaaacatattataaatatggtttataacttgctttttttcctcatcatcctatattgtgggtgtcttttcatgtctttaagtgtgcatcttcaatattattttgaatggcttaataatgtttcaatgtgtacatacatcttagtttatttagccaatccctatatgttggacaatagaattgtttccctacaactatacgtagtgtattgatgaacagtcttgtacactgaatcctttgttgttttttttaatgtccttgacaatttctttagaatacaagtagtggtagaagtaatgctactgggtgaaaagatgtgtttatttttagggtttctgataaatgttgcagaattgccattctaaaaactgttgctagtaactgcctatgttcccaacctttttcaatgctcagtgttgttatttttatgtatctttgttagttgaatatatgaaaactgatatctcattttaaattacatttcttccatccagtaaatattgtggagcacctactctgtgctaggcattatgactggcattggggatgcagtagtaaggagaagcagacctggttctctgtcgtcatgaagctttgagtagagacaaattttaagtaaagagtcacacaaatacatgtatactttattatacgtaaattattaaagtataaaaaagttcaggtcttaggcaaaaatgttattcaaaatggtagaccatggaatctaaactacataaagaaataaatgcaagaataggaagatctgatggtttaagtgatagaggggtgggaatagtcaaagggccagaagtccaggtaaagtgaaagaacagtcacagtggaaactgaaagacataacatgtcatagagggtgaataaattagcaattttagaggcagatgacttacggatgatcacaaagtatcttaggaatttggtggctgaagtcgagtgaagaaaatatcatcggaaataaggttaaggaactaagagaagagatgttatatcattcatctgtatggatctggaaattacctagaatgatggcatggcttggaggagtcaggtaccagaatgtatcattaaatgcgagggactaacataagggaacagaggtttttaaagaggctggaggaatgctggtctggaagcagcaatggggagcatgagcacactgactatttcctgacctgatgctacaaaggatgtgggaatataaacattctcttaagtgagaatgagaagtagtgttccctgtaaagggacagttccagagggctaggtgaaagggttcaagagcctggggagatctaggaaatgtgtcagaggccagaaagtacacacttttaggggcagcattactaatgcctcagaatcacattttagataatgactgatgacattagggatgaaaaaacatattggctttaaattcagtggcgtctgtgataagagtgggcactggatctggtacactgaaatcatgcttgattactagaacattttattcttttcccattggtacattttcattcctttgctaaattcatgctggcatatttctccctgttaccaatttgtaagggttctttatatggcaaaaatatttgctctttatcatatatattacaacgatttgttctcgattagtatttggcttctaattttgtatatggtaggatttttttttttttttgtataaaactcttttgttacccagactagccttgaactcctgggctcagtggatcctctcatctcagcttcccaagtcacagggattacaagggcaaaccatcacctcccagctcagtataaaagtttttaatttgcataaaacaaactatcagcttttatcttcatgatttctgcttttgcatatatatataggaatggaaacatttaatatttataaaaattatatatatatatatatatatataaattgttttttgagacaaggtctcactctgtcacccaggctggagtgcagtggcacaatcttggttcactgcagcctcgacctccccagttcaagcgatcctcccgcctcagcccctaaagtagctgggactacttgtggggcgcacaccaccacgtgcccagctactttttgtatttttgttagatatggggtttcaccatgttgcccagggtggtcttgagctcctgacctcaagccatctgtccaccttgagatcgcaaagtgctgggattacaggcgtgagccaccgcagccagcctgtaataatttttaaatgtaaaatttatcctattgctgtgtacatattttcttgtatccctcctcaacattccaggggtttaaggtttatacataattttgtgggtttcttgcactgtgattagttgtgatgagattttttttacctctatcacaaccatttgtggtctatgaggaaacttctggttcttgctttttatgaaagaaaatgcaaagagaacaggggtagaatatcatctttaaaattctgtcttggaatttagctttaggtttctctgcttaggcagactgatatagatcataacccccacatgccagcaactaataaagctttttgaaagcagaataaatagcctatatttaaatttctgtaccagtaggaagatgcatagagtattaggataacgatgctggaggtgttctgccgtaacggaaacacagaaaggcagccgctgaaagggcatgtgtgggtaattagttctcactatggttagactcctgaagtgagtggtccaagttgttagcgtgcttctgctctgtgaggccaggccagtatcctgtctgcatggctgaagacgaatcactggtatgtacatgttctagcttgggggaagaggagagaaaaaccaggaagtctaggcaagcaatttccctttatttaagcaaggaagctgcagctgaacattgtgctaatgttctgttggtaagaattgggttacctgtggacatctagctatgagagagcctgagaaacagtctctagcagggcgctcatgtgtgcagaaaaaaaaaaaacagatttggggactacaacaagcagtcttccatatctcagagggtcgtgtcaatttgtctaccaaaagaagtgcagagtgtactaagaatttatcttgaatagaatgattttaagtaaaatgggttttcttactgtgttttgcttactttgaaagttacttttaaaaactatgaaataaaaaggaaacatctgcatttagagaaaatatgtaacattctgagcacttacacttccttttactctaaatttctctccagatatacactcaataacagaaaccttggccgaattgtcacaatagcagagccattcaacactgaactgcaactgtggcaggtatgaagataaattcctctgcatttgtccaagaaggagcagaatgaaacttttttaaaaaaaattttactttaagttctggaatacatgtgcagaatgtgcaggtttgttacgtaggtatacacgtgccatggtggtttgctgcacctatcaacccgccatctaggttttaagccccgcatgtgttaggtatttgtcctaatgctctccctcccctttctccccaccccctgacaggccctggtgtgtgatgttcccctccctgtgtccatgtgttctcattgttcagctcccacttatgagagagaacatgcggtgtttggttttctgttcctgtattagtttgctgagaatgatggtttccagcttcatccatgtccctgcaaaggacatgaacttattctttttatggctgcctagtattccatggtgtatatgtgccacattttctttatccagtccatcattgatgggcatttaggttggttccaagtctttgatattgtaaacagtgctgcaataaacctacatgtgcatgtgtctttatagtagaatgatttataatcctttgggtatatacccagtaacgggatagaatgaaactattttttcaaatagaaatgatattttctcaattcaaatcacagaagacaatgagaaagaaaattctttttggttttgtatttttaaattgtatatatttaaggtgtaaaacatgtctttatttatcttgataagtatacacagtgaattgagaaataattcttgtatctaataaaatgtacacctattttttttctaaacataaaacaattcaaagagcctctaagaaagtttaaaagctgcaaaagttgaggtggcggggggctgagaaggccacaccagacagttcagctcatgaaatcatgggcagaaagtctcgcctctcctgtaaatgtaactctggaacaagttggtcaagatttgattccattcagaattcatagttttgcaatttcaaaactaatctcaaatctttccggtttcaaatatctcaagtccaaaggaggagaaatgtctattaatgttgaacaggtagagattgtatgaagtttcaatatctgtgtgttagatattgaatgctaagagttttctgtatgttaaaaagccaaattattcttatttttatagcaaataatcctagtatggttgagtttggggtagggctttggaggtcagagggagtacagcactaattttaagaaagatttgttttatgagtccttaataagtgaactgaaagtacattaaaatactccagactcctggagtgaaaggctaaggaaaaccatcactccataggtgagattttccagggaacaccttggggaattcagagaaaatagagaaagcagcagaaacagaaatgggcatgctagcgactgacatgctgccatccttctccaaaatgtcagagcctattttggcttgacatgctgtggggatccaaaagccatgggtaactattgctaatctgagagatgggttcagtctgaatgatgcgccagaggtgtagctcaacgttgtgcagtgatactgaatttctaggtaagaagaaagcaaatccagtttgtgaatgaaattcttgaagactaatttggctataaatgacaatcctaattactcccctctcttttctagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttgctcttataaaatcaataagagaactctcctctttttttaaaaataaatctaaatgattatcttgaaaaagtattgttttccagtgtcacttgactcttgaataaaaataactgcagtgttccccaaataatttaacacattgcaaatatgattcaagaatctggcctttttcatgcttggtactctcttctcttgctccattccttacaaagctccttcaaatatgctatgaaattagagggaacatagtgcttaactctgctccatggattttagaggaaaaaagctaaataattggaaactgttcaggaaagagagaaggcagattatttcttaaaactaaatggaattagaatttagctttgacctcacctagcaatctaagtgtgaaaatggggagacctgtgggcatccccagcatgactctgcatatctgagcatatatctccttatagatcaattttatgtataaacccttagatcctaatccatacagaatagcactgatcaaatttaaatgcatgacttgattaaagacatcaatttcatagaagctggtggcaagaatatgtttaatatggcacttgatacctcctagatccataatgtaagtccaataggcagaaaagatggtaagttactatgtttcaatctgctatatctagaaaatctaaatttatttggaactttcaaaaatgtaaggtaatttagaatcggcttgatgagaattgaagcatatggaaacaaaaccttagctttaactttatttatacaataatgtgccctaatcatgtactctgaaactttataaactttcctgttgctgtttcttaattatcacttctcaatccgtacagccaaactagtaaattcaaatgtagactgggttgtgggtggcagatatagaagaagaaatttccagaccaaaaaatattaaatattattttaaattatttcagaagcaaaaacatattaacatcataacttaccagaaaaaccccactatcctcataagattaacttaaaattctgaccacaatcagaaccagcacttgaagtctatgtattgtttcaagtaggacatattatgaggtgagatggtttatccttctgttttatgaaattaatacattttaaaagaaaaatgttagtttaagggggtggtaaataaaacagatttcaacttgcctacaagacattctatttcatgccttttccttttgttgttctatttcattctattttaagcattaaaactgagaacaaattgtttacttcttttcactccacacgcgaaagagttgtatgtactttgtcagaataagtcttctagaccatcaggtccttctcaaacaacacctgttttttaaaaggctgatgcctaatagatagatctatgccaagcacagtttattactttgcttgcttggttttgcacagtattcacaggggacaaaaaatttaatatgatgtttccaaaattaagccacagtaaatttaaataattaattttaattgaaaaaaagtaaccatttaatttcaagaattaactggaaaatatgggaagcaaggtcatgtagcaaaaagcaaggccagtattactgcctcccctctaggcagcccactcctgtattccagatcattgctatgtacccacataattataaattaggagtttaaataataaaacatagacgtaaaactgacaggcaagggaggtttgggaaacaggggtgagatgtatacctgggttgaaggtaatgatactcctacagcttaccctccaagttggtgaagtgttagtccaaaagtagaaacaacagagtaggggcaaaaatctagaacaataattctcaaagggaattgggggatgagaaggaagtagaaaagaggggattcaaattaccagtggtgctttctaaaacacggttaggtaatcatcatcatcagactttcctttttttttcaagcatttttataaacactagcactccacataacattaatttttacaaaacccccttaaagtagatactgttattgttcttattttagagtggataaattgagatggagaagttatagaacttgcacaaggctacaaaagttgtatttggcaccagccagtatttgaacccaggcagtttatcactctaatctacattttaatctgtattagagtaaaaatatgcttttgaaatcagagtgacctgggttggaatatcaactacttggtagttgagtgcttttaacctctccattgttgtttcatctataaagtaaggatcaaaatagtagctacctcaatggtagttgtgaggattaaatacaaaaatgcatgtaaaggacatacgtataggaaataacaatcactcaataagtgttagctcttattattgttactattatatctccccatccctacttaagacactagtttgaagaataaaataaactttggttcaggaataaccaaacctaagcaactgaaggcactaagggtaggctatgtgttagcctgtgttattgttcataaatagtaattgccc

SEQ ID NO: 13303 - DNA, 104520 bp, Human
  misc_feature (1)...(104520): n = A,T,C or G
agcaaaataatacatataaagtacttagcctagtgtctgatacctgttaggtgatcaggaagttacatggtttttctcatctttccccacttcccagtattgagaacctcccctcgacccctgctctcccattttttctcattgcttcctcatggtaactgaaaggcctccgtattgtaatgtgctgtggatcgcatggtgttatttgcagcagtcccagtttgcagtgtactgccctgtgcacctctagaagatgcagtgatggtaaatatagaacttccccttaccctttcaggttttgtgccacgtgtcttatctcctggcttctgaactcagggacttttctgttaatgttactgtaggttctgggtttttccttgcccccctcagagcaaagatgggtagtttttaagcaagagtaaacagtccacctcttgctgtagagtccatccgtttgaggtctttttgcttcagagtatcttcccctctaccagcatgcccctcagttgctttttcaccattagaggaagatgaggatattgttttctctgtgcttgagattgatactctatcacccctcagtctctgtggtttctgttttgttcctttagatgacatctacctacttaggttgctgctccctatgggatgtttggaatgaagaagggaagggagatgtgtggaggccagtagccgtctttattgggttgggtgttctcattagcatcagagtgccctttttgtttacttacttctgttaagtctaccacttctggatctcactgcagattataaggcagggcctctggattgaagttaatgtgtataaatttttataaagctcctcagatgagcctaatttgctcctattagtgagaaccacgattggataattgcaaccagtttgcattcttcctctttgggtgagatgctttgttttttttgtttttgttttttggagacagggtctcactgtgacacccaggctggagtacagtggcgtaatcatggctcactgcatcctcgacttcctaggctcaaatgatcctcccacctgagtttcccgagtagctgggatcgcaggcatgcaccatcatacccagctaatttaaacattttcttgaagagatgggttttgcatattgtccaggctggtcttgaactcctgggctcaagcaatcttcctgcctaggcttcccaaagtgttgggattataggcttgagccactgtgtccagcttgttttttttttttttttttttctggagaccaagtctcgctctgtctctaggctggagtgcagtggcgtgatcttggctcactacatcctttgcctcccaggttcaagcgatccttctgcctcagtctcccgagtagcttagactgcaggtgtgtgccaccacagccagctaatttttgtatttttaatagagatggggtttcaccgtgtggtccaggatgctctcgatctcctgacctcgtgatccgcccgcctcggcctcccaaagtgctgggattacaggcatgagccaccgcgcccggcctgcttggtttggttttgttctgtgttttgtttttttcttgttgagaggggaatgatacttaacagataagacttcgtggattcatatatatctggtttcaaatcttactgtgttaactaggtgtgagagttaaatacttatgagcctcagttcagcctcatttgaatgaaggggacagtaatatccatgttcagagtttctgtcaagagcctgtccatagaaataacctgttctgtagcatcatgtaaacattcaggaaagggtagctattggggattttgagaatggtagcaataacgttatttggaatgtaaaagtataaatgtgaatttgaagattttggtcttatattactaaaattactatctgcaaatgttttaccatgagaatttttttttaagcagattcatgtgtcagttcttaaatatttttaaatctctctctctctcaaaataagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaaggtatctactttgccctgcagtacaaatgtgctgctagcctaggacaagctagcagacctttgttgttcatgaaaactcattagtatatcttgatgatgaaacctacagccattttttctagtaatatacagtagtatatctgaggatacaaatgaagacttctttctgctctattaaggaaaataaatgacctgaaccatccaattatagggaggaaagacaaatttttatacgcttggtttttaactttatttatttatttttgcaacagagtcttgctctgttgcccagcctggagtgcgcagtggcacgatcttggctcactgcaatctccgcctcccaggttcaagtgattctcctgcctcagtcacccaagtagttgagattacaggtgtctgccaccacgcccagctaatttttgtatttttagcggagactgggtttcatcatgttggccattctggtcttgaacttctgacctcaggtgatccacgtgcctcggcctcccaaagtgctgggattatagacctgagccaccatgcccagcctaaaatatatttttaaggttaaagtgagcagttccggaaagttaataatatgtagttataggttggatggacctacaagccagtcagaatgattgcactgtgcctttgataatcattatcctaaaatgagaacttctaaggaaggctcttggttttctatgtacacctccttttcacatggtagctctctgtccccctccaaaagcttattactcatgtaagagtactcagtagtgagtaactccacatagtagatttttcatggaggagttgacttagatatcggctctcaaaaggacaaataagaacacaagataattttaggatgtaaacattataatatatgctgtaataaagtcataatagttgagctagaatgcctggctggtatcttgaagtgataaaactagttgatgtagtaacactgaaatgattttgccctcccagttaataagggctccataaaaacctgtgttgagtaaaaactttcatagctctagcagagggccaggtgtgggcatggatagacaggctagagtaaagcgcactttccctccttcctttctctgccaggttttttcagagtgttttatgtttactgcctctacctatatttcctaccatttggttattcctaactccttctgtttggaccttttgtcctttaactccaaggtgatgctaaggccgttacagaatctgtggactttgggttatgtgattacattggattctagttgtaaaatgcctattctgggccatcttttcttttgaagccttgattttcttcagcttacttcatcatttttatgttgttgttgttgttgttaaagtcattgttgataatgtcctttcttagtgacattgttggatcatttttcataaagatgagacagggtcttgctctgtcccccaggctggagtgcagtggtgcaatcacagctcactgcagccttgatcttctgggttcaagtgatcctcccacctcagcctcccaagtagctgggactacaggcacgtattgacacacctgtctaatttttaaattttgttgtagagacaggatctccctacgtagcccaggctgatcttgagctcctgaactcaagccattcttctgcctggacctcccagggtggtgggattacatgcctggccctacacttttaaatacaaacatttcacaagtctcagctagtggcttcttttgtgcatgttctgaaccttacttttccaaatattctcatgacgttagctgtcacctgtaatttgataacccatatttctcatctcagcttttgctacttgcttaatttctgttacaccttttcatgtcagtgttccacaatccattcaaattccttttgcttatgtgtgattctgttaaaagaatacagaatatacttagtagtagttatctctggggaagaaagtgaaaatgatttttctcctcaactaatctgtcttttaaactttttaaatcactggtgaggattgttacaggtcttaaaggttgttacaggtctacaaaaatcaggtcttaaaggcaaagggctaattactgctacagaataaaaaatagatgtgttagagaaagggtggcagtggttctcattctgagaacttctagctaagtgttagcaatgcctcatctgcgtttatctgggatgttacatgacctgaggaacttaaagaaaaatacaaattcctgattcttacttaattagacttaatgggggctttgccgcttgtattttcagtttcacaggtgtgggttagtgcagtcaagactgaaactcaaagcagtagggaatttaaaatgtatcagtaaatactttgtctttagtggaagcagccgctgtcttacctttctgtattattcagctgtatgtttatattttaatgatgggtaagcggtgtaccatatagatttatagctgttaagtaatgaagacattgttaaactaatatttcctaggataatatgcctattttaaaaaaaatggcgctttattgtctcataaatagaactagcaaaacaacccttttgatacttggttacttgaattctcttcaattgcaataaacgtttgataataataatgggggtcaagaaaaaagattaatgcgtggtctcttaattttacagatgtgggaagaatatcctgatgtttatggggtcaggcggtcaaaccgaagcagacaagaaccatcgcgatttaatattaaggaagaggtaaggaaaaaatgttttaagggcatgcatttaaactccctatcttacttcattctttctgactctggtatgtattaccattaaaaagactgaacttcaggcatgagggttaagtgactctaatatgagctatctatgaccagatacagtaaggcaagaagttaataatcaaataaaagaatctaaccagaaagatcatataatagtgaattttttagtagagtattatacagaactgacctcaaaatggtttattttttaagttgtctctcatagtgaaaattgattatatatagcaagaagtttacctttttaagcccctaacttctaaatctcctagatatttattaaatgggtaacttgtttggtaaacaaacagagcaatagaaatagtttgggatttattcctgaaagaggagggagtgcttaattaatgtatctacttttatttaacttcttaaatttggtttccttgctcatttttagtgtgagatataataaaatgagtttcaaacatacttactctaattgtgagagattgatcagtgatttttttaaattggtattctataccaggcttggttgtctatagaatcagacttctttcacctttctcattttgtgtgatatttttgtggattcttattctgaattaggtttatagactagatcctgaagagagattcttttgtctcaatgaaatgtctactttctgctttcttgggaggactttgctagtcttagctatataacgtacttctgatgaaagttaaatattgatagccacaggtcagtgagttgggtgtgggtttttaaataaatgtaccttaaaaatctaattcaccctaacatctgcattacatttgtgatgttttattttgagtgacctctgagctgttttgcctttgcttttgttttccatagtgtctcgcactaggttactgagccatgtttgttaaaaccaatcacatagttgtagaaatctttccctcttttacatattaattaacacattctctgtagggtacaagattaacagcaataggaatagtttgccattttccttaattgtggagagaaagagctactgaaatgtctgtgactgtaagctttccttggcctagtgctgttagcagagcactgttggctcatgagtgaacatactcttaaatgagtctaaaatgaatacatcagtagttggtgcctttaaggcacactgactaaatgttgtggcatttttatttgatagtctcaatctgcagtatccagtatggtccccactactcacatgtggcttttaaaattcgcattagttaaaaataaaacttccatttctcagtcacaccagtcacattttaagcgcttggtagtcacatgtggctgatgggtactgtattggacattgtagatacaggacatttacatcgttgcagaaagttattggatattgctgttctggaagtcaagctgagataaatatttcctggctttagagataactcagtgatagcagagagatattaattttcaaatcaaaagaagagggagttccaccaagcaagtgcttaggtttctttgtgtctaaaagctcatattgaataatggtatattgagtagactgttgatccaggagatagtgttgtcccgaagaactgtgaattaaagtctgtaatcatttttcccccctcacacactgaaggcaagtagcgggtctgagagtgggagcccaaaaagaagaggccagaggcagctgaaaaaacagtaagtctttcatgggggaaattattcaatctagtagtttcaaacttgtcagcatttctaggactgccttcgttgtgtctttagtctactccaggtcccttagtctgcttctgtctctcttactagctcgggtgactgtctaccttgacctgttgcaatagcagcagcagcattggaaactcaagattctcagtttaacacatggaaggggtccacgtatactcgagcttttgcttgggataaatctcagcttcttccatcgggttaacccaattagcccattgatttttttcagaaaaatatgtataaataacaagtacacaggtatttggtattgtagtaagcaaggaacaaatgtagatttgctatttttatggcaaaattatattggctgaacatccattttggtaagaaattacatattgttgtttctgtataattttaatgttgcagttcataagccagaaaaatttaatttgtggacttaatgtggagtttctttataacatagatttatatgttgattttttaatttaaaaagttcgatttatatgatatgaaattatttgattttttttgagaaataatttttaaagtcattttttggagagggtgtggatcccgttgacaatctgaattctatagcttctctcaaaaatgtagatattcaaaactttgtataccagttcaggggttctcatgttaaacagttgtccatggcttctattaagagctctaggtacatatgctctgttgtaaaatattattactctttagtaagtggcctaaggcaagtcatttgagattttaaaacccatttcctcatctccaaaaaaaaaaataataccatctacccaacaggattattagaaactatgctaagattttgtgacattaaataaatgtagggtattacagagccttacagaaaagtacttaattttgccctgctagagcgcattcagttttcatttgtgttttggagaaatagtaactgtaagcaaacctgcacttggcatcttagaaggcttttgttctgccccagtctcctggtctgcttgggagactattatctgcttactggtctaatggccttttgagtatctttcctgaaatgtccaccttgattacaccctgggaaatccatgcatgtaatcattacttcaccatctggctacattcctttggtctcttgactgcaagttaaatggtgctatgcttgaattcttgacttcctattttaatggccttatttgtgtgtgcagaagccagcgtttttttcagtcactgtataatacattgcgcttactctggttactggctcatagtcttgtcagcctttttgttttgttttgttttgagacagggtctcactctgttgctcaggctggagtgcagtggcttgatctcagctcactgcagccttggcttgctggacttaattgacccacctaagccactcgagtagctgggactacaggcatgtgctatcatgcccagctaagtttttaaaaatttattgtatagatggggtctcactatgtttctcaggctggtttcaacctcctgagctcaagcagtcctccagcctcggtctcctaggattacaggtgtgagccactgtgccccgccacttatcagtcttaagaattccccaaagttggcaaccttcagtagcatatatggacctttcttttcctgagtagaacctcttagttccttgcagagtgggatctgtcttctttttcatattgcttccctaccctagggctgttcataggaactgccttgggctgagatagttcccctcatgttcctgtgtttgggcactgggctagccttcgtttctgctattctctggccagctggtgagtattgtggatttacagagagctcttctcctgagtcaccagttgagattcctgaaagattaattaggggaggtcttgtagctgctgacactcaagttgcaaggcactttaggagccttctgtgatccaagctgagcaagtgtaacataacctaatgtgtggtcacatgcatttcagaattcagactcactcagagagtgaaaggtttgaaatattggcacaaagaaatgcttttctgaaaccctgcagattttattcacacattttagagtttttaaaaagggaccattttgtaaaattggtttaaaaaaattaattccaaactttaggaaagttgcaagaataaaagtgcagtacaaaggacaccttatatactttacccagattaccatttttcctccatttgctttattattatgggtgctgtttatttaagagagagggtcttgctctgtcacctaggctagagtgcagtggtgcaaccttggctctctgcagcctcaatctcctgagctcaagtgatcctcctacctcagcctcccaagtagctgggacgacaggcgtgcaccaccatgcctgattttgtatttttgtagacatagaggtctcactacgttgccctggctgttctcaaactcctggcctcaagttatcctctcaccttgctctccaaaagtgttgggattagcatacgtgagccactgcacccagcctgtgtatatttatatatatacaaacataatgttttttatgaactatttgagactaaaattcataaaattttaccttttatccctttaccttaaatatgtaaggtgtatttcttaaaaataaggattttctcttttataagcacagtacagtacagattcaacttagatttaaaacattgctgacgtacttttttttttttttttttgagacgcagtctggctttgtcgccaggctggggtacagtggcgcaatctcggctcactgcagcctccgcctccggggttcaagcaattctcctgccttagcctcccgagtagctgggactacaggcgtgcgccaccacgtccagctaattttttctatttttaatagagacggggtttcaccatgttggccaggatggtctcagtctcttgacctcgttatcagcctgtcttggcctcccagagtgctgggattgcaggcttgagccaccgcacctggctgctgatgtacttttgtctgattcatatttcagttttgtcaattaacccaataaagtctttcataatatttttccatctctactacaggatctagtttagggtcagttacatacaattagttgcacatcttttttttttttttttaattgtactttaagttctagggtatatgtgcacaatgtgcaggtttgttacatatgtatacatgtgtcatgttggtgtgctgcacccgttaactcgtcatttacattaggtatatctcctaatgctgacccttccccctcccccccaccccatgacaggccacagtgtgtgatgttccccaccctgtgtccaagtgttctcattgttcaattcccacctatgagtgagaacgtgcggtgtttggttttctgtccttgcgatagtttgctcagaatgatggtttctagcttcatccatgtccttacaaaggacatgtctgatttctttaattgggagcactttcacagccttcttttgcttttaggacattgatgtttttgaagaatgcagtcttgcaagggactgtgttctttgcagaattacgaagagaccaattaccccgtcacgatttgtattaggtttttattttttgggatggactctcgctctgtcgcccaggctggagtacgatggcgcaatctcagctcactgcaacctccgcctcctggactcaagtgattctcctgcctcatcctcctgagtagctgggattacaggcatgcgccactgtgcccagctgatttttgtatttttaatagacatggggtttcaccatgttgcccaggctggtcttgaactcctgacctcaggtgatccacccgcctcagcctccctaagtgctgggcttataagatgagccaccgcgcccggccctttttttttttttttttaagttaaagagacagggtcttcctctattggtgcacatgtgtggccatagctcactgcacccttgaactcctgagctcaagtgatcctcttgcttcagtctccccagtagctgggactgtaggcacgtacaaccacatccagctgtattcatacttttaaagcttagaagaagttatacagcacaatggacctgcacaatatttaaaatatttttaaattagttagcatcatttaattgagagtgcataacaatctgtgtttttagcttcttttgagaaaatttggtaatgctggcttatgtaacagtgatggaccaggagttctccattttgccttgtttgcagttctcatctggcccctgtgagtatttgagattgtaatctctgacttagagtcatacaaacaaacaaaacattgaactttttttaaccaactcagatgctgttttgattaaactctttttttcatgcattacctcttaatgttatccaaattgcgcagtgttgtataagatttttgttgacttctggtcctggtggttttgttttgtttttgtttttgagacggcgttttattcttaccaggtgggagtgcagtgcagtagcacattcacagctcactgcagctttgacctcctgggctcaagtgattctcccaccttagcctcctgagtagttgggactgcaggcgcacaccaccacaccaagctaatttcttaattttttgtaaaggctgggtctcactctgatgcccaggctggccttgaactccttggttcaagccatcctcccaccatggcctcccaaagtgttgggattacaggcatgagccactgtgcccggcccttttccagtgttttgaattggagattgtcacatacctgtaacacagtggaagggaatccctattagcctcagatttctgttgatcattggaatttttttttcaaaagcatgctttcttggggaaatctactgaagactgaggaaacaaaagtagctacttccctcttccagatgtcttctaagtggaggaaaaaggagttttcttttttacagacagttaatagcaagccttaccaactcttggtcaaagttctggctcattatatttaaaagtagcttttgttcatttcctactttacagttgattagatttgatttgtctgtcttaggatttgtgtctagccaaccaccttttcccaataaaggaagaaaactatacacatttaaattgcattttgactttttccatgtctatttacattgccttggggcctcttggctaaatcttggtatttttctccctagttctcaaaatttcgggaaaaatttagttgaattatgtgtttttacagtatctaggggggactctgttaatggcctctaaagctggatattgtaagtttcctttgatagacattttttgctcacgatctcatatcttaaactattctttattgtagactgacttacaatgtatggcttagtggtggagtcttgataagatttgcattttataagaggccagtaatgtaggagaggacagcagtttcacatgtgggagagccttatacatctgtagggttgggaagtaatttctttgtaacagctcagtcacttttttcacttcacccattcttcacagtgacttagtattgctggtccttactatcttttttctcgttcttgaaaatgaaaagaaaacgtgaaagaatccaaccaatttcaaatatacatacacacacacttaggccttttaaaccttgagtttttcaaatactcccaggacgtgtaagcctggctttaatgtttcctgattctttggtcctcagtgagttatgattgaaagtagcagggctgagggttggtgatatggccaagcaactcatttcctcactgcacttcagtttccttctctgggaggagaactttggactagttgatttgctaagttttttttttctttctttctttcttttttttttttttgagaacagagtctcgctttgtcacctaggctggagtgcagtggcccgatctcggcccactgtaagctccacctcccgggttcacgccattctcctgcctcagcctccagagtagctgggactacgggcgcccgccaccacgcctggctaattgttttgtatttttagtagatacggggtttcaccacgttagccaggatggtctcaatctactgacctcgtgatccgcccgcctcggcctcccaaagtgctgggattacaggcgtgagccaccgcgcccgaccttttttgcattcttatattgggagattctaagtcctcctggttgttcataagtctgtaaatctgtaatctaactggaaaactctagcctcaacacatccattctctgtgtttgctgtctgctatacttatagaagtggacctcattggtggccctggtttaggttctcaattcctgggggagatatggtaattagaatttattggtgaatctttcttatctgaaggactagctgttcatattccttcaagcatgcttctacttctctccagtttgactgtgtaagccccctctgaggggtaaactgttgtggacttggtctgagggagactgcagactcatgctggtctcccacttactgtaaacatcttcctttcttccttcctggtgatcaccttatattccttggattcttagcaaacatttattgtactatgctccggggaagcagaattagaccagtgtccagagtgtatatacgaaggtctttgttttaaagagactgaaggatattaggcaatactaacaggcctttctgtcttaccagaagcacccctacccgtctgactgatagactaattgcgcattctttcattgatttttttttttttaacctaacaaagaaacatctccatttgcctgactttggctaaactctggtacaaagacgaacaaaaagtcttggtgtacaaggacccatctactggggaaatgcatatggaaacacgcagtgctagtagaagttgaataatattcataaaattgctccactgaccgtccgtggaaggcctgaattgttgttttttccccctaaggtctccaccaattcaggtttagggtgaccgttgtagcttttaggaaggttctcaatctgcacatcagccacctcctttcaataagctttcaccattacttgacctgttctcccatgaagaatattgatttgacatttgtcttgttgtagctgttgtctttagtatgacctcattccctataaagtgacccataggcaaattggtaattgtttgatttacagagaagccccaggcacttgcctgtcagttttttcctaggtatttcatgcctagcagctattacatgtttcttccctcttctctgtaggtgagaaatgagtggggtccctgcaatatcttgttggattttcaagtaaactaaaactgtttgggatagtaggacgcctgtaggttatggctctttcaagccttctaagaattcaaggagcaaaggaacatctactgtatctaataattattaaaaactacatctttagctgaacagattagttatatgataggtttattgttgaaaaataattttagggactgtttccttaaatgtattctagagacttaaaatatctagtatagtggttctcagagtttctacccagtatcagcattacttgaatttgttgaaattcatattttttaggcctcaactgagacctactgcatcaggagctctgactagggcccagaaatctttttttttttgatggaggaggggcagataggggcagggtttcactcttaaccgcctagggtggagtacagtggcaaaatcacagctgactgcaacctcaaactcctgggttcaagtgatccttccgcctcctcagcctccttagtaactaggactgtagacatgctccaccaggcctggctcaattttaaaattttaactttaatttttctggagaggtgtcttgtattgctcagcttggtcttgagctcctggactcaagtgaaactcccaccttggcctcccaaagtgctgagattacaggcatggaccatctcacttggcccagaaatcttttttaacaagccctttaggtggtcctgataacattttaaaattttggaagcactgatcttgtgcatgttatggtttcaatcttgtcaataagagtagtaaatgaaaaaagtacatatatatccatttttatttatttttgttactggagataaaataggaatcgatattatgtagtccaggaaggatcacaattcaagtttaaatggagctagaatctcttttagcatgtctaaaatgtgcatgttctgccctttggatagtaaaattgaaattggttttgtcggattatttatcttgaaggattcttttagaaaaaaattactttgttttgcttttgatcacagagaaaaatggaaacaggaaccctcagaagatgaacaggaacaaggcaccagtgcagagagtgagccagaacaaaaaaaagtaaaagccagaagacctgtccccagaaggtgcactgtttgcttaagatctctacttgggatgagcttaatctgctgtagattgggaaggataatgtcgtgctgaaatgagagctttaatgagatgcattgtgttttgattctgcgttttagatatctgtggttcactttcagccagcctacattgcaggtcttactgcttctttcttcgcagactggctatcgtggggcaaacatgtcttccgcttttagtaaaactccttatatgtttggccagggtacagtctctttttgggagaacaaattgtttaaaacactgtttgcctggcttaaagcatacttgagtggtttattaccttgttcataaaatctatataacattaaacaaataatctgattgtgtagagaaggaggtaggctgaaatagcagcaaattatgctaatttttgataagacagatggcagcctaagatagtgatgacaggaaaagggagtcagaagacaggccccagggaaaatttcctccttgtagtattgcttagaatggactcagcaaactatgccctttgggccaaatttcatccaccacctattttcatatggcctgtgagctaagaatagtttttatagatgaacatttctaatttacagtttaaggatagagagcactaaatttgaactccaattaagtgaaatgttatcccctcaaaaacaattctgttctcattagtagatatatattgcagtaaatgtacctgattatttcattttgaattatttaaaaaaatttgtgaaaatttattttctttcattatgtaaggacctatacattggtccccattttgcctcttggctggcagagcctaaaatatttactctctggccatttacagaaaaagtttgccaacctctggcctaggacattgtacttaccccccaacaccagcaggggaatttgtcaactgaattttatcttattttatctcagcttaataagtttatctcagaactgtcacgccagttctgtcttttagaattttgctcattatttattacatcgttgatcatctgtttaggtttggttatgagaaaggtatgggaggtatgagagaaagagataataaatgtgatcatgagtatccatttctctccctctctgacttctttcacctttttatcactgatggaatatttggggatttccttaggtgagcttctagactgtggctttcaatcctggccatctccctggtctgtccaagttaattctgtgatagggcacacagtctctcaggtagtattccaggtatattttatacacatacagtaaaaacttatgtatagttacttcttgtgctttactttcttcacacagataatagcatcctctgctgcttgttctgtaggtttctttatcctggaaatcctttcgtattagtatacaaaaaactctttttttttttctatgagtacatggtactgtttagtttccagttgaagaatatttagagttttcttaatgttttgttgttgcaaataatgctatagtgaatactttattatgcctgtttaggtgtatatcaataggattaattcctacaagtaaaactgttaattcctacaagtaaaatagtttgatagctatttccagtttgcccaccaaagagatactatcatgaacaacatgctgtgtatgtgtttttatatcaggtaatcctgatgaacatttgtgaaacattcacgttctttcccataaatgattgaggattatcagcattagaatgaccttcctgttggaaatccagatttctagtgaattagaatttcagggagtagggcccaagaatatgcatgtttaacattccccaagtgaaatgttacattctgatgtatgaaccactgctctgggaaatactgttatataaagtagacaccaaatgataaagtgaagacttagccttttgtttctcttctcattttagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttaggtaagttgtaccccagaagtgtttcactggtgtgatgtgataaagtagttggttagattttggttctcataagtccggggttgtgcacttaatagataaaaataacagcctatgtcctgaagttgttttcagaaatctggttagctttcttgcaaaaagagtggtattgagccaaggggaataggaaaagagtagcaatagctcatttgaagccttcattcctaaaaaacaccacaagttcgtgtcctgtccaatggtgacttagtggcattatcttcatttcataacatttttttccattaaagatatttggattatattcctacttctgaattgctctttgaatcacagacgtttttctgaggttcagcttaacgtattgctacttgaatctgattttatcaagtactaataggatatgaagcattaataggaattatcattagtgaaataggccaggctcagtggctcatgcctgtaattccaacactttgggaggccgaggcaggcagattgcttgagcccaggggtttgagaccagcctagacaacagggcgagaccctgtctctacaaaaaataagaaaaagccgagtgtggtggcggcatgcacctgcagtcccagctacttgggaggctgaggtgggagaatcctgggagatggaggttgcagtgagttgagatcacgccactgcactccactccaggcaaaaaagctagatcctgtctcaaaaagaaaaaggaaaatgaaataaaggaacagatatatgcaaacactagtagtttactttatagaaatcaagtatttttttttttagattttacagatttgttcttcatagagatggtgaaaatgaatcctagagatattcataacttattcaatgtatccagttaataattccaaagctaggactgggctttgagtatgctagtgtatagcctagcactttttcttactgtaactgtactacatccaggattgtttttctttcttgtgactcaatcattcattgttaatatgtgataggaagttacatatataaaaatatatataaaaaatataaaaaatatataaatatataaataaatataaatatatataaatattataaatatataaaaatatatataaatatataaatatataaaaatatacatataaatatatataaaaatatatataaatatatatataaatatacatataaatatatataaaatatatataaatataaatatatataaatataaatataaatataaatatatatataaatatatatatataatttttttttttgagacggagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatcgatacggtcaccatgttggccaggctggtttctaactcctgacctcgtgattcacctgtgtcagcctcccaaagtgctgggattacaggtgtgagcctccgcgcctagccaatatgtttctttttttaaaccaggaagtatttgtgttgaagcttccagcagtctgggaatacttaaatttcatattcttattactgggagacaacatacagggttgacatttttaattttagaaatattgcttctctttttgcctgatgaaatagtagcaaattttttcttccattatggtttttctttttttgtgtggtagtctacttgtttacataataatctgatactaaaaaatgaaaaaaatagaagtgtccttatagttttctatatcttgcttatacaaatcagtataaatatagaatttttattttcaaattgagttagactccctacagttgtttaggagcattcatcagcactttaggaaaaaaaagtaagctttgagcctactgtaaatggcagatctataaaacaacatgcttttggaaccaaaagggtatggtttcttattctagtgacggttatgtgtggcagtttaattctgaagagatcatttctcatttattcagcattattcctcttgcagttacaaagaagatgatgactttgagactgactcagatgatctcattgaaatgactggagaaggagttgatgaacagcaagataatagtgaaactattgaaaaggtcttagattcaagactgggaaagaaaggaggtatgtgtatttggggagcaaattacattttatgtatgcttagtaagacttagattttaggtattttaactctaatgtgatgaattttagtctactgctgtatttgttgtgatatgtagaagtctttctgacccagtgtttcagagctgaggacaaaggtatgtgtacactatgtctttaagattttaaattaagctagtatagataagtgtcaatgttttataaagcagtgatatagcagagatacctgctaattaacattaagcaaatccacctttggttatttgtttcttaagctccttgtgaaaatatcaaactggttaaataaatattgtggtaatattgaagatttttaaatatctaatttagatatctcataactaagttgcattaaagtaaactttctgtaaaggaaataccaaaataatacttaatgctttttcttttggcttttttttttttttctttttttcattctggcttcgattgaggttaagaaagttaaccggggacttcgagtaggggaggttggaggaggatattttggtgttctatccttagtcttggagagagggatttgttttccgagttagtaagggaccaaaacaaaaggatgttgctgctctgtttttattgtttttgaataagggatttctttgatttcacctgcaaatttaggaatatgtaaaaagtggtttacatttttaaaatacttgaaatttttgattgagtccgttctgtgttgtttgtgagtttgtacttatttcaagttgaagtattttggtgcttcatccacaaagggagtcttcagataattgcattcttgggaagctttttaatatctggtgtaatatactctctttcaagtgtacttaatccttttgcagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggtatattttccatcatggattaaagaaatgtatttgcagcctgaaagaagggaaggttttaaaataatgcatggagatcacagctatctagaatctcagattttgctttgatcatctaaacatggagccatttacaattctattttataagattgtgaccttcagatactatatttttatatgtggctaccaagtttttggagttaactagcttatggagcgttattcacacattctttagttttcacaataagtgcatgagatttgtactgttattacccattttgtagatggggagaatacggcacacagcaattctgcaagtggactcaggttttgaattctgatgccctgaatccagagcttattctcttaagcaccttgttattttcctgtagttaggctggggtggcttagatgtagagagttaatattctggaactctctgggttatgatatacttaaaacaaattctggttttatacaatttgcagaaatgatgtgaaggaaattattaggttaactactgaaactgtgatagtcctcgtgtgtttagtttacttacagccttgaatgtctgggtgttgtatatgggaaatatgtggagctatagcacacaaaaacctaaactgggtaataatggtatcaagctcagcctgaagacatacctgtctgtgtggtgtgattagcctatttttgtgtctggaatgtgcatagatttttgtgtctggaatgtggacagtaattctggttttactactgtgcaaaatgtgctactttagtaaattacatgttttttctttgactcaaaactgaaaatatgtaccccttagatggtgaggtaggcttgtaaagcagttagaaatttgaaatcctctgaaatataataattctaatattaagttgctgctgttgtcatctgaaaggttttggtaataagaataactagttttccaagtcatgtttaatcaatcctaaaacccatatatatataagaaaaggcgtacagttttattatcctgatttgttgagatgtatgaatttgccacatgaatctatcacataaaagagttatttttgggtctctttttagacaggacacatcagaggcaggtaactggtatatccttctatgagtgtaaggttttcagtgttctctaaaagtgttttttttgtttgtttgttttgttttgtaaaatctctggcgtaattactagtaaagattacttaaggggcagatgggagtaaaaaataggttttcttttccacctttgacttttgctttgatgtatgtggatccccagactttagtttatgtgtactttttctgtctgtctgccattcaggttagggaaagtttctcctgaagatgtagaatatttcaattgccaacaggagctggcttcagagttgaataaacagtatcagatagtagaaagagtaataggtaagtacatggtaactcacttcagccatatttgaacttgaggaatagtggcttttgcttttggaagtaatgtaaattttaaaaatgcactttggagactagacacgtgctaggtttattttaaaggaaaagctaagaagatttgctggtaaatttggatgtgggggatgagagaaagaggtgttaagtatgacctcaagatttgtggcctaaacatgtagaagtttagaggtaccatttaccgaagtggaaagatgaagggaagagctgatcattggagtggagaccaagagcttagtttgatatttgtaagtttgatttacttcttagtcatctaagtggagaatatagtgaaggctggagcatatgtgaacctggagcttaggactctttagtctgggctggagatttaaatttggaaatttatcagtatttagtatttaaaggccaagattgaacaggaccatcagaaatagagtatcacgtggtaagaagaagtagtctgagagcatttcagcttttggaagtcagaaagaagctagcaaaggagactgagaaagaacagtcggtgagacaggaggagagctgagagagagtggtgtactggaagccaagtgattcacatagccaggagagaggaaatgctgtcagtcaaggacgattaggactgagacttgatctgtgaatttggcactggcaaaacgcatccatggagtggtgagggtgcggcctgattagggtaggttcaagagaaaatgagaggggatagcaagtataaacaactcgttgggggagttttcttacaaaggggaacagagaagtggagtgtcagcctgagagagagatgagaaaaagaatttttttcttcttcttcttcttcttttttttttttttgagatggtgtcttgctctgttgcccaggctggagtgcagtggcgtgatctcagctcactgcaacctctgcctcccgggttcaagtgattctcctgcctcagccttcccagtagctgggattacaggcaccccccacccccaccacgcccggctaatttctatatttttagtagagacagagtttcaccatgttggccaggttggtcttgaactgctggcctcaagcaatctgcctgccttggcctcccaaagtgctgggattacaggcgtgagccactataatcccattttttttttttcttttttaaggtgtgaggtagtagaatatatttacattttattcatagaacccaaaatctttcattcttcattgtgtttataacttttctgtcttattttttatttgtttagctgtgaagacaagtaaatctacattgggtcaaacagattttccaggtaagcaagaaattttatttataaatgttcttcaacatttcagaacagtgtatgttttgcagattattttgttttgccacatgatgttttattgattatgcataaaacagaatgtcatttttcacttttaattgacagttgctaatctataaattttttttatatgaaatagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggtatggtgatggttggcttttgttttttcagggagaagatatactgataaagaggattggacacatatgtgctgagaaaatattacaaaatgaaatgatgattgccattttgaagtgaaagaaggtgatttaaatatgacattaaagcaaaaggagagaatgaattatttcatggctttgctgacttgtttaatcttgcaatttacataattagaaatagagatatttgagagaatacttgaaaggatttaggcacttttattttattttattttattattttattttgagacagagtttcgctgtgtcgcccaggctggagtgcactggcactatcttggctaactgcaacctctgcctcctgggtttaagtgattctcctgcctcagcctcctgagcagctgggattacaggcacgcaccaccacttccagctaattttttgtatttttagcagagatggggtttcaccatgttggtcaggctggtctcaaactcctgacctcaaatgatccacccaccttggcctcccaaagtgctgggattacaggcgtgagccaccatgcccagttgcatttaggcactttaaaagagaagtgaagccagttgcagtggctcacacctgtggttccagctacttgggaggctgaggcggcaggattgcttgagcacaggagtttgaggccaacctggggaagattgtgatacccgttctctaaaaaaaaaaaaaaatagagagcgggaagtgatagaaaaggcgagtgtctttgaattctaagttagaaattaaatatataggcttatttgctagattggctgaataaatcctttccttggaatttattccatcaggaaactgatgtgcttgggtcctcagtaatgaaatatcagacaagtgatacgtctctgagaagttgacattcatgttaatggcactagaattctatctgtgaaaaccagtatttaattgccaaagagtgtgatagggaaaatgtggtcagagaagcaccaatgtagaagtctctgagctccagtggtcattgaatgggttttaagaggaagttgtggttgttgaactgcatctggcccttgtataatggattggtgctgctggctatacagacaagagggggcccagggtattgccctcctgtgaaaggtatcaagagaaagattcttatagttcaataggagaactactagaccccaggggtgaggagaagaggaatgatgttgacaagtacatcaaggtcaaagtgtgtgtgtcttggctacctcgaagggtattttgactttatctcctaggtattcgtacagctgagtacagtggcattatgaaatagttttatttagaaagcttcatgtaatagcagtatataggagactctggagtaagtaattattaaagccagaaggtccagccagtaagatgtcattgaagtccacgaatgaagaagtagtgtgaggacaagggaagtaacagtggcgtggaaggagtggatgggagaacagttatggggtaggtttggtaggagtggatggatggctgggttttggagttgagagtaagcagtcggattccattcactgccagccgccctcatagagaactgaacacatcaataaccttatcaaatattcttattagaatgatacttctcataatgtgtgctatagagcactaatcttcagagaaaagtcccctgaaaaaagactttttggccatgtaactttgagatacatccctgaatgaatttctcctgtaaattcacgctatggacacacatttcagactttgaaaagtcatgagtaaagaaattgtataactttttgatcggttgtttcctaaactgatttggccacagaatccacattttatgcaaaccatagagactgacctcactagaatgctatcctttaagcttctgggggtgaaaacaaccttcccttcagaagcttgtttctgaagggaaaaccaaattcacgcaattaaagggtttaaggtagatgggcggcatttctgaatttacaaatcctgttatggtgaagatcaattgtatttagcatatgacagctggaggcaatgttttgtactctttagaatcagataacagaaagatagttgtttctgaaaaataggagactctgactgccatataatagacaagacctaaagtgctatttaatgatgttcatagatttatttcaggaaaggggcaagttaactaaaaatattttatttgaggatgaactaactctggcttatggaatattaaccatgaagaaaggggtgatggagtgaggtggtgattcacacacatgaaatttaagtttttggccaggcgcggtggctcacgcctgtaatcccagcactctgggaggccgaggtgggcagatcacgaggtcaggagatcgagaccatcctggctagcatggtgaaaccccatctctactaaaaatacaaaaatagccaggcgtgggtggtggcgggcgcctgtatgtagtcccagctacttgggaggctgaggcaggagaatggcgtgaacccgggaggcagagcttgcagtgagccgagattgggccactgcactccagcctgggtgacagagcaagactccgtctcaaaaaaagaaatttgagtttttatgctttgatgccgaatatgtgaattgtggctagcgttttaacatagtagcagtaagaacattttctcagacttgggcttttgtttttcaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgagagaaatgcttcctgggagtttttatgtatgtgtaataccattttattctgatctaaagaatactttatttcattatttggtgggtaatttgtcatagccagaaacctgtatcatcatatgttactcatgagtgtatatagcaagttaagtcactcaaatctttaatgtggaaggagttactcagaagaaagaagaagatgtctttttcacatgtattttctttctaggccagggaagcctttaaattaatttcctacagtagtgctgtagagagtgtgattcccctcccttcactccactccctacctatatagtctgtaggattatcctgttcagaggaaggttgaacctgtgaaagtatcctttttataagaccacgttaatcttgggggggtgaaaaaaagatgagacagtgatagcactggaggtttaaaggtacttttgggaagtacttacaaatttccttcaccaatttcaagtagttcctaattactaagtgctaggtgttagaaacaaatgcttgttcctcggtgctgaaaagaactagtgctcaaggaattttctcagcaaggcaattttactttctgcagaaagggtgcttcttggaagcctaattgtcatgagagcacaccgaacaaagaaaagcagaggtttttatccctgactcattgggttcttactgctgcgtcctgtctccattggctggagctggaccgcacaatctagactgattccgattggctaaaagcttaaaactttcctaaatagataaacgcgcagtggaaaacaaaggaagggggttgtttacaggaaattaggagaataataacatttccaaataaggaaggggtgtaggctgtaagctgggaaatgcctgggcacgttcggacatgtctgagcaggttatagtccagaacaaataacctggttaaagtacaaggacatagaatgtacttattcccttactatatttaacagccacatagggcttaacaaagagttattagcaaaaagcaagggagcttgaaggaagttaatttctaaaagaaactgttatttctaacacttgttatttattctttaacaaaaagggaaactttgaagaggaactttttacttttcacatgcggatccattagtcctcgagaatttaacagtgaacctatatagatgtattttgctgtccttacagaacatgcagtgtaagaagtacctttaatgccaacctacacacttctttcccgaagtacccaattaagtgcaaatgcttaatgtctttagtgttttatagtaaagcaaaaaatccttatttagaattagaagtacaggcctgtgcaacatggcaaaaccccatctttaccaaaaaatacaaaaattagctggacatggtggcatgcttatgtagtctcagctacttgggggctgaggtgggaggatcgcttgagtccaggaggccaaggttgcagtgagccattttcgcaccattgcactccagcctgggtgacaaagtgaaacttcaccttaaaaaaaaaaaaaaggacagcttaaaaaatatttttcccctcattgctgaaaggaagctttctagttatagagatgcatttacagtgactttttcccaagtgaaccatctcctactttttatctgataaaatctagtacaatatttaatactcagttgtgaaaattaggtgtcttgagaagattgagaatgtgggtttgatataatgattctgaattgcttaaaaatgatttttccttttagaggttagtgggacctaattcatctaaatgacagttaataaaagttagatgaactttaattgtgatctaatcctctcattttataattgaagactcttaggaacaaaggtgccgtgtacccatccagagtcacatggtgttttgtgtacagtccttggccagcattttttagactttttattttttagtttttttgagactgagttttgctctgttgcccaggctggagcgcagtggcatgatcttggctcactgcaacctccgattcccaggttcacgtgattctcctgcctcaggctcttgagtagctgggattacacgcacgcaccaccatgcctggctaatttttgtatttttagtagagacggggtttcaccatgttggccaagctggtcttgaactcctgacctcaagtgatctgcctgccttggcctcccaaagtgctgggattacagccatgagccaccgtgcctggccagcatttttttactttaaaccaaaggaataaaaatcagttgaaaagggctcaagcacctgttaagccctggtcacaggaatgttactacattacataatgtgctattttggtctggttccagaaaaacaggtgaatcaattcaaacctactgtagtctgtatatgtagacaatggcattttctaggggcaggaaatactggagaaacttaactgtgcttcctcctgaatagtattgaaaagtgagggaaataagaaggaaattactcaaaggaatatactacatcgtttaaactgtgtagaaaattaggtgtacctgagatgtataggggtatggcttcatcattctccctttcccaagtgtgatcttctttgtttctgtattttaccctttaaactagctagtttgtagaacacagaaggtatttttagaaattatgtctttttggtgaattaaatgtcttgttttttgaatcagttaggttgcctttaactcataaattacttttagttctttctgatttgctgattaagcacatattatatatacgtgcaaactttcagtgtccttattttccagaacctttttataatgtttgcaatctgatgtcttacatgtaatcctaatttcctgccaaaatgactgtattctgtttcccaaatatattttcctaactctggctgtttcttcaattttaaatgtttttcttagatattctttttccattaatatcctgttgaaatctagcccattttgtagagtagtgtttctcaaactgtggttttaaggtagtgcttcccaacctttttggcactagggactggtttcgtggaagacaatttttccacaggctggggaggagggagggggatggtttctggatgattcaagcacattacatttattgtgcactttatttctattattattacattatactatataatgtagaatcagtgggagccctgagtttgtttttctgcaactggacggtcccatctgggggtgatgggagacagcaacagatcaccaggcattaggttctcataaggagtgtgcaacgtagatccctcacatgtgtagttcatagtggggttcatgctcctatgagaatctaatgccgttgctgatctgacaggaggcggagctcaggcactaatgccagcaatggggagcggctgaaaatacatatgaagcttccctccctcacccgctgctcaccttctgctgtgcagctgggttcccgagtggggaatcctggtctggtctaaggcatacctgagtcagaatctccaaaggtgtttgtcagcccttttccatatattgtttagtatatctagggtggggtccacaagtatgatctgtagcctacccctgctttagaccaaagtgtatttaaaacaagccccatgcacctatacatgtaggtctaggaaatagtgtgggtggcattaaacaacccagtggcctgcagtggaatggggtgggccagccacaggattcaccagcggtgctgatagctttctctattgatggagtctaaggttacatgcttgtcttcactttttacaaagcctgtcttctctgtgataaaagatagcctatggaaggtgatgtgaaaagcctaaaggtaaagagtctgacaaggctgtcatagtaatccaagtctaggtaggccacttgttattctgctttttatggtttctactttcttccttatgttgaaagctgaagtaattgcagatgagaagaaatacatttgaggcttatgaatgacaccttgcttggctgttattgtgaagcattggtgtcgttgctgtttatgcacattctgtgttttggtgaactaatgatttttttgtttttatttattttttctttctgcagaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacggtgtgtaaacaaaaagagctgggttagaatctgtgttataaatgtaatttagaaattcacttaaagcctttagtagatcatcagtaaaatttgtggttattattctgatactgtgctgtgttctcaatattaggaggtttatctatcacaaaagtgcaactcagatgttctttaacaaatatgcttactagttaaaaagcaacagcagtatgtgagtgggaatctcttttagctgggttgcaatattaaatttttcttctctctgccctttttacttctaagattgctttatatgagataatatggagttaatactttgtgtaatattaatattatttttgctttctcaatagacatattactgaaaataatcattcttcgaatttcttaatttcttaaacagtgaggttgcataacttataaaaaaggaataaaagtaaaggaaaacaagctattttaggactgtagaaataagaattatcctaaactgttaccaaactttatttgggcatcatgaatttagaacacagtgacttaagtttatctttgtttagcagatcttttctttatagtaactttttttaaagcacctactgtgtgctagatgttgcgctgggtgctttacgtataatacctgtaatcttcatgatagtcttcaaagctgatggcattctttcctgctactgatgaagaattgactcagagagtcttaacacgcgaccctagcgagcaagaatgtggcagagctcagattcggacacaggtgtttctatctagtctagagctttgctctttcatcactgtatataaactatttctgggaaattgcttgtaataagagcaagccattagcaatgtttaaatatttgagttgcatgttgtaaccatatattttcatacaaattcaaatttatttttggtaaatactttcattaaaattgtgtaacttaaacactggctgatttcattggcctaattttgagtttctaagaatatagttttagctttgttaaatcattagttaaccgttaaagacgaaaaaagagaaatttataggtttacaaaatagcgtaaagcactacattccaaaaatgattgcaaacaaagaaaatgaactctaaaaaattgtagtcagagaagttttccttgctatctccagttctccttttctttgttctttttacccccacttgggggcgatcacctgcaggcacttactgtcttgttctccagttcctaacttgacagccaaactgcaagagcgttgtcatgagtcttcgtgcttgctgagtgtccagttatacttcagtatgaatgtgctcatctttgtgttcttttacattgacgttattatacgtattgcattatattttcatcttacaagcctccctttttgttgggggacatatctctttggtctatggttgatgaagttccaaaggttggaatttgttttacttgttaatatatgtattttcctattcaaaaagtaaataaattgcatttttaaaagaaatttctaaggatctgggagatcccttgttgagttccaatcaccagggttcagtagctgatgaagtgcattttcttcagtagatgtatttctgggggccagtttcttctgattctggcaataaagcttttgctgttcggtggtcagtgttttaattctaactcttactgctttatagtttggttgcttaggtcattttagaatgtgagatattcattgaattctaatcagatttattttttatttggcatgtttctattacatcaatcacaaaacttatgtgatatagaaaggtagaagtagaaattatgtcttaattatgtttttttcttatagatacgggaatatgaatggattcattcccaaaccaaaagattgaagttcaacgcacttataacaacatatgagatcctcttgaaagataaggtgtgtaattaatatctaaaaggctaaatcttttccagtgcgacttgtccagatggtagggtctgttactgttctgtggagcatgttagaaataaatacttgaaagttaaaaataaaaaacaaatggtagggtctgtacctcctacttgccatgttacttttcttctcttatttcaaaaagcaagcaaatgaacaaccagaaaaattacttttcaaaggatattaacgttataaatagaaaacagaaccctatagatgaggggaccttaggtcaccaagtccagttgaattaaacagaatgaaagggtattgaataggtcagtaacttacctgagattattgtcagtcattggatgccatctcaggtatttcccttgaatgtcatcttaggcatttcctattgtatcattgttaaggcatttctccagaaaagatgatgtgaatggtctttgtgaggaggacaaaaataagaagctctttaaataccgcctttctgctaagaaatatatgtggtaggtagatcccattggtattaagtgcaaacaagttgagtttggtggctcttggtgtttgtgtgcttcagggttggggtggagaataggcaagagaaggaccataattaaggggagaatacagaatcatgtggtttttttgttttatttttgcccagcatagcaatttttgtgttcttgctgtggggcatgcagtaatagctggtataagaggcccacctataccttttagatgatgatactctcttttgaatagctaccaatctggcaactaacagaataaacagaagaggcctaatatatattgtcagtgaagaataaatgtgtcaatttatacctttgtaatggtatttatacagagataattaacacttgaaagcacttgtgggttcccttctgacctggtggctcgttctgttttgtttttactttagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtaagctccttcctgtgtatttcaaaagatgctagaatgtctgaaatgccaatgctttttaactttcttagtagaccttagggaaaacagatggcatggtttggggaaagcaaagcgtcaaatggaggcagggatggcggtagtaaaatgtttcataatcaatgaaagaaggcacagaaattagcctgttaaggaggaaagcagtattgtctgctgaaaggctgaattagttaatgcacttgggaaataattgttaaatagataacatcagaccttttcactgttggtataagataatcaatataagtaaaatgaaatatacaaggtacacaagcactgaaaagtatgttatactcaaatatctgataaccgaagcatcaattttacatcttattcacgtattattaaagaactatggaatgtgtttattgaaaagatttttatgggagagatgatatgcacatttcataaaacttaaaattatccaatggtattcagcgatacttagaataacatctatattcattaatttggaggactccactcagtctggccccttgacaatagtctgattcctctcatccactttctccattactcattatgcttcagccattctggctatctttctgtcccttaaacatgccaagccattactattccttcttgactagaattatatttcttcttgtcttcacatggccaaccaccttaatgtttcagctcatcttaaacgaccacctcctttcagaaatcttttgcagattgcctaacctaaagtagccctttagacatcttatccctaacctgttttagtgtctatatagcatctctttttacatttatgttctcattcatctcatgtcattaaattatgtatgaaaatcgcagggattttgtttgcttgattcattgctggttcccattgtctagaatagcacctggtgcacagtaaacaattcagttaatagttgttcagttgatagatatatgctctacaatctttttttttttaattcaggattaaattttattttttacttttatttttatttttaaattttaaatttaaatttgtttagtaactttatagtttgcaaccatcatcattgtccagttttggaacattttcctcatcccaaaaagttccccctttcttgtttgcagttaacctctgcttccacatatagccttaggcaaccagtaatcagcttttgtctctagagatttaccttttctagaagttttatataagtggaatcctaatatgtaggcttttgtttccggcttccttcacttagcatattttttttgagattcattcatgtcagagtctgtcagtaggtgttctctttcattgggtaatatttcattgcatccagttaccggttgatggacatttggattgctttgttttggggttattatatctttgtgtggacatatgtttttctttctcttgcttagagacttaggaatagaattgctggattgtttggaaagtttatgtttaacattatagaaactaccacgctgttttctaaagtgactaccattgtgcagtcctaccaaaaatgtttgaaggttctagtttccctgcgtcatcaccaggacttggtgcattgtcagtctttttgattctagccgttctggcgaatgtgtgtcattgtggttttgacttgcatttccctaatgactaatgatgttgaacgtcttttcatgtgttcattagccatttgtatgtctttggtgaaatttctattcaaatgttttggcattttaactcaggcgtcgtgttccgtcattggaactctaagcatgtgggaattatttatatcctactgctcaaggtcattgccaaggtctgattgcaaaaaattcaaaaaattgcaacctctatcataaatgggttaaaaaaattggattgtttgtcttattatgagttgaagaggttttttatttcttttaaaaaaattctaaagacaagtgctttatcagtacagtccccaactttctatagtttgatgtaaaatgttttgacttttcagtggtatgaaagcaatacactttcagtagaaagtatactttgaatgaacacaaccattctgtttttcattttcagtgtaatattcgataaattacatgagatattcaactctttattataaagttggctttgcgttaggtgattttgctcaatatcctcatgataagcgttctgagcacattcagggtaggctacggtgtgatgttctgtaggttaagtgcattaaatgcatttttgatttaacaatgttttaaacttacgatgggtttctcaggacataaccctgttgtaagttgaggagcatctgtatataatttgaacatattttatcccaatctgtggcttcttttcactttttgaatgttgtctttcaaagagaaaaagttattgattttgatgaagtttaatttatggatttctttgtatggattgtgctttagatatcatatctgacacagatttgcctaacctatggacacgaagacttgcttctttatttccttctagaagttctagcttttgtattaagtcagagttacattttgtttatagtgtgaagtgtgagtgccttagttcatgtttttgtagtagaatttgggaaattgttctagtatcacttgttgaaaagaatatctgttcttcattgaattgccttgacactgttgttgaaactcagttgacaccataaatgtcatgctttgtttctggactgtcagttctgttttattaatacatatttctgtccttctgccaatgtcacactgtcttgattaatgtagctttcgactgtttttttattttttattttttttgagatggagccttgctctgtcacccaggctggaagggaagtggcgcaatctcagctcactgcaacgtctgcctcccgggctcaagtgattctcctgcctcagcctcccaagtagctgggattacaggcacgcaccaccatgctcaactaattttttgtattttagtagaaatggggttttgccatgttggccaggctggtctcgaactcctgacctcaagtgatccaccgtccttggcctcccaaagtactggtattataggcgtgagccactgcacccggcctagactgctttttaaaaatggagaagtacaagttccattttcttctttttcaaaattgttttggttattctagaattcttgatacttccatgtacattttaggatcaggttgttaatttctgcaagaaaaatatggaattttgatagaaattgtgttgaatcatatatcagttaaagcaaaattattaatattgagtcttctaatccataatcatggaaagtttttctccatttatttagatcttctataatttttctcagtgtttagtggtttttagtttagaaatcttatacattcaaaatattcttttaattctgactatatttggagtggaatttttaaaaatataacctattatagaactacaattgggttttgtatattgatcttacatcctgcaaacttgataaacttactgttttctactgtgtgtgtatgtgtgtgtatattgttctgtatttcttagtatttttctatagacaggattatgttttctgtacctaaagatttcttttccaaaatggatgctttttatttcttcttcttgccttattgtattggcaggaacctccatcttaaatagaaatggtgggagcaggatgttggctatagatgttttttgtagataacctttattgggttgaggaggttttcttttcttcctagtttgtgaggttttaataaagaatggatattaggttttgtcaaatgcttattttctgtgtctgttgagatgaccatgtggttttgtcctttaacaatatagtatattacattaattgctttttagacattaggccaactgtttttttcctagcataaatctgacttgttaacagtgtttgatactttctatgcattgctagattcagttggctaatattttgttaaagatttttgcatctgtttggtgtttttttttttttttttttttttttttaagacagagtttccgtctgttgcccaggctagagtacaatggcaccatctcggctcactgcaacctccacctcccaggttcaagcatttctcatgcctcagccttccaggtagctgggattacaagcatgcaccaccatgcccggctaatttttgtatttttcgtagagacagtggggttttgccatgtcagccaggttggtctcgaactcctggccgtaagtgatctgcatctgcctgtctccgccgcctaaagtgctgggattacaggcgtgagccactgtgcctggccgcatttgtgttttttattttaattaggattttagtctatagctttttgttttgttttgatgtttacgttgctttggttttgggatcataaaatgaattggagagcgtttcccttctgttttctgaaggagtttgtgtaagtttagtgttatttcttctttaaatatttactagaattcaccagtgtagccatgtcaaccttcactttgtgggaaaatttttaatgactaacctggtttccagttacaggttcacttaagttttctatttcttcttgacttagttttgttaatttgtgtctttctaagagttagtctgtttcatctaacttgtcctaatttgttggcataaagttatagtactctcttagccttttaattttagttttcttttttaagagacatggtctttctctgtcacccacgctgagtgcagtggtacgatcatagttcactgtaacctcgaactcctgggctcaagggatcctcccacttctgtctcttgagtagctggggctgcagatgtgcaccacaatgcccagctaatttttaaaatttattttttgttatttgtagagatgggttcttgctgagttgtccaggttggtctcgaacttctgggctcaagtgatcctcccgcctctgtttcctaaaatgctgagataataggcatgaaccactgtgcctggtagattcttttaaggatcaatagtgattaaagttaattttcttgattatggtaatttgtatcttagctctttttcttggtcagttctagctaagggcttaacaattttgatgctctcaaagaagcaacttttgacatcattggtttcttcctctgttttttcttctctttttttttttttttttttttttgagactgagttttgcatttgttgcccaggctggagtgcagggtgcgatctcggctcactgcaacctccgccttccagtttcaagtgattatcctgcctcagcctcttgagtagctgggattacaggcacctgccaccacgcttggctaatttttgtatttttagtagagacgaggtttcaccaagttggccaggctggtcttgaactcctgaccttgtgatttgcctgccttggcctgccaaagtgctgggattgcaggcgtgagcccccgtgcccggaccctctgtttttctgtttatttccactctcaaaggttgccgtcctttgcttgcttttcatttaattttctctttttctcttaagatacagtttagattactgatgtaaaacttttttcttttctagttgtttaaaggtatgtttacttctatgcactgctttagctgcatcctgtaaatactgataattttgtgtttttgttttcatttgatttcatctattttctaaattctctgtgatttattctttgaagcatgggtttttcagaaggatggtgtttaatatccatatatttagggattttccaaatgtcttataattcggttttgtcttagagaacatgctttaaatgaatttattatgacttattaaatagtcttagtatgctttctttcctggagactgtccgataagtgcttgtaaagaataatctgtattctgcctttgtttgagtagtgttttgtaaatgtccgttcagtgtggtgttaatggtgttgttcaagacttttatatcttttctaactgccagtttagttgtgctttgaattattgagaatgaaatattttaatttttaactgtagttgagtttttgtcttctagtcattttttgcttcattattttggggttgttctgttaggtatgtatccattcataacttttgtatgttcctgaggtattgacctttttctggtcaataccagaatgtcccatttgacctctaatgatatttattgttttgtaaatccattttgtgtgattttattatagctcctcagctctcttctgattcctgtttgcatgatatattgttttccatcattcgaactggttaccatttgcatggtatactgttttccatcattttactttcaacttacttctttctgtaagtctaaaatgtgtcttatagacaacctgtacttggatgtaccttttttatccaggcaaataatccttgccttttgattggaatatttagttcatttacatttaacagaattaataatatggttggatttatttctgctattttactatttgttttccatatgtcttacatcttttttgttccactttctcctttattgccctcttctgtttcagcaagtatttttcagtgtgtcattttaattcctgttaattttttgctattaaaaaaattgtaattggttgctgtagggattgtatgcatcagtcttcttcaggttagtactgactcagttctggtaaaatagggcaactttgccccgctgtagctccattttcacttccttatgttataaatccaagaatacaaggaaataattattgctttccacaggtttgtcttttaaggacatatagaaaagagaaaaaaaatatatactatctttcatatttacccatatatttgatcattttcagtgatcttcatttcttcctgtgtattcaggtcgctgttgggtattgctttcttttagtctgaagggcttcctttatttacatattgcaaataagaatatgctggcttagatgattaaaagatgtcccgtatgacacagtcaataagtagatagacgaagatcaatagcaaatcttctgtgaccaaggccagtgtcctttgaacttcaagttctaggagaaaaaaatacatccttcataaaaccattgagacgaagtaaggtcaccctacgtagtaagagttatgagacacagtgggaacatctgtgcttgtttttatagaaaaagaattgtggtatgtagtttctaccagtgaatacttagccatgatttgcttttgtgtacctacctgctgaagtggatggtagggattttgctcctaagtggtcataattagctttttcctgccattaagtagctgtggcattccactcagcatgggctatgtttggaaaaatgtcatatatccttcttttgtaattggagagaggaactttcaattactttatcattcagggagtctcttccaaaattttcctttggccagttgaatcaattatggaatgataggttagagttagagatgcaagtttttttctgtgaaagagatcttttttctttgaaaattttgtgtttaaagcattgtcattttcaaataaagtttcaaaattgttgttcacaaagatatgtatatgaaaaggaaaccaattagttaaggagttcagatttgcccttatttctgcctgagcttgctggatgggtaactatagtcttgtgaagtattttgcctcatcctcagcagaagttcctgaggtaccttaggactctacagagcttttgaagaaaggatccactgaagaaaaactattgtaaaggagagaattaggtttagtcaaatagctttggaacttccccactcaaatgttacaggctattgtttcaaaatccaaaagttagtcctctttttaaccaactgaaattctgtttccttagtatagagtctaagtgcctttcctgcagggtggctctgacagggagtacacatgactaaccatattgggaatacttatcaatcaatagcttcattttgtacatactgtttgcaaagcatggaacttggtattaagggtagaaaaagatatgacaagattgaaaaattcggcttataaagaccatcatgtgcaaatatatacttcagacttaccgcagaaaacaagtcagtttgatagcatgtatttcagagattacatcttttagtgttgggatgattttttaaatttttacttctgtcgtctaggccaatctcttaattttttttgcacttttccttttacatatttactgtgtgacttttagcataccattttcactgctttggtttaatttccgttgttggtccttattaaagtaacctatttttctaaaattccgtgttctgcaaagctataaagatcagaattttttctagttctgtgagagacaaatattaaatacagaagttgatagcagggatttatctaaaatatgaatctttagatgtaacatggtgtctttatacatcaccactatgaccttataccttttctatatctaatattataaattaataattgttttcagggcagcagactttttctaaagaatctgatagtatgccgggcgtggtggctcacgcctgtaatcccagcactttgggaggctgaggtgggcagatcacgaggtcaggagatcgagaccatcctggctaacacggtgaaaccctgtctctactaaaaatacaaaaaattagccgggtgtgatggtgggcgcctgtagttccagctgctcaggaggctgatgcaggagaatggcgtcaacccaggagcccaggaggcagagcttgcagtgagccgagatcgcaccactgcactccagcctgggcgacagagccgagactctttctccaaaaaaaaaaaaaaaccaactcagaatctgatggtaaatatttttggttcatagcccacacagtcattgttagccactcatctctgctgtttagaggaaaagcagccatagagaattcataaacaaataaatgatacttatatctcctcagtgtgtgtagatcaagaactagtgtctcatattaactcccttaatataataagagtacagtaggcaggtgaaaatatttgttgcttaaaacatagaggaagtaaatcttggaaataaactttacatttaattttttagattagtaaagttttaatttattataacatgtgttaggtaaattagcttattgaaattgtctctcaggtattcagaaaatagcctgatacagtgatatttctacttctactgatttccggtcacttcacacatttagtgtgtgaggtatcatctccagcattgagatagttcagttttctttctttcttttttcttttctttttttttttttttttgagacagagtctcactgtcacccaggctggagtgcaatggcatgatcttggctcactgcaaccttcatctcctgggttccagtgattctcctgcctcagcctcctgagtagctgggattataggcacttgccaccatgcccagctaatttttgtatttttagtagagatggggtttcaccatgttggccaggctggtctcgaactcctgacctcaggtgatccgcccgcctcagcctcccaaagtgctgggattacaggtgtgagctacttcgcccagccagagatagttcaattttcattgtgcatttgaattattagttttaattcctcacctattttatgttcttggagtatttgcttaatagcatagcagtgtgagaaaatacagtttaccttaggtttatcaggctgtaggctttaatgacgactttagatgtctaccccaaaagatcatataatctgcttccctgtagattgtttcaggccataccgggtgttactaaggctgatgttgattcacttaacaatacctgataaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatcacttgaggtcaggagtttgagaccagcctggccaacgatgatgaaaccctgtctctactagaaatacaaaaattagttgggtgtggtggtggcacctgtaatcccagctacttgggaggctgaggcaggagaatcacttgagcctgggaggtggaggttgcagtgagctgagattgtgccactgcattccagcctgggcgacggagcgagactctgtctcaaaaaaaaaaaaaaaggaatgactatttatgagttcagaaatgacggtgactttcttgaggctgttgtatccattggcagtactggcaccagctatatctgacgttccatcttaccagagggcatgtgctttgagtagttactgagtagttctagatgatgttggttacatgatagactgaagtattttattaactctgaattcagtctgagaattggaaacgtgctattatccagtgtagactgatggagttgatttcattttacttttcccctttttgttttcccttctatttaagagctctagtgattgataatgtctttccttatgggaaagattcatttttttacagttttttttcctattcttcttttcctcaatgtggctaaataacactatactgtttcttccctaggtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtaagttcttgtttgggttaggcctgaaggggttgagatcagtaccatgaaactattagataggagatatatatatatacttttgttttttttttttttggagacagagtctcgcgattctgctgcctcagcctaccgagtagctgggattacagggatgcgccaccacgcccagctaattttttttgtatttttagtagagatgggatttttccatgttggtcaggctggtcttgaactcccgacctcatgtgatccgcccacctcggcctcccaacgttttgttgttattaagcaaaatttcaatactgttgttatgtctaaaaaattttaataattccttaacagtttcgtaatatctagtgtttacattttcctggttgtcatatacatgtatgtatatctccgtttgtgcatgtgccattttgcttgttttgggatcgatgtaagctccgtgcattttgcttgttttgggatcgatgtaagctccgtgcattttgcttattttgggatcaacgtaagctccatgcattttgcttgtttggggatcgatataagctccatgcattttgattggttggtatgtctcttaagtatattttaatcaatttatttttctttgccttataaattttttgagtcaggaaactgaatttatgttttgtagacttttctcacagtctggattttgctgattctagctccatggcattctttaatattttcagccaggtgtggtggctcacgcctataatcccagcactttgggaggctgaggcaggaggatcgcttgagcccagtagtttgagaccagcctgggcaacacagtgagactccatctctataaaaataaaaaaatttttaaaaaccacttttcctctgaactgtgttttctgtatactcataagtaagtgtaaaggcttgattagactcagattcagtgtgactttagaggcagaggaatattgtttcacaggataaatgtccttttttgtgatgttagtgactaacgatgagcattgcctagatctgttaattcattagagagtacaaaagggtgatattcaaattttatcactcacttgtttattaggtggaatacttttataaaaagaaactttcccatgtcagctgaggaacagttcatgtaggaaaggcagaataagattcttttttacttttgccattttcaaaggaaaagatctacttttcttcaaaggttttgaccaatgagatttactttgatatgattatgaactcatcaattacacctatttatgtttaattctgttggagttaatatccatattcatgctctaacagtcccatttttagctagtgggaactcattcaagttggttgttgtagtccttttgacataaccgtaatagtagttgatagtttctttgctatctggaatgattaagtgttccacatccatcttgtacatttcctgccccagaactagagtcagccatttatccaagaagttctgcatactcctttactaggaaatgatatttgtttgtttctgtttttcctctgaaaatagtttaatactgtaaaatgtaaaaggggaaatagtgttaccttagtaacaacatgaatgtgtcagttggtcagtgctattttgggtgttgattgatcatatgatttttctggcaactctagatacttccagtttacttaagttgatttagttgagtttttatcacttgcaatttaagagtcctggctaatattctgttgccttcaggctgcacaacatgcaggattggggaaagcactagagagccaaagaaagtgagcagagttacttcagggccaccagcgttccccgcaatccctgtcctcaggcataggcccttctgctcttcccactgtagagcagcacccatccccaccaaacctcacttctgggtgtgacttcatagactgtcgtgttctgcagtaccctcgagtccgaggctgttgagtctgaaggatcctcagaagactggcctctttctgatggtttatggactatggcaaagatgaggaaatggtatttggagaccacatactgggccctaggggtgctctttgcaactgcaacaaacatggacagaattgggaaatttgtttttaatggtaaaaatacatgatgaacagtaccacagagattttatttgatcttactgatcttatgccatactaaaaatctcacttcccaaccacaccaagctaattcattctatacatacaacaaagctaatactaccaccaacaataagaatagtaaaaacaggttaagattttctttttttttttttttttgagacggagtctcactctgttacccaggctggagtgtagtggcacgatctcagcttactgcaacaggattttctttttacaggttttgtttttacttttttttttgctttttaaggttatataccacaagaagtggaaaagagttttaaagtactcaagatagtttttcttctgtgtctttaggcaactaatggttacatagatttatttatttcattttagttttgatttttagggattgctttaattttgtttttaaattatagtatttgtagatttccaaaggcaaagctacaaagcctggtatgttcaaagaaatgtagcttcagtccctcttccctccattctagtccatctttccccataggtaattattattattattttttgagatggagtttcgctcttgttgcccaggctggagtgtgattgtgtgatctcagctcacctcaacctccgcctcccaggttcaagtgattctcctgcctcagcctcccgactagctgggattacaggcatgcaccagtacgcccagctaattttgtagttttagtagagatggagtttcatcatgttggtcaggctggtctcgaactcccaacctcaggtgatctgcccccttcggcctcccaaagtgctgggattaacaggtgtgagccaccgcacctggcccataattattattattttttaacattttaatgcttatccttcctttaacttttaattattaaataaaagcaaatgcattttaactttgaatatcctcctttctcttaggtaagtggtagcataccgtatacacttttctctgccttccttttttccttaatgatacatggctgaagagcaccccatagtagcttatagagataggcctttatgatgcatagtgttccattgaggttatatagtatggtttattcaaccagtttccttgtggtaggcacttagattgttttacctacttttataaatagttctggagtgaagaccttgagatagattcctaaagtgtgatttctaagagaagcatgaagaaattgcgccactcaggaaaaaatgtacttttactattttggagtttgtggttaaggaatatacatgggtatacatgaatatatctgtatttctcctccaaatttgggtagaaaacatactgataagttattttgtcagataaaatactcttttacaatgttaaaatgggtatgtagcctctattttatggtatatttacatttatttaacctcataatgttagcttatttccaatttttatatttcagtgaagagtgtttcagtgacagtcattttccattcacacatgcacacacaggttgagtctcttatcaaaaatgcttggggaccagaagtatttcagattttgggatatttgctttatacttactagttaagcattccaaatctggaaatcagaactgtaaaatgctctaatgagaatttcctttgagcgtcatactggcactcagaaagttttgagtgccattttggaacattttagattttcacatttaggattctcagcctttgtgtacacacacacacttaaatatgtataaagtacatgtgtgtaaatatgtaaaatgtatgtatgtatgtgtgtgtgtgtatatatgtaaagcatatgtgtgtgttgtgtatatgtagagagagttgttttcttctagtattcctgtgttcagtgaggttgaaatatccagcagaatctttaacattcctaattctgactggagatgtgaaagatgtatgattagatggcaggagatacaaaagaaaatattctttgcttcttaaacttttttaggcctctttttttctccacaatactactactatctcttatactcttctggtacctacaactttctgtttttttgtatctagtagtatcattatcattttaatttgcaggtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctggtaggtagttcctcataattactttctcaaaaaaaacgcttagtttctctaggtgcttttcatcagaatgctctatttccttgttggtgacctatcaaggatcatcaaaggaagctttaaaaatgggagagaaaaggtaactaagaatgatttggaaagtaaagtatagtatcaacagatactgggaaaaagaacatttcgggaattgctggtcaagcaggttgctaagggcttcagaaagctttaagatgatttttaaaatatggatttgtagagattagggaagattaaaatttgtgtttcaacataattattggaatgtcttttaaatcttcagtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccaggtaaggtgatttcagtaattgctgtggggggaatcaatctctctctccgcctcccctccccaaccttcctacactgggttgtatgctttgcttgttaaagtaggaagtaagagttttcttgtttcaaagaagttaaggttaagattccagggggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagattccaggagggtcttaatttttacttgcatgcctttaggctaccatatgaaagtggtcatgaggagacgattctttttttgaaggtgggtggggaggattagagaaagtcaaacggggcaagataaaaaaaggatgtcagatggcatcttattgcatgtgtatggtgaaagtagagaggaagtaagtgtgagctcaattccaggagcccaaatcctagaaggagagggcagtatcagacattccccccaaaagttgaccctggctgtgaggctgggaacatagcagaacactgctacttaaaaccttgctactccctgaagtaagtgatgatggcttcccctattttctgtggagttccttaactggagttactgtcttcacacagttatctcctatggggaaaatttcttccgcatagtaacatttttctaggtgtatataatctagtagaaacttattctctgatctatttatagacacatagacatatacgcaatttaccttgtctcttggcatgtttatagtgctttgatttttaagatttattacattttttttaaaactttgaatggatgaactcttctaccaactcacataattatgttgggattgaagaaacttggaccaatgattatctcctaagaaggcccacctttgagactatcagattgattatctttcaaaataccctgaaaggcattgttatatccataatatcttatatggtctttcagttgctgtcttagaatatagcttaaggctgtgcttgttatcaagaaacagcctattgcaaaaagtcacttctctgtcagtgaatcgaatccctatgagctttcattcctaggaaatcccgtgataccaagtaaatcaagaatgcatcgtttttctctctagggaatagataagcttggtcagtgacttttagataattaatgccctctactaatgggaatattaaaaggcggcattaggttttctgatttcaagtaaaggctctgaatctcccattgaatacgtcttcggtttaaggctctgagtagagtagtcagtgagaaagaagtaagggactcctcacctgtcagttgacttgagttaggtctggtgggcaaagttctgggtatgtaggcccttccacagagtctgctgccagccaagtcacctttcaggttagttttgccttctgtaaaatgaagtattttgttcatctcaagtggtgattgtgaggggatgaaatgcaaaaatgattttaaagagtaagaaatgctttataaaatgtacagcatgcaggtgataattctttagtattttatgtgtcaatggtttctctatggtgacattgtattgcatgtagaactgacatatgttctaataaaggaattgtgtatgctaataaatgccaggggctttcttgaattctcatgtagtttagctgcttgaacactttactatgatttcagagtgtaatttttggcaaagctgggatatatgatcaattttaacattttcaatgattcagcaaaatgtttttcaaacaaaattattatataaataaatttttggtttgtgtgacactttaagtgatagttttagccacattagctaagaagcatcatttttctgcaggagcttattattgggtgacccgtggtcctatttcctaatctctgcagtacctacagaaacagaagtaaacccagcctccaagcacaggttgggttttcgtctttctccttttaggtcctggcagccattctgatccttggctaaacctggacagccctttgaatcagaagcttgtaaccttgagtctgtaactggagagctcaggtcgagtagggtagggtgtgcttcttaagcacagcttcttcatagcgctttgccagtgctttgcagttatttttactcagtgggtgttcaggtgataaaggttccaagtctgctgttctattctgagtgtagctgatcttcctatcttacagttttcttgtggtttatttttacagcgtctggatggttccatcaagggagaaatccgaaaacaggcactggaccacttcaatgcagatgggtctgaggtatactatgcatggctttgttatttgagcaacttgggctctgcatcaaggggaaagtctctctcgcttaatgtattctgtttcagaaacaatttatagtgcaattcttttgccttgagaagaaaatgagaaatctctcatataaaagatggtgttttgttgtcactccagaaaaataaatatgtgcttatttatctcccctgttctgggttgacaacagagtggttctcctggtagcttccagataccaaatccttgggcgtggaagagcagtaaggcaggagtaggggagagttgggcaatagaattaatataagaaggttctgatctctgtactcttttggtgactaagtcctgaaaaatatatttgccatgtctcaaatttgttggacttctgatacagtgtggcttaatgttcttgctctcgctaacagcaacattttacaatcagtgtcgagcttggatttggcattatgaagtattttgtttggggggcacatatagaagagctacttaggatgaaatagaaggtatgacaacattgtagtttgtgcatatcaaatcatcagatgccatgggatttgagagaagtgggagagaaaagttttggtgtgaataaaactgtaataatgtgtagagctaaaggaagcagtggagacaacctgaagtagaagtgtttcacagagaatgctaatttctggagcctgagccactacttttttttttttttaaacagatagaacagacttagctttctgaagagctttaaaaactcttgatgcctgtgcctgttactacagaatgctctgctgtctgcctttagagtgtagaaatcctagttagactagtattctggctacttctgtagtctaaacatttacttcttgaggggcttggggcatttattcagagccaaggctctggttcattaaggataagaggaatggaataattaaagacatcggtcatcaactaattcccattcctcctttccttgctccttgtttcctcagctgtaaaatcacaatgattctgataccccacttcataatattgctctgaggattaaatttggtaatcaacataaagcactgatcacattgcccagtgcatagtaagcgctctaaatatctgctatttttatcatgtagtgttggttgaaattggttttgtgttctccactcttagtttaaaaaatagtatgagtcgaatgtttcatattgccctgtctcaggggaaaaaaaaaattgctttttgcatagctctcagttgattcccactcactatgatggctatatagaacacaagttctctaccatttctgcagtattttaaaaattcctttaaaaaactaaatatttattgtgggacaaaatattatatgcttacttagaatattgggaagatggtaaagaatacaaagaaaaaaacaattgtacccctcattctagacacaacttgctgttcacgtctttggggtgtatttccattcctactagatggaaccatttatatgtttacctaattcggatcatgttgcatacagttttgttcccttcaaaattatactttgaggctaggcgcgcatagtggctcacacctgtaatcttagcactttgggaggccaagatgggggaggatcacttgagaccaggagtttgagaccagcctggtcaacatagtgagacctgtctctaccaaaaaaaaaaaaaaagtttccccatgttattaaagattttacaaaatttaatttctaggcccatagcaagaccctatctctacaaaaaattaaaaaatgagccgtgcatagtattgtgtgcttgtagttccagctgttcaggagacaggcaggaggatcccttgagaccaggagtttgaggctgcagtgagccaggattgccccactgcactccagcctgggtgacagaatgagaccctgtctcaaaaaaaaaaaaaaattttttttttaaatttctaaatttttcttatgcttgtaccatttatttatttaactaccttaccgttagtggcattgagttttataattttttaacctttttcaacttgatcatagatgcagacgacatattataatccacgttatccttgctaaagagtgatatagcagattgttggttgataggatctttttgactccagatttcatttgttttagatatctcatcttaaattgtccactgtttatctttagacttctctttggagtgtggtggtgcttaatatttctcttaagaatcacagattatgtgcctggacactcctgttgatcacttctttattggaattgtttaattaaaattcttgtgaagcagctgtctccatttttatttctatggcataatgttgttgaatgtgactattagaacatggagaccttttcattgcatctctatgtgtatgctaaatatacccatttatcaagatggaactcaggactaccagtttttcaatgctgcttctctctgctacaaaggcatcagcttttgacatatatgattaaattccctgaaaatagaaatatttcaccttttccccccggcttatatattttattctttttctcctgcccccatatttttctgagcactcagacgcaggcaggtgtgctgtgcttgcccagtgtctactgtcattgctgtggatactgcagtgtcagtgcctgggtggttccacacatcgctctccagccaaacctgttttgatttttttataattttggcatgttttgtggtaattgaggatcctgtggttctcaacacttaccatatatgatctctttagtgcagtgtttctatatttctcgccagcctaacaaacataaatatttatataataaagtatctctgtttatactaactgacttacatggcataatctaccttttccctaaaaataattatacaggtgacttcctggagttaatgatctccatgataattgtttgtctgtttttattattgttgctgttaacttcttgtatattagttgtagccgggaggtagcactaattctctcactcccattgccttattagagtctactctactcctgttcatggcactgactttgcctcttaatcaaatgaaaattcattctaccatcaagtccctgacattcttttagcctccataaagtttgtccatcatatctcacttttcttcacacctgcaggggtttccaggtgtaagggcttattggactgtgaaactgtttctgagaaggccactgcataaagtagtatattgcattgtgtacaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtcagtatggagaggcttctggaaattgctttagggtggggggccagggggcttgttcagccctttcaggatgttaataaaatgctttttccctgttttgcttttatttcccctgaagcattgatttctgtttgttaactagcacagagatgttgtctttgggcccaagatgaacctattaaggaacttttctttttctctgtttgaaaagtacaacatcagcgaccttctatgtgtttatcttgagagagatatatgatgaatagacttagaactgaacattttctctattttagtatggaaaagttaaatatcctattgttcaagatggtttgtttttattatacatgacagtgttagctttaaaggtactttggaaaaccacacacttttttgtttatgaatcttaaagtctgttctatattggataacccgtaagtttcattcttggccaaagattctgtttttgtggaactttccatcactgaagcacgatttttattgatggaacaggccataacgacagatctttagaggcaattttatttaagactgtaacctgctgcacatagtaaaagtattgcatctacttaagctgcctgcttggatggcttacagtcttctatggttagagaataaattctgttaaaattttcccctcttgggttttgacagagctaatccttctctctttttttgggggggttggggggtggttcaggcataagcataacagttccttttcctacaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaagtaagtgccaggaagattgggaggtaggcagaatcaaattgattctacatcactgttggatataataggattttctaccacagacattagtctgttcattacctggaagatgccaggccagaaccacaaataggatagcattttcactttgagtttcttggttcctttttttgcccatcaccccccttcttatgtgttttcctctctttcttgccctctcccttacctttgcttttggctgctcatgtgacatatgacacagcaacagcagtggagttgtgtgttgggtgtcagcctagcataatgtcacctttgacttttctgcagtgagaatccagattggattggcagctgttttttttttttactattggcaaaaatgtttgtgtggagattgttgtgcttccagaagggtgtaaaaagaaagtaatgaagttttaattggctttgggaagaggcacagctacatctcctataaagtttaattagccaggcatggtggcaggcgcctgtagtctcagctacttgggaggctgaggcaggagaatggcgtgaacccgggaagtggagcttacagtgagccgagattgtgccactgcagtccagcctgggcgaccgataataataataataatatcaaaataataatatcaatattatcaagataataatgatatcaaaataataataaaaataagtttacattttgagcagattgttgagtgtcttctgtggtggtgtttcagctatgttttttgtttgtttgtttgtttgtttttgagatggagtctcgctcggtcgcccaggttggagtgcgctggcacgatcttggctcattgcaacctctgtctcctaggttgaagtgattcttgtgcctcagcctcccgagtagctgggactacaggtgtgcaccaccacacctagctaattttttttttcttttttttttttttttagtagagacagggtttttccatgttggccagactggtctcaaactcctgacctcaagtgataggcccacctcagcccctcaaagtgctgggattataggtgtgagccattgtgcccgctgcagctatgttaaaggtgtattcaaattagcccttcctaaataaaatgttttcagatagttttctgtttaagaggaagctagatgagaaaagcctagctcttttattttggaccggggttgagaaggttgaaaattcttggtgaattataactttctgagtaaaaggccaaaggaaagagctccattctataacattgctagtcacctttctggcttacccatgcaataggtgaaccagtaggactgtaactaattttctattctgctggtttagggttaccatcacagactcatcctgtagatagaaaatgcgatgtttgagaaatcatttttcttgaggcagagtttatattttcagcagttaacttgacctctttctgaaggatagttattctgaagtagaacactttagaggttatttgatgtttctaacaactacattttacttccacagctcaaatccttttaataaagaagagctgacagctattttgaaatttggagcagaggatctcttcaaagaactggaaggggaggaatcagaacctcaggtaattaacaatgaggagagggaaatttttttgagaagtatgatctgtgagagtctaacttttctgtaagaagattctgttagaggcttttgtaaagaaaaagtaattacttgaaggacagtgtgtttttctttcgtaggaatctcatagctcttaccaaattgagtaggaaggaattaataaagcattcgagtatacttttttgggttgtttttttctcccatttctgttcgttttaatttttgaagtttcaccttgtcatttgtataaattatagtttgagacattagatgtaaaagatgtagagttgaaactgaaagtaaatgaaatatcagaaaggagaattggtttatttgcaccaaacatttttagtaaatacgaataatttctgggcaactaggcaactcatctgttgccattttattctattcgtgttggcttttgttcttttaggaaatggatatagatgaaattttgcggttggctgaaacgagagagaatgaagtgtcaacaagtgcaacagatgaacttctatcacagtttaaggtatgaagatctttgtgggagagagttctcagcattgattcattaatgatgactaatgtttatgaacgctttctttgtgctaggcgctctgcttttctctttacctgaattgagtcatatcctcaatattgttctctgaattgtgagtatgttgtgaatgtaggttctacagtccgcacaaaggtaatcactgaagtgggctatcctatgtagagtcagtgtgtggcggaaaagaaatcactgaagagagggctaggtagagagccaggacagagtgtagaaccaggacgtgtggagcactgtgggacacgtcaatagatcagatgccaaagagaggtcaaagataggaaaagagtagatgacaattagaaggttctgatgacttggtgagattttagtttgttttttgtttggtaagtgagagaaagaggtgtcagtggtgtctcatataacagaaaattacatgaaatgaggactaaacacaaaagttgggcaccagacgaataggaggtggcagcacagagtatcaatgttattaaaaagcttagtgaaagagtacagggatgctaaattatatggctagaaggttgaagcaagacaaggtttttgaaagatgttaccatgtttctagtttgaggaaagaacttgagtatagggagatattgaaggttctcaggaaggaaatgatttgatggcacattgccccagaggagactggaagggatacagtcaaaagcacagatggaagacttggccttggaaagaaaaaggacaagtacactttagggaagaggaggaaagagatgctgtgggagtttaatttatgctcttaatgactagtaaagtaagtgaggtgtttgcttgagaagtggaaaagatttgggacagccatggatgaggcagaaagttgttgggaggaacctgatagggagtcagctgaattgagatgatacagctttgccgtggagccagtcagcagggtcatatgactttctccagcaatacttttgaggtcagagaaattggatcagttggctatcccaaggtgggagattggcttgggaggcacaggaaagtcaaaatagcaaaggttttcaagattcatgtgacagcttggaaggaaggattgaccatgggttgattccatggaggtagagaagcaagagagacctgatgattacaatgatggctaagtgtagtatgcccattaggattgaattgaattaggggaaattgtgtgaagtgtttggaaggaagcaatattgtgtgattagctccaaagctggccactggtagaagttgtttcaatggaagaacaaggatggaattgagtgggccagagagccctagattaatgggttaggatgcagaggatggggtagagaagggggaaggtgatttattagtgttcgtcatagtcggtttgggctcctgcagtaaaataccgtagactgggtggtttataaacaatagaaatgtatttctcacagttctgaagatttgaagtttgagatcagggtgccaacatggtcaggttctggtggaggctctcaggttgcagactgctgacttttcttatcttcccatggtagagagagagaagctagagagctctctgggggtcccttttataagggcagtaatcctattatgagggctctaccctcatgacctcctaacaccttacattgggagttaggatttcatcctatgacttttgggaagaacataaacattcagtccattgcactgtttcagctcagttccacctctgtgactgctgctcctttcttcagcaataaaaacctgcacttgtgtaactcttactgtgtttcaagcactatcttaagttaagggccagagtctggcctttaaccacgatgtcccttttggaaaagttaaattccttactgcatgaaccactaacgtatgtgcatatttacatcaatcttaattttagttaattttagccaaaagtcataaagtaagagtcttaacttgacttcactgttggctccaaggaatggagcctccagaagctcatttataccttatgactgtctcaaaggctaggagggagggaataagaagaatgcggagccaggctgggggctgcctgccactgctcagatgctgtccagaggtggtagatgtttctgtgtactcctcctctggttctttgaaatggatacacttagatggctttctttctgggatacctactgttttagtacaaatacatatcggatattaaataatatttgataagaaatgaagagagtattcttctagatttatttaaattttttctgttttatgttttcattttatttcctaagactaaagtgcacttgtgagcatatgaaatcaccacacatctttaactttcatatttttgataaaaatgaataaagcaaccagttggctagatgataatgagtgctttgagttatgcattgtttcaaatgaactctatacaacttatagaaatgtaagttcatcatggagtattaggtattaagcattttaaaatctaaataaatctaaattttatcattagtattatatttattagaacatgtatatgatttataacagctcattcaataaaacttataaaaacaatttgtatctttgtagctgtttctctgcttttcagtaaaatttatgatgtgatgaacttgaggacttgacaagttgatttttgggggtataaaggaaaaattaatagaaaattgattatctgattatgtaatatcacaaaagtcctattattcacagtgtctacttagataaaaacactggataaattgttttagtagatggtgtttagaaatagggaaatgtcagacaatgggttgtctgttttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggtgatcaagtgagatgaaagatatgaaattatttcttatgttgtgaatgctacagaagtgttgattattcaaagaagaggccttgcattgttcccctgacacagaggcttcaagagcagagttgatactgtaggaaacttaacaaaggaaagtggagaaatctgcagagctcctgagcacacctgtgagacatcggatttggtctttgcaaattggctctttgtgaagctgataaacagggtctgaaatttccagaagtttgcattttgcctttgagtagtcctcacagtttggctgttaattgccactgccttcaactttcagaaagtcacacctctgtttgtccataacagttcacagcacttgatataaatacttagtaaaggattatataactataaataagaaacatataccaacttgacagttcacaaagctccatcacagacactatctaatttgatttttgtaacaacattgaaataggtagaacaagtttttttacccattttgttggaggtaatagacacagatttgttcaaggtcacagtaaatcagtatgaggtaacactagctaccatttattgagcccttacaatgtgctaggcatacttctaagtgctttaacttactgaaaaccatctgttataggtactattgtcttcatttttcaaatgagaaaataaaggcacaaagagtaaaattacttgcccaaaggagtaaacatgaacctgttttataacgggatattgtaaaaatattcatatatttttaatccagttcacttatcgttatattacaatgtctctgaaagtatgactgtcctaagtgggtatttctccaagacctgtctccccttatttgtcaaaggaaaattgacttgtctgatatggtgagaagttctgaatactaaagaattaagatggccttctcttagtcctttcaccacttgaacttcgcacttgttacagtgtgactttgcctcgatctttctcaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttggtggaggctctgttctcactgagcttgtttgaaagtgcgtactgtaagtcttgggttgactggatcctggacatcgtgacagggtaggcagaggctaatacctacaaaaaaggaaagagaagctgggtcctgtcccagatctgtaggatgatccttccttctccaaggtttctttctgttgagatcacttttatttgttgttcatctctctatttctctcttattctctggttattcagaacattttcacaaagttcagctcggggaaggagataattgacatacatgtatatacagacttatgtatctgtatataaaagaaatatcaaaaataaaaatggtacaaataagtctaccctcactacctctcccctccgccacaatcccacttccacctgtgttagtactgacatcagtttgctagtggtttgctttgatttataagtagtatgtacagcatgttgttcagcaccttgctttccccgatcccatttaaaatccattttagacatctttctatgtgagtgattactatacatttcttggtatctgattcaaatgtctctatcctccataaaaaaatctaaaattgttgcttacaaattattttttttccagtttccatcttttttttttaagcctgaagaaaatagaaagtataaagatggttttaaggcctaatccatattataattatattaaatagtcctttaagtttcatgtatttgaaactgtgaggtgtttcttttcacttaaaggtcacacctattcttctttctttgtttaatttactatggaaaaatagaaatatttcaaaatactgacagaatagcatgtaacacatcccctcttgtgcttatcatcttaacaattttgaatttgtagccaaaattgtatgtatatatacacaccccacctcttcttgctccctattcccagtattattttgagaagaatgtgttttctgctatggggcagtatgttctatagctgtatttggcttagtgtttttcaggtctttaatttcttcattgattttctgtatagttgtggttattttggtagagtcagaatcttgctctcttgcacaggctggagtatgatcctatctcactgtaacctcacactcctgggctcaagtgatcctcctgcctgagtgcctttttcactcagcctcccaggtagccaggtctacaggcatgtgccaccatgtctggctaattaaaaatttttttttttggtagagacaaggtttcattatgttgcccaggctggtctcagactcctggcctcaagtatcctcctgcttcagcctcccaaagtgttgggattataggcctgagccaccgtgcccagcctagttgttctacccattattgaaaatgggatgttgacatctctgttactcttatatgatccatttgttcttcaattgttagtttttgcttcatgtgtttttggactcttattaattgtatatattttttataatcgataggtcttgattagcctttttattgtaacatgtatttctgtctgtagtaacaatttttgttttaattcctattttcagtttgatattagtatagccactccagctttctttttgggtatttgaaattttaaaaaatggtatttggccaggcatggtggttcacgcctgtaatcccagcactttgggaggccaaggcaggcagatcgctggagcctaggagtttgagaccagcatggtctcaacatggcgaaaccctctctctactaaaaatacaaaaaattagccaggtgtggtggtacacacctgcagtcccaggtacttgggaggctgaggctgaggcacgagaattgcttgaacccaggaggccaaggtttgcagtgagccgagatggcaccactaaactccagcctgggtgacagagcaaaactctctaaaagaagaaggaaaaaaaaaaaagatggtatcttaaaattttttaaaaatattttttctgccaatctcttttttttgattgcagtatttaatctatttacatttaatgcagttattataaagtaggaattatgtctgcattttgctatttgtcttctatatgtcatgttttttttgtttatttccccattactactttcctttgtgttaaatatataatataccattttaattaccttaaaaaaaaaactatttttttcacttattttcttagtggttgccctagaaattacaagtaacatcttagaacaatttactttgaattaacatcaatttaatttcaatggcattataaaaactttgccccagttatagctcaccatccccatttgtgctgttgtcgcacattacatctttacacattttaaacccatcaatgcagttttataattcatactttatatagttagttgtctcttttttttttttcttttgagacggagttttgctcttctcaccaaggctggggtacagtggtgcaatctcggcccactgcaacctccacttcccaggttcaagtgactgtcctgccttagcctcccaagtagctgagattactggctcctgccaccacgctggctaattatttttgtatttttagtagagatgggatttcaccatgttggccaggctggtcttgaacttctgacctcaggtgatcggtgtgcctcggcctcccaaagggctgggattagaagcgtgagccacccacacccagcctagttagttgtcttttaaaatcagatagaaggaaaagagttacaaaaatgcatgtatactgtttttatatttacttactctattattccatgggtgcttttatttcttcatgtgatttgagttactattttatgtcctttcatgtctgcccaaaggactctcttttagcattttattttgaggcaggtctgctaacaatggattctctattttggcttagctcgcactgttaatttcatcttcatttttgaaggaaagtcttaatttctttttttctgtttctcacgtgggataatctcaattggcctatcttcagatttggcagttctctcttcttcaggctaatatctgctgctgagcctcaccagtgattttttttttcatttccgttattgtagttttcaactctagaatttctatttcactctttaaaaaatgtccgtttttaaacagcatttctgtttctattgatatcattttcgacctttctttttaattctctaggcagactttttttaactcttgtaaatatttataatagctgattagcatccttgtcttataagcctacatgctagacttccttagggatggtttctattacctgctttttttcctatgtatacttcatacttcatactttttttttttttttttttttttgagatggagttttgctcctatcacccaggctggagtgcaatggcgcgattttggctcactgcaacctccgcctcctgggttcaagtgattctcctgcctcagcctcccgagtagctgggattacaggtgcccaccacaatgcccagctaatttttatatttttagtagagacagggtttcaccatgttggccaggctggtctcgaacgcctgacctcaggtgatccacccgcctcggcctcccaaagtgctcggattacaggcgtgagccaccatgcccagcttactttttggttttctatatgtcccgtaatttttcccgtgaaaaactggacattttaaatcatatggcaactctggaaatcagatctcccctcccagccatgtgttgtgtttgccgctgctgttgtatttgcttgtttagtgactttcctgtactagttatctgaagtctgtattctttgtcatgttatgtgatccttgtcatgctatgtgtagtctctactcctttagcttagtggtcagctaatgattgaacagagatttccttaaatgctttgagcctgtaagtctaccagcctttgttgaagggctgggtatgtgttgttggggcacgtttcaatgctctggaaggcaattgacaactctgccttaactttcagttcctgcttgcacagttgctcaaggtctttctcaggctcagacaaatgacagtgactctgacagtgagtccaagaggcaggcccagagatcctctgcttctgagagtgagacagaagagtctgatgatgacaagaagccaaagcgcagagggtgtcccaggagcgtgcggaaggaccctttgagatctttcctctgcatggacacagacctgcacatgtcagagcttttcagagtatctatcctatgaacatctttcctcccagtttttctttttgtctttgttcaaccttttgttatttccagttggtaatgttgcctcaggccgtcatggtgttaaatctttgcatctaattgtttttgaccaatgaattttggacagggctattcacacagtgagttctgggtcagtccaataaagacaagcctgagaatggagcttcttagggtgctgttagccaggtccagtcattctgggggaatagggcttttggagaactctcaacctcttctttaccctccagtggctgctgtgctgctggttacacagctattgtagttgcagaagtgttagttttgaaggctgtcatgcagctggggttaaggggtgggaatagtgcaagttaaaaaatgccttgaagcttgctgagccattttcttgaataaatttcttagatggctgcacgcatttggttaatttccagagttgtgacaatactgattgtgaccgtttatgccagcattcctattgcttttatgggggagcagattttcacagacccttagtctgtcatttcggaagtgttgttatttagacataaaatatttcagtgtctgtcaagaaggagaaatgcagttaaggagtaatcctcaggttttgttcatatataatactttcctaacctttgtatctgcgctgttcctttaatgttgtttttagctattgtcatattcagtcccattttattctgtagccatgtcttctcatttccatttttcccttagcatctgtccttacatggttatataacccaattatcatagtaatttggcatattacatgatgcccttaatgtgtcatgaagtcctggtttttagtggaaagtactggtgaccagcctgtaggaatggggatgatggcatgagttggtatgtagcatagtttagggtagagacttgcaggaagatagattggatttttgggaggagaggtcagtagagtttccaaaattgtttgcctaagaagttttaaatcatattttactgtgccttattccaaaaactatttgagacagtcaaaaaaatcttaacagctgaaaaatcattggttttctaataacgaaaaatatggtattgaaggtaacagtggtgaactgaatacgctgatgaaacgatataagggtttgtcacaatagagtcgtgatgattgaatcctttatgacacagtgaagtctataaacttgtatcttctaaaaaggatattagagctaagtcacagttctctagcatgttatctaagcaggtttatgtacagtcactgagaataaagttgatctttaatttgaatagatttttagcagtcattattttaagttgactagtttcaaagacattcaacatttattcatttttttggtagtgcaaggattgagtccactctatttttgacaatttgcatggctcatatgtcatcacaggatatgctagcatcaacataactaaagtaagtctctgtttttttaatatgttttattgatcctattcttaggttcatcaaggcttataagaagtttggtctccctcttgaacggtaagttcagtgtaatagtcccttatcttcctcttttttgcttttattatatagtacgttcttttttggtaaatttttccatttaatactaatgctgggaacatttttttttctggaaacatttatttacaaacatttatatattgggtgcctgttcattcatgtctctctgcagagggatgacaaagatgataaagacaggccatccataaaaagactttcaccttcgtgagggagataaagcaagtatattcaaaaccatagtgcgtgaaataatttccagagagatgttcatgtaactccagttgaaaagaatgtatgtagttattatttgtatcctagttcttagatttaataatgtcaaaggtaaaaggctctttatgattttataatcttctgctaattagcaggattttatgaggattaaatacaaaggacttaacatagccttgactataaaaacttccaaaagggtagctgttgttactattctataagcatttagaaaataattcagaagttagattttaacagaagactctatttgaaatggttcggtactttacttcctataaaatctaaaaagccctaatttaaaggaaatactgggctcccttctctttcttctgataaacttcttgagtgggtgaaaattacaagcctgtttttgtttggtcctctccatttggcgaggaggtagtgatgtgtagcattaagccacagcaaggccaagaaggtcagttgcatctttccaggactattgctgaccacccaggggtagactgtctgtttttgggccagttaccgtaaaagccaatagaatgtggaaaagggggcttgacaccttttgacagcctgttttttagctgttaatgtagttgtgtgcttcatatgacatggagatcaactaaacatatagtagaagtagctatactctgcttctaggagcattgcagtgaatgaaagtaggctggagaaaggaaagtgaacacaaaagaagcaagctagtacggatggtgttcaggcacttcacctgctgccactaacagcctatttatttaataaactttgctttgcttgtttctttctttcctctctgttttttggaattattttgttttgtggaatattcaagacacaattctttatgatggaaaatgaatgtgttagccttcagtcaatgtccaggggttcttgttggagccttagaatgaccactaaaggaacgcaaagaaaagtgtctttgcaggagaagattatgtgaggcctagtggcatctcatgacacttaagaagagtgggcacagggtcctaaagtgtccccatatttgttcctcctcaggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggtaagcgaagttggctttagtgagtcttcgcaacctggcactcttggactggatttctgttgctaaagggcgttttaaggacaggcttgaggaccacacatgcctagtgatttcaggtgtttattctgagctgcgtttctgtgagcttaatattctactctcctacaggtctactcacaaatgaagttgatttgcagaaggtgtagagtgaagaaaaagatgaaatggtttttttttgtgttgctgtagaaagtttaaattcgtcggagtgatgtaaaaacccaggggcagagcttggtggacacctctgtattttggctgcaaataagaggtgttatagatcacaagcattgttaattatcttggatatatattgtgcgttatggcaaacacaaaggatttagagaattaattggaataaataaaatattggatgaatatcgtaaacatttttgggttacgttgagattttcatgccactagaatttgttctcattggattggacatgcagtgtgttttctctttgataccagaaagtgattttgcctgtcctgtgtgatatctttaaaagcaagaggtataggaatgcttgtgaggagagaactctgaagtagttattggtaaggacaccctcatagtgaactttaaagaaacgaagagaggccaggcgcagtggctcacgcctgtaatcccagcagtttgggaggctgaggccagaggatcacttgagcccaggagttcaagtccagtctgggcaatatgtaagtgagaccttgtctctacaaacagtttaaaaattagccgaaagtagtaggatgcacacctgtaatcccagctacatgggaggctgaggtgggaggttcgattgagaccaggaggcagaggctgcagtgagttgagatcatgccgctgcagtgagttgagatcatgccactgcacttcagcctgggtgacagagcgaaaccctgtctcaaaatataaataaattaattaaaaaataaagaaatgaagttattatcattctacttctccagactgtggtttatctgtgccatttctgcattttttggggacagcctttacttaggtaaggctacccttctgcagctttgttgagctgtggttaaatcttcaggctccagagaaagaggcagtcagttatctggaattttggttctaccacttctagttataagactttgggcaagttatatcccttcaactgtctcatttgcaaaatagagtaatagtatctacttcaaaggatttggataattgaataattccatacttgtaaattgtttagcaatggcgtctggcttgcaatgttagctgttattaagaagtgagtatttgtgctttgaaattttctttttttctttttaagattttaataataaaaaattattttattattcaataataaccttaatattattgaatttgatataatttaaaaatatcttcaagagagtcaaaacttattttaagataatgttcttttttgtaaaagacaaataacttgtatggtttgcaaaatgatctgaatatgtgcttttataacattcagaatacacccaaaagtaaactttaggtttaatgtacagtatgttttctatgtaattgttttgaataagtaatacatctacatggcttaaaactgaaaaacgtattcctgttacttcttgatgcttttgagaaatgaataatgttttctcccttttaaatggtagtacagcatgcacacttttctgtgcttgcttttttatctcatagtatcttgtggagctgttttcttaacagtcccttctccccaaagtctcccttttttttgtgcatgtccacattctggatctggctgattgcttcttcctggtattaacttatttcctcacacctgtatttcctgtaaactggtattcagcatattctgaatccaggctgacatttctagatcaaatggaagattattgataccttttttcccttaggttgaaatttttgtttctaaaaatgttaacataattacatatttgctttatcccaaacatatgtttccaaataccaataccaatcttactgttaacaaaagaatgctgaaatgcgaagtgtgatttctttgcatttctttttgatcttagaatatatcacactaacaatataaagtcaaaatatatgtttaaattattcaaagttattcctttctctgtgtggttaatgccaccaccttaatatatagttagactcttttgttttcatttattttcagtacttagggactgcttttctcatttagattcgatttaatttttttaattatgtaaaaacatttacatggttcaaagtcacaactataaaacaaggtacatttggagcatcttgttttcgttttttgttccccagctgccttctcttcctccttaataggtcactgtttctattagttgtaagtttatctttgattgtttcttttaaaatttaagtgtgtgtgcgtattttccttcttacacagaagagaacatactcttttgcacctgcttattttcatgactgagataaattcatatcattatgtagagatcatcctctttccttttacagttgcagagtattctaccatgtagatagatgtcaattcacacttcccccctagtatttaatatttgggttgttttcggtcttttgttattataaagaaagtcacaatgaataatgatctaatgaatataccatttcatatctctgccagcatatctttgggataaatttctagaagtgggattgctgggtcctgggaaaatgcgtatatactttgcttcgatattcccaaatccttctgcataagtctggtgccacaatgtttgtcacaagcctcacaaacagaatatattgttaaacgtttggagttttgccagtttgataggtgagaaacggtatttcatttttcttttaacgaacaaggttgtacatctctaagggtcacttgcattttgttctataaagtgtctattcatgtgtgctgcccattttctattgaaaggagttttcctctcacaggtagcattatctcatggatttcaagttggactatttggttggggcttcatttttacttctgtgatcattttaatttgaaatttgggttagggtaagtttctttttttttttttttttgagatggagtctcgctccatctccaaggctggagcacagtggtgtgatctcggctcactgcaagctctgcctcctgggttcacaccattctcctgcctcagcctcacgagtggctgggactacaggcgcccaccaccacacctggctaatttttttgtatttttagtagagaaggggtttcactgtgttagccagtatggtctcgatctcctgacctcgtgatctgcctgcctcagcctcccaaagtgctaggattacaggtgtgagccaccgcgcccgcctgggttagtgtaattttcttaagccaccacttgttcatcatttcacatgtgttagatgtgaacttaagctcatgtgttttcagtaatagtgttgtgaagatcaagttcatttttaaaacacttgagagttttttgaccttcgctagtgggatgggtaggaaaacaaaaagagaaaccttcagcactaatattataccctcagaatctacttttgttcatttggaaacaaagtagtataaaacaagcaggaagattaaaatacaactataaacatcagtgaattaaaaaagaattccaaatcttaaaagactgaatgttcagaggttattttacagacattagttgagaaaaaaatttgtcttatagattatatcttcaaaataacaataagccagagatatattcagagagactaagaggtcagggttcgttgatacatgttttctgtggaacttctgcagattttcatttaactaatgtgaaactggtatttttcaggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaagtgagtatattttgtgtacatgcttagatggtcgtaccgtaagaaaatagatttgaagttagactttgtgtagttccatagtatttttactgtctcttctttaacataccaaaaaggcccctcttctaatgtcttcctgtttttaaactttctttagatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaagtaagtaaccctaccatgctagagatttctagaagatttgttgtgtaatatttttatatcgattacttatttctaactattttcgagggggcatcaaattagaaattagtatagtcattcttggaaatacttccatctttagcagattgtggcactgtttcacggatgaagataaagggaaaagacagtagccaggtgaaattttggggaaactgtaggagaaatcttaaaattctggtatttaattataggtcagatttcattacaataaatacccaggtgagtttgttaatgataaaagcattccttggccttagttattggccctttgtttaaaagtacatttgaaacaaccatatttcatttcctcacgtaaagattgaatgtcaccttggtattctttgtaatggaattaaacattggctgttcttctcccacaaaatcgagcctcccaccctatctgttgcaagtagcaaggccatggttggagctataagcagggaaggctgactggctcaaattttggtaggatttgctccatgttgtgctcctggcacgttcaacagtgctcatcccatctggttttaggagggtgacagcaccctgccttaagcactgagaccagattcagtctggcaagagacccagttgttgtagcaaggaacagatcatgtcctggcgtagctcagtgctctccggcaatgctctaagaagcattttcaatctaaaacgaagctttaacctagctccagggattccctgctcctggaaggaggaaatccacgacggctgggatgctctagcagatgaagccacaagcccctcctacctgagttgttctaccctgttaacagcacaggtaggagccattgggagagctggatttctccatcccattttgtaaaatgagaacggctcgtgagggattttcagtgactgggagccatggacatgagataggatctgaggctttatctatattttgggtggttggggagggaaaggactgtgctcagtttttgttgtctctgtttatcctgatccactaaccaggatgtgggtggtggcgggtgcttctcttcctttcttgttgaagattctgccggtggagacagataaaaagcctcaggggaagcagctacagacccgagcggattacttgttgaagctgctcagaaagggtctggagaagaagggggctgtgacaggtggggaagaggtgagtacgctgccagctggttgtttttcaggggcctgaggctcctaccctgcagaattaggtaggaagagagaggccctctctgagcactgcacagaatgtcaccttctcatgggcatattttgtttttgaggttccagtaatgatggtttgcttggtaataatagaaatgttcatttaggcctggcgcagtggctcatgcctgtaatcccagcactttgggaggccgaggcgggcggatcacaaggtcaggagattgagaccatcctggctaatatggtgaaaccccgtctctactaaaaatacaaaaaaattagccgggcgtggtggcacacgcctgtaatcccagctacttaggaggctgaggcaggagaatggtgtgaacccgggaggcggagcttgcagtgagccgagttcgggccactgcactccggcctgggcaacagagcgagactccgtctcaaaaaaaaaaaaaaaaaaaaaaaaaaaaaaaaaattcatttaagaccacggcatcttggcagctttcttacaaacccatccttctgaaatgttgcttcaaattcatcctctgctccccagtcccactattccacacatactgttactgtttctttatcctactttctcaattttggaacatagttgcagttactgcattgaatacctgtgggtttgcctgttgttctgtctgtctctgtggttcttgtaatagtggatcccagagataaaatggacagttgtaatgcacagttaattcagaaactagaccttacttgctgtgtgaaataccaactaaattctcagtgaactcagctgagctttatctccttttgtttccccaatttataatttcagttcaggcccagaaagatggaatcccagctaagaaatacaagttacaccctgtactagcagcccatgtgtgcatgttctttaagtgctcttgcagctatgtcatttatattgatttccctgtattattataagcaaagcaaatttgaggaaaaaaacccataataccacacctcatttttttcaagtaatagggtcataagtctcattcttcatataatatgttgagtatgcaatatattatgtgttaggctctggaaaggcagaggttagatcatgttacagatcatatctgattaggcagataaacagtattttaaccttttccttattatatgtaacttgctttcaggttttttaatgttactattatgtctttaatatattatctttatttgtacttttgtatacagagtgattttccttttttaaaaaaaattgtgtctttaggatggattccaaagatgtggaatcagtaggtttaaggaatatggatattttggctggcaaggtggctcacacctgtaatcccagcactttgggaggctgaggtgggtggatcacctgaagtcaggagttcgagaccagcctgaccaacatggcgaaaccctgtttctactaaagacacacaaaaaattagccagtggtggtggcatgtgcttgtagtcccacttagctactcgagaggctgaggcaggagaatcgcttgaacccgggaggcagaggttgcagtgaggcaagatggcacctctacactccagcctgggtgacagtgcaagactccatctcggaaaaaaaaacgaaaaaggaatatggacattttaatgtggtataggccatgtataaggcctataggtttttatttgttttggtttggtcttgtgaggtaaaatgagttgcactcttttgatttctttggaattttcttgtttgaattatatggctgctactgctttaaagagtcatcatgttgtttggttatgcttttgagtgtcttgatttgtattttaatcatcattttctctccttttccaggccaaattaaagaagcggaagcctcgggtaaagaaggaaaacaaagtgcccaggctgaaagaggagcatggaattgagctttcatctcctaggcattcagataatccatcagaagagggagaagtgaaagtatgaagtggggtttcggttgagggttatttatttattttagctatacttatcatgccagctggaataaaatcatctgaaatgtgtttggtttacgagtggattaaatggaaatagaatatgtaagtcttcgcttaatctgtcagcgaggatagtttaagtcagcaactgcaaatttgtacataatggaagtaaatgaaggggactatgacatttttgttgttgttgtttgtttgtttgtttttgagatgaagtctcgctcttgtccgcgaggctggagtgcaatggcacaatcctggctcgctgcaatctctgcctcccaggttcaagcaattctcctgcttcaacctcccaagtagctgggattacaggcacctgccaccacgccaggctcatttttgtattgtaagtagagatggggtttcaccatgttggccaggctggtctcaaaactcctgacctcaggtgatcttcctgcctcggcctcccaaagtgctgggattacaggcgtgagtcaccgcgcccgtcctaaagttttaatgataaatggcgattgacacgtagcctcattcttgcaaatgacggggagtggtcaggactgtggttaaccagagagctcatgcctaatgtaaagggggcagctgctatggagttctgttaacaaaactcctgtgggtcaggtttggcttgccagtttgtaacctctggtctaagtaaagtgaatagtaagttggtatcatttagtgtgctatttcagtgacaactttatggaatttctgagagtgtaattgtacttggatattagctccaagaggatcagcagtgtgtacaggaactagcatggatttgagtcatacatacagatatttatttatttattatgagttgctttttgagatggagtcttgctttgtcacccagggtagagtgcagtggcgcgatctgggctcacagcagcttccacctcctgggttcaagtgattctcctgccgcagcctcccaaatagctaggattacaggcacctgccaccacacctggctagtttttgtatttttagaagagacagggtttcaccatgttggccaggctggtgtcaaactcctgacctcaggtgacaggtctgcctcagcctcccaaagtgctggaattatgagcatgagccactgtgcctggccaatacatacgtacatttaaatactagcaacctaatcagttattagctgactttgtataggtatataatctctttggtactcagtttccatccgtgaaatgagaataataaacttacgttgaagggttgctatgagaattaaatgagaggatatcagtaaagagcttctgcctctacagttgtaactggttattactggaaagtttagacttctctgagtcccttgaggctatttgcttgaaaacaagcttctaagtatagacagtgatgaaccactgggggcagtgcttctttttccagaaagtacataagtagatataaaatttgtagcaaaaattcatagccctgttttgtttcctaggatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaaggtaatgatgcccttctgttcatgcagatatccacagcctttgcaattcgccatttggatttagaagtagaatgagatttgagggccctggaataattgtctttttatgggtatgttcaagaaggatgggtggggccgttgatgggatacctgcacctgtccttgcagagagaggggaacctgcaagtttggggtgttctttaaaaaagaaggcctttacttggtcttttatgacatatttcagggggaaatgtttgaatgagataggacaggtgagagaaatctgcatttacatgtaaatacgaaatacgttctcagattcatattagaggagcacaatccacaactgaatttgaatacttgaagagtttgagtcaaaaacaaatattagcaagagttattggaatataaatggatgaaaagccttgctattataacctttacattaggggttttatgaagttcattctaaaccaaagaatttggtacagtgttgcagtgtatacttgctgacctctgaacacagtaaaatcattgccaaaacacaaacaactgctgtaattctaatatccagttgataactctaatagatttcttgataagtgcctttgaaacttttactttgaaattttatattaaatataaaataaacttctatttaagaacaaatataaaaatcagattaggctgtttgggtagtttttcctcctcacttagcagtatatcacaactttccaagtgattaaatgttaaagtcatttttacagccttggcaacgtagggagacctcgtctctacaaaataaaaacaagcaaaaatctagctgggcattgcggcatgtgcctacgggcccagttgcatgggaggcagaggtgagaggattgcttaggcccaggagctcgaggctgcagtgagccatggttgtgtcacacttcactccagcttgggcaacagaggaagaccttgtctcaaaaaaaaaaaaaaaaaaatcatttttaatagttggggaggattctgtttgggtgtaacatgttagaagcaatttgaatttcccattttgaaatactttctaatttttgatgttaatagaccatactgtgataaataacctgtgcatttgtgctcccacagaaagacattatttttcttaaagtaaaatattaaaaaaataaaaaaagagcaattttagcaaacatctgtttatccactctccagataccacaactgttgttaatattttttcatgtttactttaagtggctttttttttttttttggcggggccaggcggggggagacgctgatatcttttgtatttcatgaacatatgactgatactgttgaagctgccccctgttccctttccctgattttattactcttcctctgttttccccataaccactactgtgaagtgggtccgaaaccttcctgttcatgtttttatatttgtagtacatattatagtgtatatccatataactataaacaaagcatactgtatgcttaaaaatgtacatgaagtcaagctaggcgcagtggctcacacttgtaatcccagcactttgggaggccgaggtggacagatcacaaggtcaggagtttgagacctgcctggacaacatggtgaaaccccgtctgtactaaaaatacaaaaaatagctgggtgtggtggcgtgcgcctgtaatctgagctacttgggaggctgaggcagaagaatctcttgaacccaggaggcagaggttgcagtgagccgagatcatgacgctgcactccggccaggatgacagagcgagaatctgtctcaaaaaaaaaaaaaaaaaaagtacctgaagtcattttatatattcttctgcaacctttccttcaatgtaattgagatttgtatagagttcatttacaataatgtagttaatacagattcctaaaccaaagggtatgctgttaataaaggttgctacatgatactctagagagttctgccaatttacaagcttaacctcttgatgacatttctgtgcattttacggataaaggagtaagaagcccaaaaatagcactgatgaaattgaagttataattgggtacatttagagatggaaatgggaataatgtgtgagtaagctgctaatcagacaggtttgtcttcatgatgtttcaggattttattttactttttaaaaaataaactgagaccatcatatttacccattttaataacacaacataggtaagaaacctaaatcgcacggtaggattgcacaaatgacaatgactccttgtaactcttttttaaaagcctaaaagtggtgatgccaaatcttcgagtaaatcaaagcgatctcagggtcctgtccatattacagcaggaagtgaacctgtccccattggagaggatgaggatgatgatctggaccaggagacattcagcatagtaagtcttgaaatcggggggtgccagtgtctgcagccgcggtacttgctgtggctctgccttttataggtccagccagagcttcagttgagctaagcaatagtacattacttgggaaacacattgcttacagtatcggaagaccatgtgctcttcagcaggctggcaggaagagattttcttgtcttttattgaggggaagtttaaggagtggatttcatgtcttgtgctcctagttaagagaggctctcagggcccttagaggcatttgggaaagagaagtgttcactgagcaagtatttattgaatgttttctgtgttccagcccccagagttaccatgttgaatagataaccatttctatcatcgtaaactgtacattggagtaggggagttagataactacacaaatcatgttggtgcccctgtgacagggctctggaggagagagagtgcatactgtggagatcctgtgagaagggaatttgacctagtcaggggttgccaggagggcttgtgtaaggaagtgatgtttgagttgggttctgaaggaagaataaaaggtaacaggagaagaggggagggcaaggcgatggggagcgagtgcatggaccaggtcttgcacgggattggatacaggccagtgtgtcctcaaggtccctttgcccctggctggagctgcaggtatagatttcactgtgccaccatcccttccccacctctctgtggtctcttctccccatacttccacaaatccattaatcaaacggctcattcaggctgaaagaaaaagcggttttctttcaaatttgaaaatacttccatcctgtggcagcaaaggaccctgttgaccctgtcctgtaacctctctctgacttctttctctgagttctctaaaacctatacacgtatgtatatagatattgttttctttgcacttaactctgttttcttaagtctcttttttgcctgtgagctctctgaggacaagtattgttttatataaaggtcatttagatgctagaagtatatcaataaatgagtaaattgaataaatgaataaactaattacatagccagctaaccaatctgtttcctagtctttcttttccgagtgtttataagagaaaatgatatctaatgttctatggtaccatgatatttaaaaaatgctcttacaaatgactcatttaatcttgtttttatattatgaaatctttaaaagatgcagagaaatttcagggatataatagtcattgataaatataccatgaagttttgtcaaatctgaatttttttaagactcaaaatataaagctgaatcccttggtgttcctccctctcaacctatgctttttctgtctctctctctcttttttttttttttttttttgaggcagagtcttgctctgttgcccaggctggattgcagtggctcaatctcggctcagtgcagcctctgcctctccggttcaagcagttctcctgcctcagcctcctgagtagctgggattacagatgcgcaccaccacacccggctaacttttgtatttttagtagatatgaggtttcaccatgttggtcaggctggtctagaactcctgacctcatgatctgcccacctcagcctcctaaaatgctgggattacaggcgtgagccaccgcacccggccttttctctctctcttacctcccagacgtaaccatgattctgaattcgatgtttatacttaacgtgtggttctagagttttactgcttaagtctgtaaagatgataatagctcacattaatagccagttactgtttatgtgctttatatatattttttccacaacactcctgtgaggtacgttagtgtttccattttacatatttaaaaataaggtgaagagagttaagtgatttgccctgtgtcacacagctaagacatagaacacagttttgacccaggcagttcggcatgagaggttgggtccataaccattgtcctacgtagcctcccacatataaacaacatagaggattgatttccatgtcttaaaactgtaattggcacttgtgtatcctgtaacttgcttttcctctcacagcagtcacatttgttgagatttatctatattaataattgtggctgtcatttaagtttcatgttattctacaatttattcttccacagtttaattttttcccgtattggtggacatcaggatttttccaaatgtttgctactacaaataggctacagtgaaattgttgcccatattttcttgcactacacaagtgagaacttctctagggtgtatggcttgagcaaaaatggtgggtcattcattaggtgtacacatctgccactttattagatactcgagttcctcttgaaagcagttgtagagattgcatgaattatagcaatgaattcaagttctgattgctgaccagccttagaaacagttgttaatttctgactcagttaacagttgttaatttttgctaatctgaggactatgaaatactgactgaaggtcgttggacatttattttcatattttagtggtcattcatgttccttgtgaattgcctattcagttattcaaaattgacatatttggaataatttatctttcttaccttttctgtaggaattctttttacattcttaatactaatcttttattttttatagtcattacaggtgtcttttagtttttggtatattttttattttatgtcctttttaaaaattgaagtataacacagaaaaatccacaaataataagtatgtagctgtggaaatgaccacaaagtgatggggaatttgtagagttttcattatttgaaaatttcatgaccatgtgtcttacttagttcattgtgccagatactcagtggctgacaaccatgtccctacaccattctgtgaaattttcttgaattatatggtggtaattttctctaagttcccagttttacctttatggaatttcttgtgtttggatatcgaattctggatattggtccctaattttactttttaagttgttcatttctgctttttactctactttctgggagattgcttcaactttgtttcacattatttctttccaagatctttttcctccaccgctctcgaatatctttatacttctctttgctttccattgttcacgttacacactttgcttcggtggctttgctgaccctcagttgtcagctcatgtttaagagtggaggacgaaacatgtgattggaagtttgagcatgtgggtggtggggcttgatctcctttgaaagttttcattataggatgatgtagcagaaacttctgacagatagtcaggatcatttggtgtttcctctggggcggtcacattttgtgaagaatgccccagtttcctgactctccagagcgtgaaggcctggctccatccactctggaatgtgagaggcagagacctgggtgtgggtcatcctgtgtgactgtgctcatgtgctcaggtaatcctgttttcagtgtggtgggctcagccctcatctgtgcctgtgcagtcccgctcagaggtccttttatccttttctggagaataagtctttatatttgctgctggttggagttagagatctgggtatcttatgaatctggatatgtgttacttcttaagcagtttttaaaccgctccccattttagccctcatccttccttctgaagacacctcgccgttgggggaattttgccgtgtaagtcaggttagttctaggctgtcttccctcctggcttcgaatttcattttctcaggtctgttttgtcatttcccgtgctgccaatattttgttgccattatcctctctcttgttttctcttgtctttgtgggcttgtctcttttaaggacagtccctttaccattgttttagtgggattggggaggcagagaaaagatgcttgtgttctgtttaccatcttatctggaagcctttctcttgctttctttcaagcctgaaggatttgcaaatattatatcccgtatttttagacagtttctggtgggagaatttcagattaggtctgtaatactgctgctcattagatcttcaaaatgggcttgtgaggcatgccatgcctctcttgcagatgaggaagcagtatttagagaggttaagtaaggcgtgaagggttatcacataactctaagcgatggtgctggcactgcacttcagggttttctgacttgaatacttacacttactccactgcactagctttacccactcttcctctagcaattatatggcataggggtgggctgtgttttcatcgagagcacagtaagcaaaggacaagacttattttctgcagattgtttatgtctttactctgttgtcctgttgcagtgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggtaaccactttggcctcgtctgcccagtttgatttgactgagtgtgggagtggattctgttttcttttaataaaaggtggcatagccacctaagaaatctttttcccagcacaactcatctattggcaatatacctgcaggctttaactccctttccatgaaataggccattccactgagaccagccttttgaaggggtaggacgatgtcattaatttattttatgagagaaagatagtgttactggatttgctggtctattctcagaaataaattttctttaagcctacaaggggcaaaaatcatctggtcttaactactttacccatctcaggttgatatccagatattcagatattactgtatctaatacaactaattggttggttctgtaccaacacatggtgacacaaagattaaaaccgcaagaactatgagttctctattctcatatgcttttttagtaattaaagtagtaatttggattaagttaatctagaacttcagtgtttaaggcatcatggtttataaatgttcctttatatagccactgaaacttttttaaaagatttcaatagttttagggaaacaggtggtgtttggtgacatggataagctctttagtggtgatttccgagattttggtgcacccatcacccgagcagtgcacactgcacccagtgtgtcatcttctatccctcagcccccttccccccagagtccgttatatcatttttatgcctttgcatccaatgtttggttttccattcctgagttatttcacttagaataatggtctccaattccattgaggttgctgcaaatgccattattttattcctttttatggctgagtagtattccatggtatgtatgtaccacattttctttatatacttgttggttgatgggcatttaggctggttccatgtttttgcaattgcagattatgctgctataaacatgtaagtgcaagtgcctttttcatataatgacttcttttcccctgggtggatacccagtagtgggattgctggatatatatccactgtccactttggatattttaagaaaacatgactggaaatttttttttttttttttttttaaatgagacagagtctgactctttcactctatcgcccaggctgaagtgcagtggcacaatcttggcactgcaacctccacctccctggttcaagagattctcctgcttcagcctcctaagtagctgggattacaggtgcctgccatcacgcctggctaatttttgtatttttagtagagatggggtttcatcatgttgaccaggctggtctcgagctcctgaccttaggtgatccgcccgccttgacctcccgaaatgctgggattacaggcatgagccactgcgcccagccatggctggaaattctaaaaggcaattgtaacattaaatctctttccattaatcacagttacttcgtttttattttattttagactcagagggtacatgtgcttgtttgtacataaccacagttactttgaacttgtatatagttcatggataatgtgattatctttgtataatatgtccaatctcagaggactggtttttgagtgaaaagtggatttaagaaaacttctgcatgatggtgtccacagcatgcttcacacctataaagaaaagatttaattttcaaaatggtacttttttttccgcttaacactgttaccaacttctttctttacctagcggcatctggccttttttttttttcttctttttaaatttaacactgattagaagatagcaaaaggtcatcccagtgaacagacccatttttaaatgtgccaggcactgtgatcttggctagcagtagtttataaggtcctcgccctttacaagtcaaaaaagtagtacaaggtaagccctcggagaaactgttcgtcatgaggcagcaaatgcaagcccagatagagtggaagtgttgagaaggaagtgcgtgaagagtagtcaggaaggaaggtcttctgagaggcaggcaggtgcacttgaactgagcatacatgagctgagtcgaattgctgagatgaacagagttctcaggcttcagcaaaggcttgaaagtgggacagggaggggactgggtggtgttcaggatttaaagacagtttgctaaaaagactgaagctctttataggaggctttagacaggaaggtaaatggctcttcacctgatgcagcaggcttactagttagggagcctgtacaggtggtcctgtcagcagcaagccatggtgaaactacctgttaggaagtttgagaagatatgagactcctttatctggctcactctgactacctgtgcttactctttctaaacacctgtctcatcatatcattcccctgttgcgcagtaacaccatgctagggtgaacataatggaattggagggaaaaagccactgagagttttaaggaagaaatgaaaggttgtggtggcgacaactgggaggaaggaggggcagcaacacagagatgaccaactgaatggaggccacaacctgggagatggtggtgctgatggatttgtggtagagtccagaaagtgaaggaaaacttaaaaggactggagtctggggtgtcattgatagaaatttggaggagttctaggtattgatagagccttagtctctaaatccctctgtcagactcttttggcagaaccatgtaaaggtgtacggtaagtcctcacataacgttgtttccttcagctttgtttcattataacattgatgagaaaaaaaattgattttgtttcccttaaagttgcaatttccaagaacctatcgacaacattaagttaggacttactgtattattaatgcaaatacctgaaataatatttctgtagcttaatttctatgcttagggagtataccacagcaaaatttaatagcttgccatccatgaagatcataaaaaattgcttttctaattctataattcaccagaactgttcatttttctttttaggaacctatggatttttgtttccaagtttacagaatttgatgctcgaaaactgcataagttatacaagatggctcataagaaaaggtctcaagaagaagaggtaaagtacaaattcagtcctaattcatacaaacaaataccaattccacagaaaaatctcttaatttttgtttttccatggggagatgatcacagaatcatgggttattgctggtgctaatagtcaaacaataagaccagatgggtgaaatagccaatgtattggagcctaacatggttgaaattctgacaaagagtgtttaccctgtgtttttaggtcctaaaatcatttgttcaccaggttttttcttccatttgcatttttcttctgtacatgtcagtagcttataaatgtggctcctaggaagtaatagggtggtgggcagaaaatactttttctcttcttttctggaccatctatttggtgtccttccagcttttgtatggaaggggtcctgctactcacttgtgagaggtgctcagaagttgcctctcctttggaatagggggatgggtgcagaagtgacatggaggaggctgcagaggcagtgctccttgtgtgggtgtgcccatttgcagatctgctgacttgccacatgggctgtacccaagttggacattgagttcaatctgtgagcattaaataccacctccactaatgcgtcagctccatgaagacagagattttatgtctctcatctactgctgtgttctcagcacatagaatggaatagaatggtgctggggacagggaagcactcaggagtatttgttatgctgtgcccagtgctgtgttggcctgtgaagcagcaccctcaagtagttgataatttaattttacatggaagaatatgttatagcagtaacatacaggaatcatatactaataagcattataaaaagtctataaatggatagtccggaaaggccccaggagggaatgaaatagttaggaaaggccctttagaagggagtgaaaattaggaagagggtctgaagttggacacataatcatgaaagacttcattcatttagggatcagaatgaataacaaaacagtataagctgaataacaaaaacagtggtatcctactagtgggagtatacattgtcacaacctttctggaggagaattcagcaagatttattaaaagactaaagcatgcagttttgcttccaggaatttagttttgagaaggagatagagatttaaacatgtttataatggaaatggcttggaagcccaacagtaagaaatacattcaatgtggctaggcgcggtggctcgtgcctgtaatcccagcactttgggaggctgaggcgggtggatcacttgaggccgagagttcgagaccagcctggccaacgtgatgaagcctcatctctacataaactacaaatattagctgggtgtggtggcacatgcctgtagccccagcccctcaggaggctgaagtgggaggatcgcatgagaccaggaggtggaggtagcagtgagctgagatggcatcactgaatgcctgcgacagagtgagactctgtctcaaaaaaaaaaaaaaaaaaaaaaaaaaatacagaaaacaaaaacattcagtagttcatgatatatccatattggggagtattaatcagttattaaacataatattgtagaaataagtatttacatggaaagattttcacaatacatgaagtgaaaaatgaataccaaatatttttgtttaaaatataactacaaaaaaaagcttagaaaaatacgtgccaaattattaacagtaattcccttgctggttaggatttgggtcactttattttttttattgtgtgattttttttatatcaaacatttgacttgtgtgataaggagtaatgttactccaacattcagatatttagcttgatgacttgggcataggagttagttcccactggacagtcgagggttgtttgttgtggttagccttggaaagttggtagtcttggttttacatggtccaggatgatcctctgagagtgccgccagcctgggcgcctacaccataccctgtacagtgacatctagcagtctatgcatgtgttcttgcaggtacttagcagtaatggtcaaactcagcataaattccactgagttcccccagcaaatagcctaacagtggaatttatgagccttttttttgttaggaggtagtaaacgccagttcagaagtttaagaaggacaagaaggagctgtttagaggtgatagcctttattcttctctggggaattaagcctgggatcttgagcttctttggtttccttttactctttaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcaggtaggtcattaagtggagtttttaaaagaggtgccaaaagataaaaaattcacacagccgtttcattttccaaagacactggctagacttctgtgctttattatcttctaacactttattgtcctctcttttcttaatgagagaaagcatgaaataaagatcccccaatttttttttttgtttgtttgagactgagtcttgctctgtcacccaggctggagtgcagtggcacaatctcggctcactgcaacctccacctcctgggttcaggcgattctcgtccctcagcctcccgagtagctgggattacagatgtgcaccaccacgctgagctaatttttaaatttttagtagagacagggttttgccatgttggccaggctggtctcaaactcccggcgccatgtgatctgcccacctcagcctcccaaaatgttgggattacaggtgtgaaccactgcgtctggcccccaggactattatttcaacttccgattaagaagaacccagctaacatgaacaaacgaaaaagactgagggagaagtttacattctgtatgacagtgaaatggttaaaactgctaatcttgaaagagctcttgtaaattgagaacaaaacaataactgaatagaaaaatgggcaatcaacagagtgaagagacagtttatgtaaggggagaaaatattaccaaccgtacatctgataaggggataatatccaaactgtgtaaggaactcagctccttatgtagcaggaaggcaaatgctcgattaaaaagtgggtaaaggacctgaatagacatttctcaaaagaagacatacagattgccaacaggtatatgaaaaaatgctcagcatgactgatcatcagggaaatgcaaattaaaagcacgatgagatatcacttcacacttgttaggatggctagtaccaaaaagtcaaaagataagggttgccaaggatgtggaggaaagggaacccagcgcattgttgctgggaatgtaagttagtgcagccattatggaaaacaatgcagagatgcctcaaaaaaatcacaaacagaactaccatatgatgcagcagtccctttaccaggtatatattcaacgaaaatgaaatcagttatgttgaagaaatgcctgcacttacatattcattgcagcattatttacgatagccaagatacgtaatcatcttaagtgcccatcagcaggtgagtggataaagaaaatgtgtatatacacaattgaatagtattcagctttaaaaagaaggaaatcctgtcgttcgcaacaacatggttgaatctggagggcatttatgttaagtgaaataagtgaggcacagaaagagaaaaactgcatattctcacttatgtatggaatctgaaaaagtcaaactcatagaagcagggagtagaacagtagttaccagggtcggagggcaggggagaattgggaagatattaacaacggagataaaatttcagttagatatgaggaataagttgagaaatctgttgtacagcatggtgactgtagttaataacaatgtattatataagtgaggtagtgcatatgttaattaggctgattgagccattccataatgtatatgtattttaaaacattgcattgtaatcaataaatacatacaatttttaattgtctattaaaaaatttgtacagtctgggcaacatagactcagtctctacaaaagtgtgaaaattagctaggcgtagtggcgtagtagtcccagctacttgggaggctgaggtgggagaatttcttaggcctgggaggtggaggttgcggtgagccaggattgcaccactgcgctccagtctgggcaatagagtgagaccgtctcaaaaaaaaaaaaaaaaaaaaaaaaattgcagttttgaaacaaaactcaaaggaatccagattgaattaaaattttggaaatttgattagaaaaaaactctgtggagcttatccattgttttaaaacaaaatgagcaaaagttatgaattagacagttcatgtaaaagagaaaattcaaatggccaatatgacgagatgaccaaccttgctactaggaaaatataaattaaagcaacaataggttaatcaatttttttacccattcagatcatcaaaaattaaaaagggaaatacacaccgattgctaagagtgtgaattgctataatctttgcagaaaataatctgaaaacccactctgcgggttgtctgttcctccagcagtggtccctgcctgggaaagacccagatccttagcctgttgcaggtgctcaggatcactgatctcttcagtggtgacagaagtcatctcttaactctttgaggttttctgctctgtggaatcttagtccttctagtcctcattgctttagctgctctttgatgcctttaaacacttctttctttttttgggagatggagcctcgctctgtcacccaggctggagtgtagcggcggcacgatcttggctcactgcaacctccacctcccgggttcaagcgattctcctgcctcaacctcccaagtagctgggattacaggcacacaccaccatgccgggctaatttttttttttttttttttttttttttgtatttttgtacagacagggtctcaccatgttggccaaggtggtcttgaactcctgacctcaggtgatccattcgcctcagcctcccaaagtgttgggattacaggcgtgagccactgcgcctggcctaaacgcattctttttaatcttccctttctcattgtttttggcaggatgtaattctgctacaagctaccctgcctggaagcattacgttctatgttctgtaatcttaaaaatctgagttcaaaattatttcatcaccattttgttgagggaaagaaagctaatgattttgcagaatgattgggaaatgtttccctgttcttagatgtagttgcatcagttatactggcttttttctagtattaggctgtttttgtgttttgtatacgatgtcacttattttatattctgaatcctttacaataacttcttactaaatacattcttttatttaaaccttggattcctcacccatctttttaatagctcaatactttgtaacctgtgatttacctcacagagggtttaagaagaaagaaaatctctttgatttactccagaaaaaatgaactagcttgagttttaagcacctctacaaaaccacagacattgacaccctgttagaaatctcactttccatttgatatgaagccatcctcaagtgatccttcgcatatttagaaggtgtctctttttgttgttatttgttaattcttagggtgaatagtcaaaagttttttactttgtggtgctctcatctgatctacccaggtcagccatgaatttaagccactggtggactgtacatcatattaatgctatcagtttctgagctcagcacttccttaatggtgttgttcttcagctctgtagaaaaaagctggaaggccagtaaaatgagtagagacacttatttggtggcatgtctttgatcttcacataattatagacagaagatggatttttccatgaggtcataggttccttttggttagtcctctgtattagtttcctagggctgtatataacaaagtatcacagactaggtggcttcaaacatcaaacatttattttctcacatttctggagaccaggaagtctgatatcaaggtgtcagcagggttggttccttctggaggctccgagggaaaagctgttccatgcctctcttctgccttctggtggctggcagcagttcttggcgttcttgactcacgccgatttctgcctccatctttgcatagccttctcctatgcatagcctgtcatagctccctctgcctttattttgaaaggatgcctgtcctggaatttgtagcccaacctaaattcaggatgatgtcatctagagatttttaacttaattacatctgcaaagacctaggtaaaatcacactcacaggctctgggtggacatgacattttggtagccacagtttaactctccatccctggacttctgtgtcttcactacattttctgattcaagtgagtatgattcttttccttaggagaaaaggaaggctacagaagttaaaaggattgtagtttggccttaatccgtaagagacagagcactgatccaagctcaaagttagagaaattacttttttataggaggaggtccatttttgtgtgtgtgtgcagaatagggaagaataatagaatcggtgagtgtagtctggagagattttcagagaccaggcacagcaggtaccagcaggtgaaataaacgttagatgtgtaaccggaggatattactcgcagccgtgaaactcagcggtatcattttctgaattagtttggttttgttgttaagagtctgccacagattggaaggttaaacaggtatggagagtgaaaagcggtagttgttaagatttcagaaggagaggagtagtaaattttgccttaaaattttgttggaaagaatgtttaggagtcattactgatacgttagccagcagcaacaagaccaagaagaaagaaatttaatgtctgtttgtaacatgtgtcaggctttcagtttgaacttcagcaaagtagtgcttacttcagcagcatacctacaagaattggaacaatacagagaagattggtgtggaagaaaacaaaaataaaaaataaggctgggcgtggtggctcacagctgtaatcccagcaccttgggaagctgaggcgggcggatcacctgaggtcaggagtttgagaccagcctagccaacatggtgaaaccctgtctctactaaaaattcaaaaattgggcaggcatggtggcgggtgcctgtagtcccatctacttgggaggctgaggcacgagaatcgcttgacccaagagatggagattgcagtgatctaagatcgtgccactgcactccagcctgggcaaacagagcacgactccatctccaaaaaaaaaaaaattgtagtgaaagtgaaattcatccatttcttgcagtcatcagatcattctttcttttcctgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttctgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccaaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacaacattggaggtcacatttcaacatgagatttggaggggacacatacccaaaccgtatcaccatctggaggtctttggtgtggctggtgagaacaggcacgatgccagttctttgtgagcacagggcactgttaccttcagtcttttcgggtggtcctttccctggccttgggtagtttccccacatgcacatcctaagcagtattcagctgtatacctgggaaccctctgtagatcttcaaacttctttctctgcagcactgtcttctctcatgccatgccctgtgaactctggccaccttggttccccatccctcaccttgggaagccaactggtgtctttctgggtttccttcttcctgtgtcacagcctgagggactatctcatgatagtgaacaggagccgttaaaaggctcatttcattagtgtccattcctcagggatcactgttcttcattgcctgatgtctggtgtcttgaaaaccactgttctatacattttgtcccttttggctgtttcaggcaggatggtaaatctagtccctgttattccattttgactggaacttgagattgctcacttcttcctccctctttctttcattgaggtgaaattcatattacataaaggaactattttaaagcgaacaactgaatgaccttagtgcatttataatattgggcagccaccacttctatctagttccaaaacactttcatcagtcagagaaaaccctataaccattaaataatccttccccattattccctctccccagcctctggcagccaccagtttgcattctgtctctctggatttgcctgttctagacatttcatatagaaagagtcatacaatatgtgaccttttgtgtctggcttctttcacttagcataatgttttcaaggttcattcatcagtactcattccatccttatggctgaataatatttcgttgtgtggatatataccacattttgtttatccattcatctgttgatggacatttgagttgtttccatctttgggctgttgtgaataatgctgcagtgaagattggtgtacaggtacttgactacctgttttcagttttggatatgtgcctgggagtggaattattagtcatattctttacgtttttaggaaacaccaaaatgtttctacgatggctgaaccattttacattcctaccagcaatgtgtaagagttgaaggttttccttatctttgccaacacttatttcctgggttttttttttgtgtttttttttaatgagtatctccatcttcgtgggtgtgaagtagtctcattgtggcttgaacatgcatttccctagtgattaatgacatggagcatcttctcatggttttttttggccatttgtatagcttctttggagaaatgtctgttcaaatcctttgcctgtttttgagttgggttgtttttgttgttgagttttagtaattctttttttaatggtatcatgagcagtttaccatggtccaagctaaaaattttaatactcttcacactgagttggtttttaagataattttattaactagtcactcacttgttgcatatttaggttgatggtgttattaataacttacaaaataatttctgtggctctttttctcatgggctgggtccaggaatatggtaatgtttatggatcttaccagatttttcctaaagggagtgagtttgcaaaagccatcagtaatttttcaagtgtgtacttgtgtcactgcacacttgagccttatttcataggatgtattttgctaataagtgtaaaatgactctgttattaatttttttgattcctaataatgtgagcatttgtccttgaatatgagtatatgaggaagagccaagtgggtagtgaagagaagtggatgggaatctggcttcagtctttcgactaatccttgcatctctatttcaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctcagaaatctcctcacgattccaagtcacccctggatcataggtctcctttggagagatcactagaacagaaaaacaacccagattataactggaatgttcggaaaacataaaggacagctcgtaaaggagagagtaagagtcaccaaacacgtggatatttttggtctgatcctacagtagccggttatctagaccagtaagtggagttttggacatgctgctgctgtcaactcactggctgaaggagcacttcaaggaatgggaggcctttcactgggtccagctctgattcgggtcaccactcctgcactttggcaccccatcccattccagcctagttctggcctcccactttgacgggcacttggaggaggagctgactgtgtgtgtaccagcttcactgggatgtgtttccccagtcaaggaacaggggatcttcagagtcatgaatgttttcttgccagggtcagtgttcccaggaccttagtgcatggtcggggcaggaactggtgcatggaggctgctgggacctggtgaacagtgtgtgatttggttgatttggttcactctgacatgatggatgctgctgatggggagtggcgagttggggcaagcgggtggggacaagcataggacttgaaggggagcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccagggaaggtaggtttctctggctgactgagtactgtgagtgaggcaacactgatgccagcatgggtcttacttgactggggagtaggctgagtgaggggtagggtggggtaggtggggagtagtgtggccagggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagc

SEQ ID NO: 13304 - DNA, 120213 bp, Human
  misc_feature (1)...(120213): n = A,T,C or G
gtagcccaaggaggaagtattgttattgtctcccttttacagatgagaaattctggggattgtcaactccatgccccaaaagatgcaaaacacagctagtaaagtggcagaattgagattcaaacaatggctccaagaacacatattcttttttaaaatatttttttatttctttttttggttcctcagagatccctattctgaacatatattcttacattacaaagaaactgggccatatgagagtacaaccaagagaaaaacattgtttgttattatattatgttatggaaatggaggttcaattagcatagagattataaactcctattcaaggctgacattatcttacattgaagtcagagcctctcccaatcttagtttatcaactcagttcttgataacctatttttagcttcagtatttacagatattgtcttaagcaacattcttgtttcttaagctcctgctttaattagccaataccaaaaaactcccacaaaaaaaaaaaaaaacaagaaaatatggtatttgcagtggggcgttttaagcaagaaggggctttaagcacaacactcataagcttagtcatcaggattaagttaatttagggcaaattcaaccttacagtcaacaaataagtgtatttcactttatattgtttgctatttaaaagtattaaaattccagcttctaaatgtagatatccatcccccaaacatatgcttctttaaaataggaagaacacaaactttaataagaactcacgtattcccttgcagagtcagaaacccaaacataacagcaattgggcaagtaggtaaatgaggaagtacaattcataacaaatggacagcaaaaccgataagtcaaattagacattttgactataaagcgaccaaacgcctctcctccaaaaccaaaagccaaaaccttttcaaatatacagcaactgaatcagacggtaattttggctttaaaaatctacaatactcttggtaatggtagaaatgatttatccggtaggttaaagataggtttctatcattccacttaacattatttaccaaatgctgcatttcattaatggagctgtcagtttattctgatggtaatgaaaaacaggttttaacatgaataagccctgggtccaccagaaaatatcagtgaatcaagaggtcccgaagcttatgcagtttaagggaacttcgtagattaaatttccaccttccagtcctgagagctgtggtgtgcacacccagtccgaataccttgttgagcatacaggacactaatttccgacactgcagctaactcctgcacaaactcttcaagttgcaggcttctactcaagtacccatccctagtccacatgccctagaaaaacacaggaaccagttcgggacgtagttacacatctagcaccccacgctcctcctcaagactatcctcctgctgtcccagcccagtggggcccagcccactaccatcccgctcccgctctccgaacttcccccctcccactccccaccatgtgaccaggaccctcccaaccgccgctccgagctccaccaatcagcaaccacctccacccagaacccgggacctggcgctccactttcaaaaaggcagcttaatcctcccgccctcagccacgccccctttccgcttccaggccccgccggcccctcccacttccttcagttccctgttcccctcctcccctccggtggcgcccaccctctcccgggcttcgccccgcccaccaggggggcagcgcgctcgccctcttctcgcgagatctgagcgtcccccgcggcggccgccgggctccccctcccgtcctcccacctccctcccccggcatctctcactctccggctctcctccctccctcctcccccctccaccctctgggccggatctcgtctcgctcaggcggaggaggagaaggaggaggaggaggacgacgttcggcctgcgcagtgagatgtttgtccgtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccggtgagtctctcctcggcgtccgggaccccggggccgggggccgggccgagagccgcacgcgaggcccgggctgaagtcccccaacaggccgcaggcccggcctcccctcccccacgcccgccggccgcggggcgcgagccttcccggcaaccgggcggcgcggggccccggcgcggccgccctcccgggccgttccccgcgccgggagcccgggcctggcgccgcgcccccgtccgggagctgctccttcagccgctccgcgggcgtcggctgcggccggggcccctcggccgccccacgcctccccacgttgccggggttgtaggcccagtctccggcgctgctagcagccgcggagtcctccctgtgtggggcgtgtgtggaacttttcacgtggggtttcgctacactttgaaaaattacccagcctagcttttagggtgatgaaggggctgccctctctctctgcccccctccccaggaaggtctatgccatcaacctgcccccgacgcagtgacagtggttccacggaatgctccgtggtcataaactagtaacattgggtgtatttatagcgtctttcatcctacaagcttcctaagcactttacaaactcttgtgcaggattgcctcgccactcggaggaaggccgggtgggggggaagcaacagagagcaaaccggccaattggttctccatttctcagccttgggagcccaaagaatgagtgtagtcgccttgcggagtagctttgtttcatcgctttcagtgacagcaaacgtgttctgctcagaaactttttcttttttggcattacgttgagtcgtacccttgcgatgtttagtatataggatataactttgggtgtcaaatctggttcagcttccccgtggcaagcaattaaaatgtactgttaacgaactgggcatacttgcctatgtcgctacaataaaaggcatacgtcaagacagacgaactagcaatcggacagaagattttaaaaagtaaaattagagaaagatcttggtcttcccttcttagattcataaatacttcatatgatgtaccagcgaaagagggggatttgttgtcactttttaaagcatgcttttcctgaagcgcagttgcagtgaggaaagacttaccttgatgtgattgccccagttgagtcaagtgatttagtttcagagaacatgaggacctctctgaattcctaaaatttaaaaggatacacctcatgcagaattctgaaattgtaagaacataaatactaaagtcagtgtgcgaaaacctctgctttgtgtaaataggtacgatggaatttaggagaataagtgttttgataataattaaagattttttgaatgtttcaaacttttttctaagtaaacgtgagaaatgttgacaagcgagtactaacgaagcttactagtatgttttcccttataattgggcagagctgggttatgcatttgtgagtgatattaattttcctactaaattctgaccactttagagtttagaattacttagaattttatgaagttaatagttttatacaacagattttctttttttttgagacaagagtttcgctcctgttgcccaggctggagtacaatggcgtgatctcagctaaccgcaacctccgcctcctgggttaaaagcctcctgagtagctgggattacaggcatgcgccaccacaccgggctaatttcgtatttttagtagagacgaggtttctccatgttggtcaggctggtctcgaactcccgacctcaggtgatcaccgacctcggcctcccaaagtgctgggattacaggagtgagccaccgcgccaggcctatatacaacagattttctagcagtgtgtgcagccttacactactcaattcttgaagtctcatgttctaaataagattttttgctaaaatgtggagtaactcaaatttgacatcaactcactcaagttaatggccttctgattgaccagttgtacgttaatgtatgtgtaattaaactctttgacctcttcaggtttccctgctcttacctgttttgccatcatttaatttgttcagcaaatactgaatattatgtgccaggcactgttctgggggtctgtcagtatagctagaaagaccaagatccctgccttttggagctaatattgttggggagaagaggtgggagagaatttcattattcctttagctgaccagtataataacgttgtgtgatacgttaccacatagtactggaactgaatttttttttgttagcttcgttatgattatgagctaatttggatccattctgtctataacttttgcaggtttttctgaaaaccttacatgaagtaagtgactagttttggtattcagtagttaatagctgctgatttctaaaagaatttttcattactgtttaataagtattaataacattcctaagtgattcccattggaaagaactattacagtttatggccctttgttacagatagatgtatatctcagtgttagggtgtttcatagatttatcttactaaccgtgtgcttatagaccttcaaaattcctgtcttccagattggcagtcttgttcataactacagactgcgtgagttgctagtcaaaagtagttaatacctagtgttccgtaaagaaaaaatatggccgggcgcagtggctcacgcctgtgatcccagcactttgggaggccgaggcaggtggatcacctgaggtcaggagctttgagaccagccgggccaacatggtgaaatcccatctctacttaaaatacaaaaaattagcggggcgtggtggcggatgcctgtaaacctagctacttgggaagctaaggctggaaaatcgcttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattatatatgtttaagatgtacatgatgttttgatatatgtatacattctgacatgattactaccatcaagctaacacataatcacctcttttttttttttttgagatggaaactcgctctgtcacccaggctgaagtgcagtggcacggtttcagctcactgcaacctccgcctcctgggttcgagcgattcttctgcctcagcctccccaagtagctgggattacaggcgtgtgccaccacgcctggctagtttctgtctttttagtagagatggggtttcaccatgttggtcaggctggtcttgaactcctgacgtcgtgatccgcctgccttggcctctcaaagtgctgggattacaggtgtgagccgccacgcccggccaatagttctgttttttatgtctgtgtgatgagaacaagtaagatctactgccatagcaaatgtaaaatatgtaatatagtattattaactgttcttaactgtgctgcacatttgatctccacaatgtattcatcttaaaacttgtatcctttgaccaaaatccacgcccccatttctttcattccccagcctaggccttagagcaagactcttgtcttaaaaaaaaaaaaaatctcaagcactcatctcagattgttttacaaaattaacttgtaaaaaaatatagaattgtgttttgagattgttttcattgcaaaatagagtggtaattgaacttactggatattttatagatactactccagataaattcccatcagtaatatcagattctttttagtgttttgagtgcattttttttttcttttttgagacagagtcttgctctgtcgcccaggctagagtgcagtggcacgatcttggctcactgcagcctccacctcttgggttcaaccgattcttgtgtctcggtctcccaagtagctgggactaccggtttgcgccaccacgtctggctaatttttgtattttaagtagtgatggggtttcgccatgttggccaggctggtcttgaactcctgatcttaggtgatcagcccaccgctgttacgcaaagtgctgggattatagctgtgagccaccgcgtttcagccttagtgcgtattttaagtataccttcatcattgtctgtagaagttataatacacaacagtttaatgcacaatttgcatttttaaatagaccttttcctagaagttctttttaagatggaagacaataaggacgtttctgtatttgtaagctgttgacaaaggaaaagtttattccagtttataagctttcccgccttgcacaaaatgtatcatttcacatctttttgataatgtttaaattttaatttgtatgcagaggaacaaggaccacaaaactttttaaagaaagcaggctgtaattgtgaaacttctggaaataatgtgggtctggatcaaataattctgccccagggagtctcttccttactcctgggctttgttccacctatgtaggattagttgctctcaggtgaaccttttattatctttatctctgaaaaatcatttcttaccatttttactgtctggggttttgcccacatgggtttgatgagcttgattagaattggagaggatacgtttgaatgaaaatgctgtcctttcctgtatcaaacggtaataaagcctttcttggcctagccttcagagtttgggaaacctgttatgaaggtgactgtctccagaatgtaatcaggctcttaagatctctaccctggggtcctggaagtagcttcagttagtttataaaagcttgctaactcatcaggagaaagagtgttatgataaaatgcccactccctaatgctagaggaactccacttgtgtagcatggacagcaactgtttggaagtgattgttagctggaacatacagggcgactcacattagtgaaggagttttatgttcatttgtgatatacttaagaacaggaagagtcttaaggacagatgggtacagttaatctttttttttttttcttttcttcgagctacagaaatgtttgccagatttgagggaacagctttcatcttcatagtaggtttctctttcttagggaaggtagttgttggcatagtactacctggactggtacatagaggaaagctggatggtagtcttgcagatcacactgagcagagaattaattataaatttgcttttcatttttcatgttatgaaacaaagtgaaacagattcattaaagtgttacttatacttaaactaatactgtttatagttttgggacagccagtattgtcatagctgttagtactactatgactttagaagttagaaaaataaaagcatacggttgttattaacaaagtatttattttgtcttgtctttctagatagcagttcagaggaacctggaaaattattagtaccaatattgaattagaaactatttaagtaatatgaaatataatgtaaaaatttggctttttaagtaatacataaatcacaaacttgattcaaacaaattagagaatgcttcatttgtttgtacatcattcattaaatgaagttaagggatgaaagcatttgtccagttcaggaagattatatgattaaggctagaaaaagtggtatgccttttttttatattatacattgggggactttaaagggaattttttgttattttcattccagagtacatggatggtctttagtagtcctgttaggtttatataaaagttactagacaatttgtagttttaaataatgcaacttttttttaaaagtagttcttgttagcccattgtaaggtcaacagaatgtaaaggtattactagtaagaacaaatcactgagttaacacatgaattacaattagttattagtctatcagtgtcttgtgaaaactattcaaccatagtctgttaaagcaatgaatttattttagtagcttttctaattataacaatgatgtatattcctggtagaaaaattgataattatctaaatgtacaagtagggaaataaaaaaaatcacctgtaatcctaccacttggaaacaaacaacattaacattttcatgtgtttttggaattttaatttcatattgttggctgaacagacagtaaaattaaggtaagataatcattgtatatgctgctgttaaaaaatttcttactgtaaatttttgaaaacatagtttttaatgactatcatacttcagtttgcttaaccatttccctattgccaaatattttggttgattccagggagtccatattttttctgttaaaaaagattgcaactatgactatttagacacataaatatttgagtccatctatgattatggaattattgggctgcacataactgaaatatattacctaattgacctccataagggtaataataatagctaacactttctaaatgcttatcatgtactctgcatatctaaacttaatcatttgagcaaactctattgaatactactattatctgttctacaaatgaggctttgagaggctaaataatttgcttaaggtattcttccaagtggcagaactaggattctgacccaagcaatctggctctaaagtgagcactcttaagaattaattatatttctcaaggttgtatccgtttaacttctgtgtagcagtatcttacccagcataatgtatgtttaattttataggtgaaaaaatagtactttaatgctttaatttgcatttctttgactacttaggagaataaaactatgaatagtctgtagagaattttcatttacttttgcactggagtattcaacatatgaatatagggatgtgactaaaaagtaaagagactgaaagcatagtagttaagagtgtgggcttgaataccagctccatgtctttctagctgcatcaccttttttttttttttgagacagagtctccgctctgtcacccaggctggagtgcagtggcgtgatctcagctcagtgcaagctccacctcccgggttcacgccattctcctgcctcagcctccctggtagctgggactacaggtgcctgccaccacgcctggctaatttttttgtatttttagtagagacggggtttcaccgtgttagccaggatgatctcgatctcctgacctcgtgatccgtctgcctcatcctcctacagtgctgggattacaggcgtgagccaccgcgcccggcctctagctgcataacctttaacaagttacttcttgtagcctcagttttcccctgtgtaaaatgagactgctaatgagacccaccttacaggtttgttgtgtgataaataaaataaagctttaaaatagaacttagcagatagttaactattattataccaatatttagccatgattaggccaatattaaaattggatgttgtttttgcaagcagttacatcgaatgccatacacttattttagcgatcctgtcattttattgtacaacttctagaacttaagttttgaaaagcctgcagagccagtttgtgaatcgttctaagaaagcattctcaaaggatatgggtttagtaccactgggatacttaaagaatcctgttggctcttgaggggtggcttcaaaaacagaagttcatatatgattcacatgtaatccatagagtaagtgtgtaacctcttgtaactttattgaaggaataaacactcatttggtttgcatgttctataatatgtacgttaaatgtgcatctaaaaacacatctagtttttcttttttccttcctttcctccctttctcctccttctcctcccccccccccttttttttcactcctgaactaggttaggttgtggtccctgtccaaagcttatgccagacatcgttttgaaccatgcagcatttagcatagtgtgagtggttagtgaatgattgattacatgagaaactagtcctctaagccaaaccatagtaattgataaattcagtgagtcagcgcaaatgatgctctgaaatgtttgaagtttttgtaactctaagtgaagtcttaagatgtagtagagggtcgttaaagatcatgtggcacttctgtatgtagcagggtagtcagcctagtctcctggaaaaatgagttgaaattgtcagtgaccctgaattgggagttagaagacttagtctgcggtccagtctttctgtttactagctgtggtctacatttcacttcctccaccatgactgttcttcgcatctcatcccttcctgtcacactgttaaattgtacactctggtcccctatttctcaggcttatctttttgaattgaggtttctattacagtccttgaattattgggcccagatgtggtttattgccacttccatcatcatcttttttggcttgagaattactctcctgctctctccctatgaccatctgacttcctgaactcatgctccctcagtcattgaggagtttaataccttcctcacagatactatgttaatacattcctcacagatattatgtctagcctctattttaattttgttcattgcatgtggaagtcattcatttattcaatttaaaatacgtttattgtgtgttgctgctatgggtcaggtcctggatctacagtggcgatcagacaggcttgtattgcagggatcttcacgcttagagcttgtcatcctactagtttaaaaatcttcaaacttccattttgcattttatcctagctcttctgtttgttagatgtaggactttgagcaaatcacttagtgtcttgtctgttccctcttttgcaaaaaggaaaaaatgatgatacctacctcataaaattgttttaaagatggagttaatacatataaagcttcttagaatagtgcttggcacataataagcattatacataaatgcaaggtgttattatttaattattctatcttgttgcttggttccttctcacgttaatgtgccctttgatctcaggaagacccatttattctcccaagccatggtgctgtcacttccacctatgttaccagttgcccctttcttactacctccccagaacaaggccagaaatagcagcagaaagcatcttggatcgttctacctatttgcccccactgaacatattttctagctactcctggagaaaattgcaagacagtggtctctaatttagctggactctcagtgcctctgagcagtttcttttatgtccctggtcagcttcctctcccctttcttgcctgagctattccaaactttaatcattgtccttaagctatctcttgagaattctcttattgctcttacttcaagaaacctaactactacatcagtgtgaaaaggaatgtaattaggtgaaagttcgaagttcattcagcattcttccctttcaattatattatttaatctgcatctttattcattctcgactccttccctctggtctcagagaaggaaaatgtctttttcctgtcttctgcattatagtaactacctcctttcacagccaagattcttgagagaggagtctctatttccttttttagagcataattttcttgaggaggcctcagtcttttttatgactttgatcagtacagcagtacgcacccagcatatagtacacaatgttgaataaaggaactaacagactctttaagtttgtttcctcctctttaagatgagaactacagcagtctttcacaaattgtgaggattaaatgaaatcatgtcagaaaatgctaatagtggtatcactatgacatttaaaagaatttcccaatcataaaatcaaaattttcaactataattctgtttcatgtagggcagttattttcaaacgtttacagggagcctggagggtgtctaggacccaggaggcctaggaagtgttaagtagaaatctttgaaagctccctctgtggtccttgagagcagctcctgtgttaccatttgtatatggggttctgtaaaagatttcattttaagaaatgctgttaaccattgctttaaaatcactagtaataattattaatgaatcttttttaaaggtgaggagaatactacttgctcaacttgataacggttaataggaaattgagaactgatcctgtagttgccttaactcctaatccaaatctgttgctactagacagcattcttttttttaaattcagttttaaagttgaaaatataactaagcaaaacttcctaatttgacctccatttagtacttgtaatcattgagaaaggattggacccaaatttactctttaaatgagaaatgttactgctgagcagatgaataaaacgacttcaaaggggaatttttacctactttaagaaaatataagattccttagagatactttcttataaaagcaagccatcattgctaagaggaattccttcacatatgtgtttgtaagtcactcttacctaaaacagctcttaactgagcaacacttagcctcttctgtttgccctgtcctctccaaagtaatggtgaaaaattcctttttctttttcatctccaattcctttccatttccactagaggttgccttgtaagattagtgacaacttgttgaatgtctgacttgtggtaggctgttttagatacttttaactaattatctgaaatcctgaaaacaattttaagtataatgtggttactcctgttttaaatctatttgggtctcagagaggactagtaaaatatttatgatattacatatacgcctagagaagggcagagttgggattcagattctaggtatgtctgactgaaaagttcatgttgttttcattatacagaaaattaattctaaggttaccttttaaattattagccaggggcagatctggggacgctgaagcttatacaatgcactactctctttacaaaaagaatctaccttcaggttccaggagttggaagaagccttcgtaagcttccttcgtaagcttaagttttactggctttaagtaaatggaccatttataaaagttatgaaaaacttgggaaatgtgtattgttcagtaacatttgaatatataacttgtttaaggggaccttagtgtgtattgacttgaataaagcagtcaaaagcataacctgtaagaaaggcttattattactagttgacctatttatgagttaacactttgctactttaaattgtaaggccgacgacacacattaaaaaaatttggttaatagaaatttaagtatatacttagcaaaaagtgattccttgaagttaatatgtctaaaatactttgatttttaattttttgtctttaagaatatactaaagagatagattaaacagtaaaatgtattagaaatacaaagattaaattctctagtaataatttactacttttggtgtacgcaaatgcaacatgaaagaaataatgcttttttgatgaatgctatcactagccaaataataatttgtgtgctcttgtgttagtattttaatttttgagggctaaaagtgactcttgaaatctttttgtggtgctataacaaaatcctgcagactgagtaatttataaagaacagaaatgcattttctcacatttgtggaggctgggaagttcaagatcaaggtgctgcaggttctgctgtctggagagggctgctgtctgcttccaacacgatgtcttgatgcattgtcctctcggaatcctttggtggggacgaatcctgtatctgcacatggcagagacagaagggcaaaaaaataaactctctgtcagcctcctttataaggccacctaatcccattcacaagggttctacccttatgagttaatcacttcctgaagaccccaccttttttttttttttttttttctctcactctcacccaggctggattgcagtggcttgatcttggctaactgtagccatgccctccagggcctaatggattctttcaccgcagcctcctgggtagctgggacgacaggtgcaggtcagcagcaattttttttttttttttttaagagacagggtttcactgtgttgcccaggctggtctcaaactactgggctgaaatgatccacacactttggctttcaaaagtgcaaggattacaggcgtgagctgctgcacctgcattgccgtaccttttaatactgttaaattgatgattaaatttcaacatgaattttggaggagacacaggcattcaaaccgtggcagagacttttgagagaatctgttctttctcaacagatgagcaaacaggggtctagagaaagtggtttaccaagggatacactcctgacttgaatttatggaaggaccatgaccagaagcttgatttctggttaaaagctcttttctctttagcagactgaaacaaacatgtagccgtaataactcaatgttaacactggcctatttaattataaaatgatttctcagtattgagcactctgattatttgagttgacatggtaccctggaaggacactcagcttaggacacttggactccttcattgctctgtgtgatcttggataagcttccttagccttagtttcttctttgtgaaatgaagaggttttaacttggggttaccttaggcttattctagctccaaaaatttcagtaaaagacaattgtgtttatacataaatctaggcaccgactactagtgtcttttcctgtggcctttgtttgaaatattttgtgtgatgttgcaaaaattacttactttttagtcttagatttttctttatgaatggtatggttcagtgatgatggttaagttctaatgtgaagcagtgggaaagttagctgtgttcttgtgtacattttttttggtgagttgacagttgtaggaaagttttaaacagacttatagcagatttttgtaacaattttgtgtcatagaccttttgctgtcatatcttatttgattacagttagaatcattcaaagacagagcaaactatggcagttcggtattttgtatgtttttttcctttccctttgggttatgtgtaattgatttaggtacaatcaatttgtcattgtcttacagtttatagagtttttatacattatcatagatgaatgtgtaaaaagtaattttatatacatgtgacccatgtataaataaatagtagtgttaaatagtataaatagtagtgttttggatttcatagtatattgggaaatacaacaaattttattttgaagtgttgattttagatataatcactaattttcttaatatagagggtctgtaagtacaatgtttgaattctagttatgatgactactgtgttttttggataaaatgtgtttaagggagtcctgtaacatctctatttttatgggtggaaatagcaccaatagtaggacagtgacaagctttttacctcagtgagagtacttacattattgtatcttatttgttgtggtcattatcacattttgaaatgttatacatacctttttttctatatatgcaaaagtcattcacagagatatagtcgaaagagttgttagtacttttagctcaattgctctgtgacttaaatggacttaaataggctaatctggaagcttgaccttgtgtctttgaaaaaattgtttcacatttcccacattctcaaattgagttttggatagcctactcatattgaggactgaaatgcaaatcataattgaaccttctattgatgatttaactttctcattatgaatgttactgttctgtaatgtaatgatactagagcccaattgaatgtcgatcaggttgtgatttcatggaattgtcccatgctgctgtgcttttctaattgataatctttttttttctttttccttggcatcagctctttttttggcagcactcccccactcccatctgttctccactgtaaccagagaaaccagttaaccaaacatcagtagtttttacattcagttttaagtcactaatcaaggctatatgtctcttctacataggcaaggaagaaacaaacatatttattgagcaagtgctgtgtgccagatgctttcacagactttcttaattaccccacagtccaccgtctcacgtttctctggccacaagcaaatgaggaaagtgagctttgaaaggttaatttgttcaaagtctgtttgaatgtgtcccactgggctgtttttctcaaagcttggatctttggctacatttttgatggttgatgttgcttaaggaataattgatggataaatggtattattgcagatgtcataagtagttgtatactgtttggtcatcaaataagactccttatcattaactgcaaatggactgtattcagatcatttttttttaatattatctatacattgtgccacgcattgtaaggggtacaataacataaagaccttatctactgtgaggtgcttacagtttgggagggagcttccttatgtaattaatagtttagttgtatcagatttaaaaaatactgccattcctcagatgcttgtaccaaagcttttttttttttttttttttttgagactggagcttgaaattaagatcaagtattttcccttgtttattttttttctagctgtgtcattctgaattgcctggaatttcaaattctcaccctttcccccacccaccctgttctaaattttttcttgtagaaaattattcacagaggactaaagacttcttgtcctttgtatgtagtagatgttaagaattcacttcttttcatttagttttaatttgtctcatgatgtagttctctcagtaatcacagaaccttcaagatgtgtaagtatataatagactgacatcctttcaaattcaggcattttgaaggttatattttttatatcatctgaagtaatgtaaatgaaaagattttgctttaaagaaaacaaagaccattatagatttatttttgttattgatacttttctgatgggaaaattgtaatcctggattggagggaggtaaggaggcaaagatcactttcaaaaattaaattcttgacttggtttttgaaagtcttactaaactataaacatttaagaatccttaattatatttttcctttaaaaaagcttttgtttctttttctgctgaatgaatttaatttgcttgctgatcattttgtaacttggccttcttggggaagggtcctgtatacatctgataattagatagcaaatattacatgtttgtgtatatagatgataaatgtgtgtgcagtttattttattgttttgctgacgcattagttgctagatcccttagtgtatttgcagttattgcaacttaatcagtttatcaatgggattaaagccctgctcaagtaatttagaatgttactttaaaagaatgttacttctcttttaaaaaatatattaatacataaagttagagcctttaaattttattgctcctggaatgaagtatagcttaaagtttttattgttaacatattgatgaggtgagagttgaacatttaggcatttaaaaaatttttcagtagcagttaatgttgcttctgtgtcagggatgggcaagtggaaagattaaagctcattagtaacataattattttgccaaggatgttgacgtgcatttgatgccaagacccgatcatgtgtatgtattaatctgcacttgaagcccatttcatttgatatgtagtttttggacttatttgatttagggaaagattgtagcttattgatctgcttctgaagggcctatttcgtctaccctttttttcccagttaatatttattagtaaaattaatgattaagcagccttctgggtgaggcctttaggtgaatgggaaaaatctgaaaatattgcttgatgtaaaatttaaaagtgtgttacttgtacactacttctgttagaaaaagatttgattatttaaaaattagattaattgctgagggtaaacacattcaaccgttttcctgtatcattgtgccttataagtaaaaagtttgtgttgtcaaaattacattggtataacatggataaagtagtattcattcaacagacatttgtttacaaccttctgtgtggcattgaagaaaaatgcataatctcttaagctcatagtctagtggaggaagatgcatgaacagataattcagctacatgggagtgtagtgatggttacaaactgtcactagtagttatagactatcaccacattcccatataaacgaaaatacactacagtttatttagtgtatagttaagtaaatacagtttacactataaaatatcacggaagaactgagaaggagttgttaactttgcttgaggagttcagtgaaggattcctagaggttatgacacctagctgtgttcagaagatatgtgtaaagaatcagataaagaaaaggcaaagcaaaggaggaccaaaagcaggggggaaaaaagacatgggaactgaaataagtggggaggggctgtgacagtgatggaaatagagtgagaaacagcaagttgtatatttaagaattcccattggtttaatgttgttgggaaatacatgtcagacaggtgtggataagtgagcataaactaggtctgtgcctactatgctaccatagaaaggttttgaacagggtcatggtgtgcctatgtttattttgattgtgattttgagggaagtagattccatgaggttggagttcatagtgtttggaaggctcttgcagtgaactaggtgaaaggttttttttttttgagacagagtctcactctgttgcccaggctggagtgcagtggcacaatctcggcttactgcaacctctgcctcctgggttcacgccattctcctgcctcagcctcccgagtagctgggacgacaggcgcccaccaccacacccggctaatttttttgtatttttagtagggatggggtttcaccgtgttagccaggatgatctggatctcctggcttggtgatccgcccacctcttcctcccaaggtgctgggattacaggcgtgagccaccgtgcccggccgaagcctagaagttttaacaccaccctgggcaacaaagcaagacccccatctctacaaaaaaaattaaaaatattagccacgcatggtggcacacaacggtagtcccagctgctcaggaggctgagacggaaggatcccttgaacctgggagtttgaggcggcagtgagctatgattgcacctctgcactccagccttggtgacagaagaagaccctgtctaaaacaaaaacgaaaacaaagagaaaaacaccttgtgactaatcatcttcgtgtgagcagtttctctctgtagtgtagtaaaaagttttcttttgcggttttcacatatttttcattatgtttagtggaaaactgtaaacctggaataacacgatggaacccattcgacgtgcccccagtgaacctggaagtgctcccaaaaagcagagaaaagtcatgacgttacaagaaattgttgaattgcttgatgtgtactagattaagttctgcagctgtggttacctgccatttcaaggtaaatgaagccaggaccattgttaaaaggaagtttgtgaagccatcgctacacctgtgccagctggtgcaaaaaccttgtgctttttgcaaaatacttttttatctcatattgaatatgcagcttgtatgtgggtgcaggattgctgtaagaaaagtatacctactgattctaatatgatttaagaaaagcaaagtcattatatgacaaagtcaaaggaaggtgaaggatctaaagctggagaatataatgccagcaaaggatggtttgatacttttagaaagaagtttggcttaaaaaatgtcaaggtaataggagaagcagcttctgccattgaagaggcagcagacaagttcccagacaccatcaagaaaatcattggagacaaaggatctgtctaaacaggtttttgatgtagacaaaagtgccctattctggaaaaaagtgccacaaaggatattgactagtaaaggagagaagcacatactagggtgtacaaggcaggaagggataagctaactctgctgttctgtgcaagtgcagtcaggtttttgatcatggctgactttatctataaatctactaacccctgagccttgaagagaaaagataaacactagctgccagtcttttggttgttcaaaaaggcctggcctggacagtgagaactctttttccggattggttccatcagtgctttgtccctgacgtcaggaagtaccttgtcagtaagggattgccttttagtattttttctactggacaatgcacctagccacccagaatctcatgagttcttcaaaactgaaggtgttgaagtggtatccttgaccttaaagtgtttttaattcagcctgtagatggggaaggtggggggtcaataaggacctttaaggctctttaaacgcagcagtagtaatctatggaaaagattgtcattgctatggaagagaacctcaatagagggaacatgatgaaagtctggaagggttacaccattgaagatgccatcattgttaaaaagccataaaagccatctagcctgaaatgatacattattgctgtagaaaactgtgtccagatgttgtacatgacttcccaagatttacaacagagccagtcagaatcacgaaagactgtggtaaagtgaggagtgaagggtttcaggatatggatcttgaagaaattcaagagctaatggacatcacaccggaagatgacttgatggagatgagcgcttctgaaccagtgacagatgatgaggaagatgtagaagaagcagtgccaaaaaccaagttgacattagagaatctggcaggaggtttctgatactcaagaatgctttgacttttacgacatggactgttttatgatgtgggcactgaaacttaaaacaaacagtggcaaaagatttgggaacagatagaaacatttttagaggaatgaaaaagcagaaaagtcaggcaaattacaatgtgtttttgtgaagttacagagtatggctccctctcctgcctccctttctacctctccctcctccatctcttgtgcctgtgccacccctaagacaccaactacttctcttcctcctacacctcagcctactgaatgtgaagaccagaaggatggggacctttatgacaatccacttccacttattgaataccaaatacattttctttttcttacaatgttcttaatattttttctctttattctaagaatacggtgtgtaatacatgtaacatacaaaacaggtgttaatagactgtttatgttattggtaaagctttgggtcgacagtaagctattagtagttgggggacttaaaagttatacacagtattttgactgctcaggaggtcagtttttcctaactctcacatggttcagtggtcagctgtattcgggatgaaaaaatgggaacatatttgagaaataccttggggttaatgtcagtagtacttgatgattggataagaaggagatgagagataagaaaaaatataaggcttatgtttctagcttgtataattaggtagtttatattgccacaactgaattagagattacaggaagaaggtttgggcaggtttggatggtgagttgtcagggatttttgacatgataagtttgatctgtgtctggagcttttgattggagatgtgtagcaggtggttgaaacaagagttttagactttgtggggaagatctgggcaggcagtatagatttgggagccactaatgtaaatgccagtacagaagtccccaccccatccacagggaatctgtttattccaagacccccagtggatacttgaaaccatatagccctgagccctatatgtactgttttttcctatgacgtttaatttacaatttagaaacaataagagattagcaacaacaataataaagtaaaacaattataactatattgtaataaaagaacatgaatgtggtctctcaaaatatcttgtactgtacttaacccttgtgatggtatgagatgatacactgcctatgtgatgagatgaagtaaggtgaatgatagtggccatacttctgtagttttgagttgcgacagcaaaactagtgcagattctttttccttctccacagtttcgtggatagaagaagatgtgttcttttcttttctgagacagagtcttgctctgttgcccaggctggagcacagtgccacaatgtcagctcagtgcagcctccacctgggttcaagtgattcttgtgccctagcctcccaagtagctgagattacaggtgtgtgccactgcactcatctaatttttatatttttagtagagatggagtttcatcatgttggccaggctggtcttgaacttgtggcctcaagtgaactgtccacctgggcctcccaaagtgctgggattacaggtgtgagccaccaccctggcgagaagatttattcttaacatagatcttagcaatctcagcatacctttttttttccttattaagtagagaactttcaccttttcacttaaaggaagcactttattgcttctctttggcatttctgaattgtcagcatcactacttttgtggtttggggacagtattaagtaagataaacattgcctggacataagcattgtgattttgatctgataaaccagatggctgttaagttaccaagtttttaatgggtgtggggtgtgtaacatagtgtggaaatgctggacaaagatgtaattcaggattcacatcctgagtgggatggcatgagatttcatcatactacataaaatggcatgcaatttaaagtttatgaattgatatttctggaattttttatttaatattttcaggcagtggttggttgctagtaacttaaaccaaggaaggtgaaactgtagataggaggactgttgtagtttatcttctttaagatatggacaaacttaggaaatctgatagaaattagggacctactctccagaaaagaagtgcacacacagtatacttggaaagttttgtttattgttttaggaacctctggaatccctcttaagttttagaaccctgcatgtacggataatagatgtaaccatgacaatgaatgaaaatacatagagacccagtagagagtgacaagagccaaggacagagttctcagggtgaaaatgatttaaatggctctggaaaagtagtatacaagagatgtaggggaataatgttttctaaaagaaagctacgttatactgaggtgcatttatcatagtgttattcttaaggtgcctttgttttagctcatatctgtatatttgctaagcttgaaaaagctatatttctttctgacatttatttgatgactgtcgatgagcgttcaagagattctatcattgggcactttcctttgttgatgcatgagggattatactgtgctctgggctgtgttaaatctactgacgttctcatttaatcttcatgacagccctttgagatagatgctgttattgaacccaggacttaattttctcaaggtcacatggcttgtgagtaacaaagctgtggcacaaacctaaggctgtctgacagcaaaacccatgttctctaccagtatactaactatgtttaccaagataatcagtgactgtgatgttactttaccatattagcacaatggaatgtgacattagtccactgatttggactaggttttgggatatataagttctaatcccagctctatgattttgggtaagtcatttaatctctctgggtctatttttcattgtcgtcgtctttttttttttttttttgagacaaagtcttgctctgttgcctaggctggagtgggctggcgcgatctcggcttacttcagcctctacctcccgggttcaagcgattttcctgccttagcttcccctgtagctgggattacaggcacgcaccaccacatccggctattttttgtatttttagtagggttggggtttcaccatgttggctaggctggtctcgaactcccaacctcaagtgatctgtccaccttggcttcccaaagtggtgggattacaggcgggagccactgtgcctggctcttcttctcatttgttagaaaaatttttaaccttagctatcaccagaaggaacattttttcctgcagccccatcttttatctatcaataaggcatgaatttaaaaagaaaaaaaaaacgcactacatacaaccttgtgtagtaaaacagctcttgatgtatatatgtgaaaatggttatgttataataatgtgagagtacttttacaatgtttgaagcctcttggttttatagttttaaaattcttcagcttctagtagaaaaatttagtaatttactctgggtagagacattttaatactttttctggctttcagaggatcttaggttatagagcctgtaaagatgatttgatgttttgctcagctattagcagtataggtatctttgaggcttatagttgacattaacttttctcttttttgaaattgttctgagtattttgctttatctatttgttactcaatgtcaagagatagtgtcttagtttgctttattagaacctcagcatatgtagtcaacaaactaaaaccacattgcacgtacatagctatggtatttgaggccatcattattacatggccttgaatcttctgtttgtgaaaagttagccgcatcagtacattttatatggatgacatcctatcaggatatctgattaaaaagaggtagcagtataggtgtaggggtaaattcttttacagtcatttgataaaagtctctgacagacttaggtcttggataggatttcggtaaaagaaaagaaattgttctgttaaagttccttctcaagctcttcagaaaagatcagaataacaagattcagtttgagtcatttgcttaaggatcgtcttgattgagagttgagctggtattttactgccagggtgactaaaataactattttgcctactccttcctcttttcacattcatacacatcagacgtgacttggagaggattccactaactcagtaatttttatccagttcagatcagaagtttgtgtgaagctgatcaatgttgcttaggttgtaaatgcagaacttggagattttatgtggcatttacaaaggggtcattagtcatatattagcagaaaatcagtcaccgaagtatgaatccttgttatgtgccatatactgttttagaggctgaggaatttggcagtgaaaaaaagatccctgccttcatgaagctgacatttggttgtagagagggggaccaggaaaataatgaagaatgtgggtcggagttggggatcagtagtgaggtgaggctgttactgtaaataaggtgggcatttaaaacttcactgtaagatgacagttgagtagaggtttgagccatgcaggaaactgagggaagaacatttcaggcagaaagaatagcaaatacgaagacactgaaatcagcttgtttgatgtatgccagggagtgcatggagcagagcgaacaaaaggaaaaaatggatgaagttgagagattatcagatcgaataaagcttatagaacattgtaaggactttgacttcaactccaggggaaatgagaactcatttgagagttgtgagcaaatgagtgacatgatttgatttatgcttttacatggtcaccctggttgcctgatgatagcaggccaggagtggagatggagaccagttggaggtggtggtggttttaccaggatagtagcagtggaagtggtgagaaagagttgaattctggggatacattttgaagttagagacaacagcattttctgttggagtagtagtggggtcagagagtagttaattatgatcacaagcattttggccggagcagctggaaggatggagtggacatttgttcagctggaaaagacttcaggggaaaccaactgagggaaaagatgaggagttctgtttcaggcttggtaagtttgagatgcctactacgcattaaagtggaaacattgagtaggtagctggatatatgactctggcatgtacagagggggccagagaatgtatcaattttaagattgatttaaaaccatgagaatagatcaactccacctagaaaatgagtgtgactaaaaaaaaacaaaaaacaaaaactgagtgtggctagataagaaatcgagaacttgagctttaggattggaggtttaggtgataattaagagccagtaaaacagatgaataggagacagaagtagaagaaaaacaagagattgtagtgcttggaagttaagtgaggaatttgtttcttttttttcttcttcttttttgagacagggtcttgctctgtcatccaggctggtgtgtagtggcgcagtctccactcactgcagcctcgacctcccgggctcaagcgatcctcccgcctcagccccactaaggagctgggactacaggtgcatgccaccatgcccgactaatttttgtatttttagtagagatgggtttttgccatattgcccaacctggtcttgaaaccctggactcaagtgatcctcccgctttgactttccaaagtgctgggattatgggtgtgaggcaccatgccttgccaaatttgtttcaaggagtaggagtgatcagctctttcaaatgctgctggataggtaagtaagaggagaactgagactttgcccattagattttggcaatatagaagtcactggtggccttctcaagagtagttgcagtgaaatggtagagatgaaagccctactggagtagattcaagatataatggaaagatggaacttggagacagtgcatgtacaatctcctcttcttgcctgtgattttgccataaatggaaagagagattagatggtgctgaaggaatatatgggtttgtgaggatttgtttttgacataggaaactgacatttttttttttttttttttttgagacacaatcttgctctgtcacctaggctggagtgcagtgttgtgatcttggatccctgcaaactctgcctccgggctcaagtgattctcctccctcagcctcccgggtagctgggactataggcatgcgccaccacgctcagctaattcttaaaaaatttttttgtagagacagggtctcactgtattgcccaggctggtctcaaactcctaagctccagtgatccttctgcctcagtctcccaaaatgctaggtaggattacaggcatgagccagtccatgtggtgaaactgacagttttcagtatgaatggaaattatctaccagaggaaaaattttgatgatgcttagatgtgtgattactaaggggaggagttttctttctttttttttttgagacagagtcttgctctgttgcccaggctggagtgcagtggcgggatcttggctcactgcaagctctgcctcccgggctcacaccattctcctgccacagcctcccaagtagctgggactacaggcgcccaccaccacgcctggctaatcttttttttgtatatttagtagagacggggtttcaccgtattagccaggatggtctcgatctcctgacctcatgatccgcccgcctcggcctcccatagtgctgggattccagacgtgagccactgcgcccagccaagggaggccttttcaataggtggtttggcatagaactagagatttacttgtcaaatttcattctgtataatattacattgggttcttgttaaaatgtcgattctgtttctgtaggtctggagtagggcccgaaattctgcacttctaacaagttcctaggtgttgcttatgtgtctggtccttatgctatacttcgagtacaataacttggcactttgagcacaagaacctagcaggttttattggcataaaatcaggtcggttggtgtgtgaatatgatgggaatttgtatagtgtctcatcgggttgtttttattttctcagtggaataggaagcagtcataatcatagagtgaggatggaggaggtggtataaaatcatctagaagagtagagtgagtagactgactagtggaattgtggggttgcatgaaggctgcacttaacgttagtggttatgaatttaaactcagatggaccaaaaatatgggcatatgttattctttgttttctttcagctatacggatatatgtcaggagtatgtgggctgttgggatttaacttggcaagtattttggtgggagagagataaggggtaagtgacttacgggtatataaatcattatgattttatttaaagtgaagagttctgctccaggtaagattggagggaggtcttaaaagatgagaaagtgcttctaacagatctagaacctatttttaaatgtatcctttttttccccctgttaaaataggttgttaatgttcttatgtgtcatagatttataatcatatctatataatacaatatttactatatatggacaaatatagaaagactttcaaccattggttttttttttttttttttttttttttgtctcttctctctcttggatattacagatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtatcaaactttaaaggactgttgctaatactatattgaatgtagaaaatcctttataccatattgcactttgaccggaagtgttctttttaaaggtgccagaagcctatagaaattactaattcgtgactgttataagcactcatgaaaaatttataatcagctaaatcgaaaatttggatatttgagagatgaagtttgtgagctataataaatgctttctttaaatcataatgaagcaaactcagtaattcacaaatgcttattaatatgttaattacaaggaatttttttccttaaaatgatttaatcagcccatttttactttctcatttttctgtatatttgaaaacaataaaactacgttgtttaaaatatatttctaagatggatcactaactaaaattgactttattttaactgagttctgtggtacatttgaattttttttaaagataaattattgttgggctgttcacattattaaaaatggttctctgatttcagaaagatgtatttttttagaacaaatgtttttatagagtgaactcttccaatgcatgtaaaatgtaatttcatttagaaaataaattttattacaatgccttgctttaagattgtcaaataaaatgtgaaataccacacagactgataaaaacttctcatagtctttatgtggtattggggtatttattttttaagttttattttgaaaaaaaagtttcatgaatagcacgatgtgaactcttgtgtacccttcacctagattcaccagttgtttacattttgctacattttttttgccagtttttctattgatatgtgttataattactgttaccaatattattattgctgaaccattagagagtaagttttagatttcatctaccccaaaagactttgcaacatttcttttaagaataaagaaatcttacttaaccaaagaacaatgatcaaaatcaggcagtttaacaatataatactgttgcctaatacattccttattcagatttcaccaattgtcctgtttagtggtgatttcctttatagcaatttgttttctgatccaggatccagtccaggatctcatgttcagttcctcagcctttctttgtctttcagcacattgacatatttgaagagtataggtcagttgttttgtagattatccctcagtttttggtgtgtctgattgtttcctcatgactagtttcaggttatgcatttttggcaggaataatacataagtgatgttgtgtcctcagtgcatcacatcaggaggcacttgatgtcagtttatcccattattggtgatgttaactttgatcattggtgtccgccagatttctccactgtaaaggtaccttttttccctttgtaattcataagtaatctgttcagatatattttgacactgtatgaatatcctgttccctagaaactttcatgtgatggttttagcatccattgatgattcttgcatgaatcattattactatggtggttccagaacagtaattttctatttctgctctttcttctgtaatttctttctcttaaagggaattacatgagccacgcagttagtatcttatgaagcaaggtgattgtgtttttcacacaatcagcagttttttattaagtgcctattatgcacagctttcagtcataatgtagtggatgcaaagagataagatactatcctttcctggggtttttattgtgatgtgagagatggatgatacacacatttagataaccgtgtgaggcattatataattaagtggcaagtgagttgcataggcaataaatggcttaagaattcaaacggaggagaggttgccttgggatgtaagattttatgggaaagaatgaaattgaattgagccttgaaaaatatttgggatatatatgaacagtgtggtggaaggcattccatgatggcagatgttgtgaaattatatagagatgaactggttggttaaacttaggtggtaagtagagtttgactgaggcatataataattacagggattagtggattgtagtgttacaaagatggtttgggaacagattgtagaaaaatttgggtgccagactaagtaatttggactaaactgtagacagttattggaggtttttaagtgggtgaaaatgtgacagaatatttgaagatgtgattttaagtgggtgattatgtggcagcatattatgaggatgctataaatgtaaaattgagaggaggtttataaaatcaggagaagacctggaaagatctgggtaaagtgataggctagaaatgaatggatgatgtcagaaattctaaacttaagtctagacaaagattgcttactgggagaattatagtgccaccaattgcaaatactgtgaagtaatagtgggaaactgatttgaaatgggtagagaatatgataagttttgtttagattatattgaaaatgtttatccttggaagataccttagaaatcattttgcatgtgaggaaaattgagtgtgagatcatagtaagatgcccaagtagagatatcgtatgtttggagacacatagatttagagcttgggcaggaactcaaaattagatgtggagatttggcatttggtaacgtatactgaggaacaagtgttggagttcagaaaatgaagagcccagagccaagggatgaatcttaggagcaaactatagtaagtaggtgtgggaaatggaaaagaccaatttaagaaatttggcatcaaaaggacaagtggaagagttttgtttaaagctgctgaaggagagaagattggaacagctgagttattggatatagagagtatgggattaagaacaatggaaaagaagtaaacttggaagaggggcatgttctcattcgtcagaggttctatagggaatgataattaacacaattaacttttatttagcatttactgtgtgctaggcccagttctagtgcttttacatgttttaacttagctaacagtcacagcccaatgttgcagatactactattatgtctgttttacaaatgaagaaaccaaggcacagataattggtcatttgtccaggtccatatagctgttaagtggcctagccggaactgaattcaggcaatgtggctttagtctgagcccttgaattctctgtagatctgctcctaaggtagaatgatcaagttgtagtatgctgaaattcagtgtaaggggcttcaagttaatggacttactgtctgtaaacctccagtcctttaaattctaggaatcctttaaatttacttaataatggagttggaaataatatccctgagattctttatttctaaaattattatgaatctaataaaccatccatcttctgaaaacgagacgaagagacttggagtagcctttgtaagggatatactaaggaattggcaagtgcagaagaagatagcttcataggagttggcctgaatgtgtgctatgtcagtttttttaaaccttgggcacaggtgcagaaaaaaacataagtagttgtgtgttagggttgagaagtggctcgtccaaagagtgaggagaagagagaaggccagagtgtgagatcagtgtttcggtgaccaagttttgggctccagtatggtcaattggatgttgaagatatggtccagtagatattgaagttacgtgagcagtcactccatgagaactctgagtttcagtatattataagttgcttaaagtggtcccatatttaaggttaactgttgtcttcctcatcttaagctactgtaacaaatcccataaaccaggtggcttaaacaaatatttctcaccattctggcaagtgagaagtccaagatcaaggtgcttgcaggttcatttttctggtgagagtccccttcctggtctatagacaaccacctccttgctgtgtcttcacagggcagggagggagagaggtcatgtctctcatgtatcttataatggttccatcctgttaatgagggtaccattctcaagatttaattgcctcccaaaggccccacctctaaatactatcacatttgggattagggtttcataatatgaatttgaataacacaaacattcagtccataacaattatcatttcagaatataggcagtttttataatatattcccccaaaacatgcattcaagttgattgtactaaataaattttaaaatatacagtatatgctaaattcttaaatttactttccttatacatagtcattaatgatcattgccggcatctgaaaatgttcttttatttattcttttctttcacgctcatttgaccagtcaatttttgactaggaaatgtagcaatttcagcatgtctgttcattgattatttacagtgaattaggttttgaagcctctgctagtttctgtgcttttgttttcatgtttactcctattttataaaacaattttaataatcatataaacacagtactactgtattgaaggggacactatcgaaagaactattaactgataggtaggaccatctgacatgtttgtttcctaaggtaggacctctgacatgtttgtttcctaaggtagtaagtctcagtttgttctactaaatgagacttagagatgttactgatacaatgtgcaaaagcatagtttgcatgaaaatcagtactgcctatctctgcattgcatcttttgactagaaggtgagatattctttcagggttctgtggtatcagaatacctatctttaatctcacagaatatacctttttttgttgttctgaaagcattactgtttggtctgctcatcagtttttaattcacaatgcttttggcagttagctgaactgcctgacgaaccatatatttatttattttaaagcaaagtgcttttagtgctatggtatacatagccaagacccatcttttcacattgaagaattccaaggaaatataatttttacatggattgagggctggtttgttatatagtttgttggtactttgatttcaaggtgaggatagtgaacaaagtcaaacattttggtaaagtagcgcaacacagactaccagacagcagatgacgggaggcttcagagaggacatctctttgggattgttgtagctgattgttggctttcaaaataagttcacaaaattgaagcaggcatagaaaatataagtactgtttctctaataaaagcacttctggtaggatattatttttcttgtctctggaagaatgtttcctttgaggaaactgacacccataggaatttagttcatttctcaagaccacaaggcaaaatttagggtgtaatgtggcctttgtacctcaccataagaaaaatcttggtttagaaaatgaaaacatttcaacttacacaggaatttgttttttaactttttttctaaataaaaaagcatagtaatggaggaaaaaagttctgcttttcagatttaaagacgtttagaatatatattattttgtcaaagtgtcaaaggtatcctgtaagacttttcccatcacagaattcagcattcaaaactgtttgccaggctctgtgctaggtgtaaggaatatattggtaaatagaatacatctgattcctgcacttatgaaacagatagtaaacaggtaaacaagtatttagttataaaatataatcaagaaaggacacagtgatagaggaaaaaatgataaagacaaccacataggtcaagaaagggctgtttgaggaagtgatagtgtttaaactgggattagaagaataagcgctcacaagaaaagtgggttgaagagtattctaggcaaagtgaatggctgtacaatatttttttctgtaaaggaccagatagtcagtatttttgtttttctgagccatacattctcaggcacagctcctcagagtctgtttttgtagcacaaaagcagcaacagaccaaatgtaaatgaatgaacatggcagtattccagtaaaactttactttaaaaaggcagcaggctgagtgcagtggctcacgcctataatcctagcactttgggagactgaggtggcaggaacacctgaggccagcagttttgagaccagcctgagcaacatagtgagaccttgtctctacaaaaaaaaaaaaaaaaattgaccaggcgtggtggctcacacctgtaatcccagcactttgggaggcccaggtgggcagatcacgaggtcaggagatcgagaccatcctggctaacacggtgaaaccacatgtctcctaaaaatacaaaaaatgagccggacgtggtggcgggcacctgtagtcccagctacacaggaggctgaggcaggagaatggtgtgaacccaggaggcagagcttgcagtgagccgtgatcacaccactgcactccagcctgggcgacagagtgagactccgtctcaaaaaaaaaaaaaaaaaattgccgggcttggtggcacacacctgtagtcacagtcgctcaggaggctgaggcccaggagtttgaggctgcagtgagctgttactgaactactgcactgcagcctgggcaacagagcgattaaaaaaaaaaaaaaagctggaggctattctttgccacttcctaaagacattgaataaaatcccatcataagtagggagctaagacttggtaatggagaggaatgggacaagatggggttgcagagagaagcagaagccagatcatatcatgccagaccttgaagccatggcagaaggctttgtaattaattatatgtacgttaggaagccatttaaggattttaagcaagataaataagttagagagcataagagttgaaataaggggaccaggaaggagtaatccagaaattcaggtgaataacagtgatgatttacactagtgtagtgacagttaagattgagaaaagttttaaaatacaagatatattttggatgtagaaagaacgttacctgctagcagattgtttgtagggaataagaaacggacaaatctaagatcagttttaagtttttggctcttggctaggctaggtgatttaattttctgatacggtggggcagacaaaggagctccattttgaacaggttagttttaagatacctgtaaaatttgatatgcaaatcaaattatccgagaagtttgaactggagatgtgtatttgggaattgtgaacatatagatggtacaggttgaacatccctaatccaaaaattcagaatgctccaaaatccacaactttttgagcgccaacatgatgccacagtggaaaattccacagcttatctcatgtgatggagtcacagtcacagcacagccaaaactttatttcacagacaaaattactaaaatataacattaccctcaggctatgtgtataaggtgtatatgaaacaaataaatttcatgtttacacttggattccatccccaagatctctcattatgtatatgcaaatactcaaatctgaaaattgaaacacttcgggtccccatgcatttagggtgaggagtacccaacctgtatttaaagccctggaagtaaatgaagtcacagagacaagagaaaagagggcccaggattgcaccctgaggaatttaaacacttcgtgttcagatacattgaggattgcagtggagactgaaaagttgccagttagtggtacttaagacttagctctaatcttacattataagataataatatttgacaggtatttagcagagttacagtttttcacagccattttgcgtgtgtgtgtgtgcgtgtgtgtgtgtgtgcacgcatatatgtgtatatgtaagtcagatactaaagcacggttttaaatttagaaatagtaataattagttttgctacttttgggcatgttaagggtggagccatcttctttcattctcctttcataaggttcctatttgggattcaaacttgacagtttttaagcttgttgtagagtaacaaaggacttgccttttcttcttctaactcctgttgagcactttaatagtaagaaataacctagatgcagctgcagtgggaaaagtaataggtagaaaatagaactgagcattggtacttaattctctcactaataatcttgaacaaattactaaacctttctgggatttaaagtattaatctataaaatgagtttggagttggtcgttttagcccaaagaactttaaaaattatgattatgtgtcttgataagtttaggttattaagacttaggaagataatagtctctaagactgtttattcctgtgccatgtgttttgaataaaaatgtttcaatttttttttttttttttaatttattttccgagacaaggtcttgctgtcgcccaggctggagtgcagttggcgccatcttggctcactgcaatctccaccttgtagtttcaagcaaatctcgtgcctcagccttccgagtagctgggattacaggcgtgtgccaccatgctcggccaatctttgtatttttagtaaatatggtgttttgccatgttgtccatgctggttttgaactcctagtagcatcaatgatccacccgccttggcctcccaaagtgttgggattacaggcgtgagccacagcgtccagcttttttgttgttgttgttgttgttgttttttggagaccaggccttattgtgtttcccaggctggagtacgttggcacaatctcggttcactgcattctccgcctcccaggctgtggtgattctctcacttcagcctcctacatagctgggctaccggcacgtgccaccatgcctggctaaatttttgtatatttttttgtagaaacaaggtttccaccatgttgcccaggctggtctcgaactccagggctcaagtgatccatccgcctcccaaagtgctgggactacaggcgtgagccattgtgcctggcctcaatttttaattttcttgaagtcaggggagaaactttagttttaatatgggaagagctttattatctcaattttgtaatgcttagcagttttcttagatttaccttatgcttaatttcttcatctttaatactccatagtaataatcaaataacatggtaacctcataaatgaacctataaaaattattgaactttgaaagttggtttcttagaaaaatagctgaacaaaaaaaagttaacatttaaaattaacttatctttttagttattattggaaagaacatttattctagtggttttcaaagtttttctatccgtatgtcctattcttcaaataatatcttactccgattgaatgggaggaagccagaataagaggagcttcatcctgctcacctttcctttattcagaaaaccgcctgttgagcaaggcactggtgtgagcatttgtactatatcaaggaaagattcctgcctttgtggaagttacgttttagacttacatacttggatctacgctttgtagtcataatctgttctaagcacttttgttttaccagtggggaaattgcagccttgaaggggacatggtttcaagtttcaagtgactttcttttttgaatttctttgtaaactgcaatgtctttttgtagaacaaataattcctcaccatttatcttttgtacctagggtcttatttgctgaaaatgctgtctctgtgtgaactactttttcaatatatttttctccctatttctagatggggaagaagaaccagttttaaattttatatttgtttgtaagtaagttaagatatttatgtgaacatgaagttggtaactttaaggtaaactgtggactcttctttatgtcaattaaacagacttccttttataataaagcttttggagtgcttttccctttctaggcaaatattaattaatctaatggaaaacattaaaattaatgtttttaatggcatatatatatacaatatataatgactgcagtgagttaagaatattgatagaaacacttgggaataagattttccttagcaaattcagattcatttcagaggcccacagagattgagtttctcctatgtttcagccacccaaaaataaataagacatgattcttgccagcaagaatcccataattttagcgaggtaatcagatttgagggggagttactttgcctgaggaattcagggcaaggtagaaagaggaggtcacttttgattatacttaaagcattactcaagattcatcatgtgagcaaagccaaaatactgtcccggtagataacaaggagagaaagttgaatgagaaaaatggcaggtaggtatgagcgtagtgagatagatcagtatagatggaaggtgaacatgttgttcataaggatgaacaaaagcatcttcgaatgtttttgtaggaaatgaggatagtaaagtgggttgggctagattttgaaaaccattgtaggggatttgagtgtttttctgttggtggtgggagccattgctttttaatccttagaaaggctgactgcagtggagaagatgtagtcaggcatttaggatgagtgccattttcagttccttgttgctgcttgctcatctttagttttcatgctatcttgtcttgatgtttaacttaaaagttgctggaagtactcaacccattatgctttttgggatggtggtgacaggagtgagaagagactgtgagctaggtgtgaaaactgttaatgggtatgatatggggatagtgacctaaatataaatagcataatcccaaaagagacagagacttgtcggggatagtgtgtggaaaagggattattagagagtcaggaaaacagcaaccgtgggatatgaaggacattggaaattgaatggtttctacattgaaagggatggaagagaaatgatgttaggggagaggaggcttaaaagtgttgttttaacaagtttgcccatgttaagtatcagctattctgcttaagttgttaggtagactgtactttgagggcaagtacccgccccccatcctatttctgttgtattttttagtgatattcttctgttactaagtgaataaatgaaggaggacctgttcatttatctttgtgtctcctctttgcatgtggttggcactcagttgtctgttgaaatgaatctttgagaatactaccagcagtcaaaatggaaaccaccttggttcatagccacaaatagctgagatccattttttttttctctgtgtggggtaatacctctccctactcgagttaattactaaatctgacaaccatttaaaaacacaggtgattatcgggctatatgcttctgtttttttgagattgaagtctgtctgtcggcttagaaccagatcatgttatcttgagaaaccatggtggttttttccatcgtactcgagaacaaaaatactggtagctatgttgtcatgctttgtgtatgttttcctgattaattctgtcagtgtgcctgttactaagtttaaccatgatactaatgctataataatagcttttaatgtatatcttaaccattgggaatagtatactttacaaacgataagtcatagtggtgtttttctgtggtgtactgtcatttttctttctgcattcctttccaaccagtaagtaaaaagctatcatttttcatagtagtattttgtactgattgagaaatcctgatttttctaagtcatactattttaagaccagtttaaaagcatatttgaactaagaatgccttttttaaaaatgtcaaattttatgtgatttttaaaatagtatttgcttcaacacgtagcaaattatctttatgtatgaaattgtgaaagtgtattgtcctaacacctgttctgtgttccttctttgaactttgtaacttttccgtagtgctatttattgtattctactttgtattgaggtcatttgaatgctaatattaggctcccccttctcccctctccctcagagattataaagtggctgaaagtgtcttgtatcccccatagtgccaagcaccctgttttgcctgctggaagcaaacataaatacatgaattgtcagtctggggaaatactttgtatacttttgaatgagtggttgatatctgataataggacctgatttctttaagagcttcattttggacacttaaagcaaagagtaagaatggggaatatttccactgagaatgaatttgattttgaaattgagaatagtgtgctttttgtgaaatgctgttaagttacattactatgtacgttagaaaattacttaatgaggaatcttctggcagcaatggagaaaattttttccctacagtggctatcttactgtttttttaaggatactggtataatttttctgatcactattgccatcttaattattaaagttaattaaaaataatgagaataacacagtctactgtatgaaaaggatagtgaattttatattattcaggaatctcatcattagttaattcttggaaagtttaaaatacctacaaaacttaaaattaattatcttggccttagtagaagcttgtttgagatacagaaatcttaagattgctatatgtattataacagcaacatctgttaaccaaatttatattagttgtacaaataattggagtttgactgcattaagaattcctcaaaatatgaggtaagagttccttccagtcattcagaaattctatcctttagaggaaaggaaagcaagtgtccttattcctgacctgcccctatttttgtatatgacttctgtaaaaatagcagaacattgcagtgtttctttttaaccttttagatcaggaattctcagggtgagggaaagagccatgaagcttttttctcaaacagttctgtcagctgtcctctataccttatggcttgtctcccattgggattcactttatctagtaagccacttttattgataggtttgtgtcataccactgtggtatgataaggtggaaaaattttgaaatctttaagaattatttaatggcattccttggaagactaaaattcatgtaactggcaaaatttataaagtgacaaacccctagaccacatgtgattaatgcaggactgaaaaaagtatgttttaagtggaaatttaaatgctatttttatttttattttttaactttttttgtatatgtaagaatgtttttgtaacattacttataatggtaaaaaactaaaagcaacttatccatcgttaataaagtgattgaagaagttatggcattaagtgctatttttgtaggtcatagtaaatgttgcatgcttttgtattatgctgtctttaacagatgaaacaggcaacatgttttggaatttagagccagaaagatagcaggcatccagtggctgtcaattattttaaaatagaagccccaatttaaaaaatcatacaaaactattataaatcatatttaataaggggaaatgaagtcttttctgcagtggtgctaagtaaggcattgcagtggaacatgatgtcattgatctaatcaaccatagtcacatcacaggtaaagaggtgctacagactagataggttaggtgacttgctcagagcccttagttagtgacttccctgggcagttgtctgcaaagaggttgagtatccctaatccaaaaatccaaaatctgaaacttttttctttttttttttgaaatgggaggggtctcactctgtcaccctagctggagtgtagtggcatgatctcggctcactgcagcttccacctcctgggcttaagtgatcctcccacctcagcctcctgaatagctgggactacaggcacacaccaccacccccagctaattgtttatatttttggtggagatgaggttttgccatgttgtccaggctggtcttgaattcctgagctcaagccattgtgcccacgtcaacctcacagagtgctgggattataggcattgagccgccacaccaggccaaaatccgaaactttttgagtgctgagatgatgctttaaggaaatgctcattggagcatctcagattttggattttcggattaaggatgcttacctggtaagtattatattccaaaatctgaaaaaaccgaaaatctgaaaaaatcaaaaatctgaaacacgagtggcctccaagtgttttggataagtgatattcaaccttagcagatttttattatcttagcttctgggtgaatgttaaaatactatagatttatagaatgacatacctttgagttattgtacctctgtgatactttttaatgtcctggtataattaggatgtgctccatgttattatgtctcattttatgtttttaatacatgattagtatttttttgatggacagtaatgccaagtataaatttctgtactttggggatttgtctatatttggacctaatgttgtcctgaatttggagacttgtttaccaaggaagtcctcaattttcagtattccatatcatcattgattatgtgactctgttttagtttcaatgaactttagaattaaagtttttaatttgttttagctgatgatttctttgttttacctagacatttaattaggattggctggctgggattttgccccaggcattgaaatgtagagtgtgaaaaaattttaattaatgattaaaaacaattatgtgtgttgtggggtatgggagaactgtgcacattatgtccttcagctctccagctagcccaagagctgctggcccagtattgcttccttgtcaatccatggagatatttgggaatgaaaactcaagggcaaagtttggaagcctgtagctcctggtcattcctgctgttgtctcctgtcatcctcctttccagctccttttgtttctctttaccagtaatttgactgacttgaggatgtgtatattgcagcttggacattaatttatcattaagcaggttttattatacagttgaaaaataggccagacacggtgactcatgcgtataatcccaacactttgggaggccaacgtggaaggatcactttgaggccaggacttcgagaccagcttgggcaaaacagtaagaccccttacctacacacgcatgcgcgcgcgcacacacacacacacacgcacacgcacacagccagaagtgctggcacacacacacacatacacacacacacacacacacacaaaaagccagaagtgctggcgcgtgctgctgaagtcctagctacttgggaggctcaggtgggagcatcacttgtgcccaggagcttgaggctgcagtgagctataattgtgtcactgtactccagcctgggtgaaagagtgacaccctgtttcttaaaaaaagaaaaaggtttccttttgacagtaattccactttaatctttgctaaggatttaatttttaaaaatgcgagaaaagctatatccacagaaacaaagaatagtggtcaagtttgaattgttgcagagtggttcataaggttgatatactcaaattgtttaacaattctttcattgtttggaattaaaattgcttttatgaataaagcttgtggcatcatagcttatgtttatgataaaataataaggaaacagggcccaattttcaaataataattcaaatttttaaaaattagtgtataataaaattggcctttattttcatatatctctgaatttcagcacacataaagattcatgtaaccactgtcacacttgatatagaacagttgcttgaccccagtaaactccctctgttatccctttatagttctcttaacccctagttcctgacaaccactgatctgctatcttaacactatagttttggattttttttttcaagaatgtcatataattggaattatagtttgtaatcttttgagtctggtttctttcattcagcataattattttgagattgatccaaactattctatcaataatttgttcccttttatggctgatactctattgtatgaatgtaccacagtttgcttattcatttacctgtatacttgttgaaagacattttgtggttgtgagtagagctgctatgaacatttgtgtgtgatttttgtgtgaatgtaagttttcatttctctgttaaatacatagaagtagggttgctgggtcacgtgatgttatttaacttcctaagaactgccaaactgttttctggtaaggctgtaccattttgtttatggtagttctagttgttgcaaatctttgtcagcagttgatactgtcagcatcttttgttttagccattctgatgggtgtgtaggggtttctcatggttttaattagcttttccctaatgacttacattgttgaacatctgttcatgtacaaaattgccatctgtatatcctctttggtgaagtgtctgttcaagtcttttgctcatttttaaattatttgctgtcattgctaagttctaagagtttttttttttttaatatgttctggatacagtcatttggtttttctcctattctgtagcttctctctgttactgtctcagtggtgtctacagaacaaaagtttttaatttcagtagagtccagtttagcattttttcttttataaattatgcttttggtatcatttgcttaaaattatcagatgacattttcttcttacactttattgtaatctgacctttttctttggattactatggtgcattggacatgatatgatacagctaggtatttttcttctaaaccaaaggttaatattaaatgttaatcagtggcattaaaaaagcagggctcttctcactcataagtgggagctgaacattgagaacacgtggacacagaagagaacaacacacaccagggcctgttggaggatgggaggtgaggggagggaacttagaggatgagtcaataggtgcagcaaaccaccatggcacacatatacctatgtaacaaacctgcacgttctgcacgtggatcctgtgtgggtttttttgtttgttttttagaagaaaaaagcaggactcagaattgcataaatactattattacaataatataaaaacatactcatgttgaagaagttctgcaaagggaagagacagaaatggctagtgtgggagccagtggtttcctagtcctggatgttatatcagagtcacctgggtagatactttaaaattagggttgtcttttgatcttgtgtggtccccaaatatttcttcttctttcttctttctttcttcttcctccttcctcttccttcttccctccctcccttttttttttaaatataaagtttggtttttagagccgttttcagaataacaccaaaattcagtggagaggctggacacagtgtaatcccagcaccttgggaggccgaggcgagtggatcacttgaggtcaggagttcaggaccagcctggctaacaaggtgaaaccgttgtctctactaaaaatacaaaaattagccaggtgtggtggcgcacacctgtaatcccatctacttgtgaggctgagccagaataatggcttaaacctgggagacagaggttgcagtgagccaagattgcgccactggaccccagcctgggcaacagagcgatactccatctaaaaaaaaaaaaaaaggtggaggatggaaggtactaagatttcccaaatacacccctgccccaacatatgcacagcctcccccctgtatgcacatccacaccagagtggtacatttattacaattgatgaacctacattgacacgtcatcactccaagtccatagtttacatgagggctcacttttggaatgaactcagtctatggttttggacatatattcactagtatagtattgtacagaatagtttcactgccctgtgaatcctgtgctctgcctacttacatacctatttttttttttttgctctctctttagttttgccttttccagaatgtcatatagttggatcatacagtatatacccttttcagattagcttatttcactttgtaatatgcgtttaagttatctctatatctcttcatggcttaatagctcatttctttttagtgctgagtaatattccattttctaaatgtagtacaatttattaatccactcatctgcagaagaacgtcttggtttcttccaagttgtggcaattatgaatgaagttgctttaaacacttgtgtgtggggttttgtgtggacgtaagttttcagctcatttaagaaaaaactcaggagtgtgattgccagattatatggtaagagtatgtctggtttcgttagaaactgccaaactgccttccaaagtgactgtaccatgttacattcccactggcagtgtatgagatactcttttgctctgcgtccttgctagcatttggtattgtcaatgttttggccattctcaaaggtatgtaatggtatcagattggtgttttaatctgcagtgtcctaatgacctatgatctcctcaaatgcttacttgccatctgtatatcttctttggttaggtgtctgtcaagatcttttgcctttttaaaaattgagttactttctaagttttaagaattctttatatattttggataatagttctttattagctttgtcttttgcaaatactttctcccagtctgtggcttgttttctcattctcttcactgaagtcttatttatttttagagataggatcttgctgtgttgcccaggcttgcctcaaactcctgggatcaaacaatcctaccccctcagcctcgtgagtagctgagaccacggacacactactgcatcgtacttaaaatctgtttgtaaaagctcttcgggtgactctaattttctgcctgatttgtgatccactgtgttgagctttctctttcttcctttgcaaagctagtaccaggcacagccatcagttctccattacttgcacttcatcttttttgtcacagctggtcccatcctgctctcaatttctctggtgttgctacttgttcttccatgtctctcccctcaaattccaactctttatctgtgtaattttagtataggttttctttaattatctgttcatacttaatccataggctgttttggttctggtactacctgtacagcagggttccctcccatttgccttgctggtgcagaaagtaggtgattgtgttaggccatgagattaacaatgttatccctcccaccatatttcccatgcttgctttctttttcaatttttttataagatgttaataatttgtaaaataaagatccttttttcacttaatgtgtagtttatgtgccaacttaaccatctttttaaaagcctattttaatcttcataatcttcatctcattcctaccattttattgtgtatgtttgaataaataatctgttcactttcaactaattttctacagaaatgttggaggaaaaattttttgttcatagagtaatctgaataagaagacattgcagcagtgtatctaaggcattcattttacttctttcagtcatgagtttgtgtgtgtgtgtatgcataattgaaaaataaacaaaattagctcttaattgtagctattttctgctagtaaaattcaccgttattggtcaggataattttttgaggtatgatgcaaacaaggcaattatgacacattgtactaggagatcacgttttattttgctgaaaggcaggtataaatatgatgacaaatatgtaaatacttgatatatttttttataaaatgtacaaatcagtgatttgaaagaacatgccttattttgtaacattaactttttatttaattggtcaattttttattcattcaacaaatatgcaggcacatttacgtgttccaaattcagggtgattttaatgtagttaacatttaacttaattttataatatagcggtatgtagaagttcatataagtccttaagaataattaatgggcttgatattctgatgtttgaaatacgtattttttttgtatgtagcgtagattgctcttgcattgtcatgattttaatttaattgctactcttcagtaaaggaatatgaagcttggtgtaaaattttgaaaataagcacgttttcagcttgctgggtttttgttgggatttgtatctgacaagtgctagatttaatgagttgaaacaaatgatacattattcattttgtataagtatttccattaactaacttgatatagttaacatttttggaggaatttctgggtgatgtaacttgaagtcatggagcttagtcttgtgaacaaaagattaaatatatgataaaattctaaattatgtggtacaggcctagtgatttttatactgtatatttagtagactagatatattgtctcatcattaaatctaataacctcgttttccccaatatgtaggaaaagattctgttttcttagtttgaatttattcttccacagtgtgttgtgtgtattttctttggcacttttagccacttgttcatattagatctgatacagaatggcattttatttatgtgtatttataattgttttagaggtgtctatatatctcaacatacattaaatagttgatgtttctcagaaagcaccatgacttcagctttttcccaatctgaaaaagcataaccactattagaaattctctatggtaaaggatatttggagataaaaaagttttgtttagtgtagagttattgagagtttagctggattatggaaggttggttggatttgaataactgtagaagttggcagtatagtcccaaagtgttacaggaacttggagacaaacacacgacgactttgtgataaaacaagaaccagagtctagattctgtttctgagtgaaatggtctttcttttgggcagatagcatagcaggaaagagtagtggtcaataacattttatcagagaggatggtactaagcttgtggactgtggaaaggaatttttgaagtcttgaatagtcttttattagggttggattggaaagacatttcaggctcaagggaactttatgtgcaaaagcaggtaatcctgaaagtgcttatgttggaggtgaatcatggcattggagggcagggatatgaaataaatggtgttatatataccaagcactattctaggtgtgggatatacacatggaaaagatagaaatcctgccaccatggagacatttacattttagtggaagaaacaataaacaaataaactaatatagtaggtaatgatgaatgctatgacaaaaaaacaaattgtatggtgaagaagtagagctaggctttctttgaagtaattggttgggaaagacctctccagagatgaaatttgagcaaaataaagtgagtgggacgagccatgtgaattgaggcagaaggaatggcagagcacagttgctgtatttagtaaagaggccattgtagctgaagtgtactgagtagtttattatagagtgtttacggagtactaagcactgttttaagtgtattactagcgttaattcagttcttaaaacaatcctacaagaagaatgctatttcacatataaggaaactgaggcacagaggttaaatatttatcccaggtcacccagtttgttagggagctgggattggagcccaggtaattgactccaaaatcagtattctcaaccattattcaaagttggggaagggaaggtgtagtaggaaattcagcagtagcatgaagccagtcttacaggcccttgtaacttactataagaatataggattttactctgacaatgatgtcaagtcactggagggttgggaaatacctaggaagttgatttatgttctggagatcagaagaggagtctgtactatacatatacatttgatactcttctgtgtataggttatagcttaaaatatttctactagcctataacatttctttgatttaaattaaagattccacttcattattttattaaacagatatgtgcatgcctgtatatacgagtgtgtggatgtgtgtgtgcaaactaatgaactcttctgttactaggtgcgagaagatgtactaaattcattgaataacaactttcttcaaacgctaaatcaagcttggaatgatcatcaaacagctatggtgatgattagagacatactaatgtacatggtaagtagagctttttaaatgttttcttcctttaagcagttaagcatttgaaggctgggcacggtggctcacgcctgtaatcccagcactttgggaggccaaggtgggcatatcatttaaggtcaggacattgagaccagcctggccagcgtggcaaaaccctgtctctactaaaaatacaaaaattaggtgcagtggtgggcacctgtaatcccagctacttgggaggctgaggcaggagaatcgcttgaaccggggggtgagccaagatcgtgccactgcactctcacttgggcaacagagtgaaactccgtctcaaaaagaaattaaacatttcaaaacacaatgactttctgtctaacttagttatagtacgtctcagtgtggaaggtggtttttgttttttaaatgaacagtactttctttgtaagggccaaccgaagcctatgtgaataaaaatctttatttatttatttatttatttatttatttatttatttatttatttatttatttattttgagacggggtctcgctctgttccccaggctggagtgcagtggcatgatctcggctcactgcaagctctgcctcccgggttcacgccattctcctgccttagcctcctgatgagctgggactacaggtgcccgtcaccacgcccggctatttttatttttatttttattttatttttctttttagtagagacggggtttcaccacattagccaggatggtctctatctcctgacctggtgatctgcccacctcggcctcccaaagtgctgggattacaggcgtgagccactgtgcccggccatgaataaaaatcttaattgttcacatacttagtgaatgcttagaatgagaaactgaaagggaatgatttaatttttttcttagtatttagcacttgtcctttaaaatggaaaatatggaaaaaaccatattaacatctccttaagagttgttaaatgacaatgagaaacaaaagctgaatattctcttacaagtttttaaatccttaattcttacatcttcagtgagagaggatgtcatattaatacaattattttttctgataatcatacactcatagctgccatctatttttcttaatagtatattattgcagtgcaatattgcagctagtcttgtttaaggatattagcttcttcacatgtatattccatttttcaccggctattgctgtattttgttttcatcagtcaagaaaaaaatcctgttcagcaagatcatttggaaaacactgactttgatctcagctgtttaataactttcagagagattaaattccagttaaaaaaaatttggtgctatagaatgacgctagattcattaagtttaattactgtatcactccaaaattaataagttaatgacttgttttacatcagtgtttatgtttgtgtattggatataattatttttcccaaagttttacctttttatatttttgtttctagtttttttagttttaatgtagtgatgagagcttgtcctagtttcttttacttggtagaataaagcaatgtttgggaagaatttccaataagaacaaacagctgtaaagttttttgttctgctctgtgaattcagtcaggcctattacccctggttttgtaagggcttagtggcaagggggtcagggagaggccacttcacttttaagggatttgataaaaggtataacaaattatttagcttttctgagcattatttttctcatccggttataaattaaccttgtgttatcattttgaagttaaatgagatggtatgtgacaacatatattatctggcatataaatttgaaataagttagcttgttgttttcgaagttctagatatggtgagtctttaaatcgcatcctaactatctaacattaagatagaaaaccacttgtaatcttacggtttattcttttgacaaaagaagaactttaaaattttatacacacgcagactctgatgttatttttaaagtgtgttttgtttcagtcctcctcctccctttttttctttcttttttctttttttttgcaacaaaatctcaaaccttgaattctgactctacacatggtcaagaagttaattagttcacccctcaggttcctcatctataaaatgaaaataatattgggtagagtagtcatgaggcttcagtggaacaattcatgtaaaccacttgtagggcttggcccatagtaacatgctcattagagattaactggtattatttcttgtcccttcatcttttcatcaaacccattcggtagtaccacagtgctgcatgaactgaaaattcatacagggtagattgatgccactgtttcactgtttgtcgcatcacagacctgtggtcaacccttcacactgcccagcagtttcactctttttctttagtcagcttgctccagcagttatttctcttcagacctccatctctcccttgggtttcctcccttgtagtaaatgatcttactttctatttctcagagaaaagagaaagcatcaggtaggaactatgctcattttttgccgctaaatctagaactttacttgtattttctccccttttatgtttttctttttccctcctcttttagtggagggtggtgtcctcttctgtcaggccacatctcaacctgtgctatgggtcaatccctttctaccttgtcatgaaccttaagtattttagggttctacctttcatattggatcttactcaaccagcattaaacatgttcaagccactcactcaatcctcagaatacaattctgttaaattctctggtgaacccctgcactgtctcccaggatctgtcgtgtgtcattcataactaaatgtgttgtaagaaatgttgacatttgccatcttccttttctcatctttcatacactttgaatacattacagttaagcttctacctcaactattatgttaagttttgcccttactagtatcaccatggtatcttttcatctcagaatagagagactgctaatccccattctccttgatttttttttttttttaagcagcatttgccacagttggtcattccttcgttcttctaacatgtttccttgatttctgtaacaaagaactctctttgtatgcctcctacctaccttcttactgtttcttagcctctcctcctccttcaatgactactaactgcccccaccatccccccttaaatagaggcattcttggggtttagtcctagttgttcttctcatggtacactctcttcaccttatgtagcttcatgtgcctctgtgcagatgattcccaaattgtgtctctagcttcatttcctgagattcagactcatatatgcatttgtctagttaatggagccttcattctctgaagtacttcaaacttggcatgtccaaatgagctcataatcactatcattcagttgataatcactatcatactgaaacctgagaattattcttataagttctttttttctccctacatcatctgttgctagactctccagttttctctttattgtctgttactcaacatcaaaccaccttcatttctctcttgaaatattcagtgttgctagtcttacagtgttcactgggcacttctctgttttccatattgctcccaggattactattttaaagccaaatctgatcatgtcactgccctgttgaaatccttatctctcatcttggaattcttttacatatcttctgtctggaaatgtttctagaattttttttttctttaatgtcacttgctctacttattctttatgtcttaccttatatttctggtaagctttccctgacccacgtactccccactggctgcagttgctctcattgtacctagtactattcctttgcaacatttatcacagtcattaaccaactattcagtgtgtagtttgcccactggagtgtatgaggatggaaactgtttgtgtactattatgtctttaatacctaccacagctccttgtacaaactaggcacttacatatatctttaatgagttggtgcagagttatatagtatgtttttttttttaaataaactacactttttaaaaatgcttattaaaaatatgctattttaggccaggcacagtggctcacccctgtaattccagtacttggggaggcctaggtgggtggattacttgaggccaggaatttgagaccagcctggccagtgtggtgaaaccccatctctactaaaaacacaaaaaatttgctaggtgtggtggtgcgtgcctatgatgccagctactcggaggctgaggcaggagaattgcttgaacttgggaggcagaggttgcaggaagccaagatcatgccactgcactctagcctggatgacagagtaagactcttatctcaaaaaaaaaaaaaaaaggctattttaggttcaaaaagaaagtgttgataccttcatgttctacaagataaattttttaaattttcatatccttcatttacttacattgcctttttatgtgtagtgttctaggcttaattaaaatctacttaaaagtacatttttatggggtttttttgtttgtttggttttgttttttgagacagggtcttgctctgtcgcccaggctggagtccagtggtgctgtctttgctcactgcagcctccgcctcctgggttgaagtgatcctcctgcctcagcctcctgagtagttaggactacaggtgcatgccaccacacctggctaatttttgtatttttggtagagatggggtttcaccatgttggccaggctggtctcgaactcctgacctcaagtgatccacctgccttggccttctaaagtgctgggattatagacgtgagccaccacgcttacactggactgagagacatttgcttgtgaatcaaaattcaaatatgttcatatactatggttacaaaggcaagaaataagtagattttctaaaatttttccaacaggagctgaaatgctaagagctaaatattcagtttaccataaaaatctaagctctgggaggccattgctgagcattnnnnnnnnnnnnnnnnnnnnaggcgtgagccaccatgccgacctgaaatccatatgacttctttcaaaaagctttctgctaaataaatctggtctgaatggagggagacaagtaggcatggttgatctctgtgagaagtgaagagaggaaagacattgcaggggtaacaagtagataccaaattagagctcttcaagctcaaggctgttagtttgctcttgtgagtgtcctttagtttttttttaattaaaaagatttttttaaatcacagacaaggactcattctgtcacacagactggagtgcaatggcaccatcacagttcactgcatccttaatctccagggctcaagtgatcctcctaattcagcttctggagtagctgggactacaagtgtgagccaccatgccctgctaaccttcgttttgtttttttaagagacagggtcttaccatgctgcccaggctagtctcaaactcctgggctcaagtgatctacccgcctcagcctcccaaagtgttgggcttacaggcatgagccactgtgcccaaccaaaagtgcattttaaaattaaggtaaaatttaatgtatgttgaaatgaactaaagtgtacaaaatgatttttgacaaacatatgcacctctctaaccgatacctcatttaagataaaatatgcttttaatttttcagaaatcaaaaaagtttttctctgtggacatctccacttttttttttgtaagacttttaccctcaacctagactcttaggttatattaccaactatgcaggtttcttgtggttactggctctaactattgggatttcagatcttaggcccagagcaggaggagagaagaaacttcactgtctgcccacctactacctaatcagctagctgacttttgtttttgtttttgttttgttttgttttgtttttttgagacggagtctcactctgttgcccaggctggagtgcagtggcgcgatcttggctcactgcaagctctgccttccgggttcacgccattctcctgcctcagcctcctgagtagttgggactacaggcgcctgccaccacgcccggctaatttttttgtatttttactggagacggggtttcactgtgttagccatcatggtctcgatctcctgacctcgtgatctgcccgccttggcctcccaaagtgctagaattacaggtgtgagccacaggcccggcctagctgacttttactcttaacaaggaggtgtctgtgtctaaaatgttatgcattaaactatgggacacactgcctcttgaaaatgtgaataaagtcacaggttacatggaggtaacgattgttcaaaatttgtcccacataactttgttgtttggcaggttcggtgttgcaaaaatcaactctacatctctcttgatggaacatgtggcctctagtttctgccactccaccccttcctaatgcttgagacttgcattacctgtttggctcctgaaagcattaagagtttgtaatccctgctttacttacatacgttaatttgattcattcttttttttttctttttgagagggagtctcggagtacagtggcacgatctcagctcactgcaagctccgcctcccgggttcatgccattctcctgcctcagcctcccaagtagctgggactacaggcacccaccaccacacccggctaatttttttttttttttttgtatttttagtagagatggggtttcaccgtgttagccaggatggtctcaatctcctgacctcgtgatctgcctacctcggcctcccaaagtactgggattacaggcgtgagccaccacacccagccgattcattcttttattaaagaaataactccatgtttagcttataagatagtttggtactggttaatatgtttcactttcagttttaaattattcaaatgattaatgattgggaaaagatttgacattacagaaaatttgttatatacgttatattacagcctgaattattgatacaatccataagtatttattaatatttggttcatttttctctttcaagctatgaaaatgaatataatgttaagggaaaattatagatagtattccatagactactcaagcaattacagttaatgtcaaagggaacaaaatgatttcctatcttgatcttctgttaagaaggctaatagaagaattgctgtgcaaaactttatggagaatttcaaaggtatttttgtgtttcttcttgaatttgtatttccagtcattttcacaaacagcaaaggtattctgaaaggtattctgcaaatacctttgcagcaaaggtatttgcagcaaaggtgttctgcaaattattctgaaaggagattagagggaataaattcaaaggaatggggagagagtaacccaagaaaggagggtcactgcttctttgagctatttggaaagtcatcaaggatgggtaaagagatgaagtggtgtgtaaaaataactttatgaagaggagagaagctgagaaactctcttttggtattctagtctccttagtaaggtagaaggtaggaccatcagtttagggtgacagaagcatgtgagttgttgagcccttaaggagtgtggtaggctactccccagccccctaatcccgaaatatgtccatgactaatcattgaaacctgggaatattgcctttatatggcaaaagggactttgcagatgtgattatgttatggatttttagatgagattatcctgggctgttcccctgggcctgatgtaatcatactggttcttaccagagagatgaaagagtcagtcagagaaaaaaggcgatatgattgtagaaacagactggagtgatggactttgaaaatggaggcgggggcactagtcaaagaagacagatggcccctagaaaagcaaggaaatgggtgctcctgagagcctccataaggagccagccctgccaacatctttgctttagcctgctgaaactgatttcagttttctgaattctagaatataagagaatagataaaccacaaatttgtggtaatttttacagcagcaataagaaactaatacaaggaaaaaaaatggaatgctcactgtgctgtgatcaactaggtgtaaataaatggattatctatagttgtgaggggataatttaggtgagttggcacaaattttgtatagtggagccagttagagtttgacctttttccagggtacttagcctcagagaagagtgttcaaaataaggaaaacccactgatagaattttccctcttgggtgtgggggagaattctaagatagtagcgtttttgaaatggttgctgtgggtctgtgctgttaaaggaagcaagtgaatctcatatggtccatgaaatagaagtattacgtatttgggatcagcagacctagagatctagtgagaatgagaaacgggatcgttcaagtgtaacaaagtaggagaggtgggaagaaaaagatgatcttcaatgccagagttatttgatgtcttctaatgatgaggttcaaggtttgcttatatcaatgtgtggctggagggaatcttgataaaatgcaagattaaaatttaggcatctttaaggagtgtgtcagattgctcattagtgtgaacgttgtagtgcaaatgttgctcatggtgtgaaccaaaggtaataggtggcaaggagcagagtttagatgaatactatacgctatttgctaaagctaccgtggagaatttgtgtgcctttttggaggccagaagataggataagaacatagagatgatggagtctgtgggtctgtgttttctcatgtacattttgatgattttagctctttaaaaagtttgttcacaatattctaggttgcacatttagagaattttgaaaataactatattctggaaaagcacagatagattaagaattttcctggcaccttctctgctttcagaatgatgtactagaagaaacaggatgcagtgacttttgggctatacctcttcaacattttgactgactttgcttttgtaagaaaggtctttttaagacaggctttccccatttgtgctctaatttttatagctatgactgaccagtatccagtaccccggcatctttttatagttagaagtcacatactaggccttatgtcaaggaaaccagggcatcatgaaatactgtaaaggttaagaatgtgcctgataataagggtttcttccttccttaaattcctgctgctttttaattttatttttcttgctacttaaaaatgttatttaatatttttcagcccctatctgaaacagattaatagaacagtaaacttttttttttttttttggagacttagtcttgctctgtcgcccaggttggagaatgataaacttgatcgctgtgccttgtgaactgttttctgggtatatgcagtgatgattttagcagtccatgacattaagtttaggaaggcaagtattcagtgtttacactgcctaacatgaagtagaccctgtggtcagaaatagagcacattatttgtttttcttttctttttttttttttttttttttttttgagacggagtctccctctgtcgcccaggctggagtgcagtggtgcaatctcagctcactgcagccttcgcctcctgggttcaagcgattcttctgcctcagcctcccgagtagctgggattacaggcgcccaccaccacgtccagctaattttttgtatttttcttaaagacgggattcaccacgttggccagactggtctcgaactttcgacctcaggtgatccacctgccttggccttccaaagtgctggaattacaggcatgagccacagcgcccagcccggaaatacatcacatcttgatagagtaaagggaatgaacttgtatacataaagtggactctgacaatgtatgtgggaagtttggagtagtgagaagaatgtttaatgtgaattaagaaactagttcctgctttgtcattaatttgctcaagttatttaccctctcaagactcttgttttcttatctgtaaaattattggacaagagatctgattcttatcttttgggagtcatagatcctttggaaaatggtcatatttcacgaactctctcctggaagaggcaggcatgtgtgcatgcacataccatagaacacatactttgtgcagtttcaaggggtttatgggtgcctgaaacctatctatggaatctgtaaggatatgttgattagattattttaaatgttagagcccttttagctcttaagttttataccatcttaaaactgaaagtgaacagctagatgtagtgtctgaggaattatgataatgaaggaagaaaacagagtagattaagttgatcacagtttctttaggaactcttcaagtaggttaatataagccttccttggctgagtctccccaacactgctactcaaaagagcaaataatacttttacctttggtgcgtgccaggcactgtttaagcactttatgtatgtttatttaatcctaacaatattattatcttatcattatttttgttatttttaagcaatactttaggagatcaataaaacaaaaaaatttattgtgtttctttgaaggtaaatgtttttccaaatacataacaacagatatcatttattacatacctgtatcactgtgccacatgttttaaatacttgaccttaaagttgaatgttatctccatttttgtgaatggaaaactgaggttagaaagattaagaatgaggttagagagattaacctgccaaaatcatacatttactgaataactggagtagaatattggatttaagcctttgaatttgcagtgtttgatttttgattcaaatttgaatttagaagttgattctaaagctcatggtcttcaccactgtgctctatcaatcacctcagtgcaaaagaattacattaattgactgtttagtagagtttatgataaacccagaattttaaggtgtatcacttgttccatatattgaagcatttagtttgtttacatttaaaataattactgatacatttgggtttaaatttactgtcctattttttttttctgtctcatctgttctttattactttcctcagctttttttttttgctttctttagattaataagtgtattttattacccccacccccattagcttattatttacatgttattttagtagttaccttagagattatatgcattagattagttttttgttttgttacttaccactttctgggtagggcaaaggtcttagaacattttgacttcttggggtttttcccctttggtttttatacttttgatcctgggttgtttttgttttgttttgtgggggaaacgggcaagcatggtgttttaaaatttgaattccagtattgtttgtgaaaaattgtggaggccctgcatgataccttcctccaaagtaaatttaattttgttccggcaggcaggtaaagtacagtcagatcaccgtgatctagttgaggctagcttttagttagtgttggtctgttaacagtttgcctttatttccaggacatacctattcacagagcatagttcctctggggtctgaactgaaagaaagcctgaggtgtttgccaggttgccttctgaattaatgttcctagaattctaacagttgtctcttcagcacagatcttcagcctccctttgatagtttctgtttggattcttggtgtcatcaccccttgcttagggtgctgtatcagtaaacatctcagtgaaaaatttcttgcagaaattgcggctctttgtgtttctctcctcttcagaaccttgacatcttaagtcctagctgcttggtaaccaactccacttttgtctttctggttgggctcttatttccagtcctccaaagacagcaagtgactgaagggaaccagtgaaggctggtatggggctcctctcagtatgtttgccttttctccggaatcttggccctacaagtctaggttgcctttgttactcttgatgcttttaaacactgggggtttttggtttgtttttttaattgtggtcaaatacatataaaatttaccatcttacccttaagtgtgcagttcagagctattaagtgtacgttcacattgttgtacagagctgtcaccaccatcctctccagaattcttttcatcttgcaaaactgaaattctgtactcactaaacagtaactttccattttcccctccaccaagcctctgccagctaccattctaccttctctgtttatgatttgatcactcattacctcatgtaagtggaatcataaggtgtttgtccctttgtcactggcatatttcacttagcatgtccttaaggttcatcgtattacggcatatgtgagagtttacttcctttctaaggctgcataataccgcattctatgtgtagaccacattttgtttatctgttcatctgttgatggacacttgagttgttttcaccttttggctactgtgaataatgttgctgtgaacacgaatgtacaaatacctcttcaagatgtgctttcatttcttttgggtgtatacccagaagtggaattagtggatcctatgttaattgtttttgtaatttttgaggaactgctatattgctttccacagcagctatactatcttaggtttccaccaacagtgcacgagagctctaatttttccacattcttgtcaaaacttgttattttgtgttttgtgttttttttttttatagtaactcttctaatgggtatgaggtggtagttttttattttcatccagcttttatagttgttcttccaggggcgttggtcttacaaaagcttttctttcagtactaaaggtggaataacattttgaggtagatgttattttacagatgaggcaactgagacagatactaaggtcacacctagtaaatggcagacaagactgaaacagaggctatttggttcttgaatcagtgctcttaaccactgaattgtattgcttctctaatacaggtcttctttcctgaaagatagtcttataaattcattgctctaagacctcaaagtgtgattaactgttttttttccctctgacctctagattattaaatttgaagtagagaacagtgtttttattttatgatttattgcagtttacacaactttagagaaacatgggtttgatttgtccaatatcttggtagacaattcttaaatggaaattatttttaaataaaaaattttcacaactgtgtttttcttgttaaaatttttcagacccctgagaaggattttttttttttttttttttgagacggtgtctcacgctgtcacccaggctggagtgcagtggcaggatcttgactcactgcaagctccgcctcccgggttcataccattctcctgcctcagcctcccaagtagctgggctacaggctcccgccaccacgcctggctaatttttttgtattttttagtagagatggggtttcactgtgttagccaggatggtctcgatctcctgacctcatgatctgcccgcctcggcctcccaagaaagattttaagaaaatttttactgtggtggaaactctgagctttttagtagtggctaagtccaccaggttttttgacaccatatcatatgcttctctaccaaatttatcagtaatatttttatatctagaaatgtttatctgtacaatttactaattcatatgttactggtgctgttttagaagtgtagtcagttactggtatcatggaaagtattgagaaagttctttaaacttcgatctaattataattagactttttttcccccactatgattctgcagtagaaactttttactacttttctgctcatttaaaatttttctatttctgtcttcattgtgttaaacctttttaaatctgtatttatttcatgatttgaaagtgaactctgaaaatattttattacttgttaatagaggattaccttagtgattaaatttggtaaggcaagttctaacatgttctgacagacttgtcatagagttatttgcctctttttttttttttttaattttaaatgtgagtttaacttttcagggtttatctctagcttactagcagaataagtatttaatatttataaagatttttttaaccctgtttacatttgtcttttcgtattctcttttacagtagtagacaaaaacagttacagatgttcttagtatgaggataagaaactgaaagaagaactatttaagagtttgattaaccagcttgacagttagcttaaaagaccaactttcacagcaattcacacattgttaaaccttttttttttttcctaaataaatagctactgctggccatatgtgggaccaggcagaggatagatgaataagtactaataaataactatccttggtctattaggagtagtagtaaaagtactgaactactttgagaggccgaggcgggtcaggagttagagaccagcctggcccaacatggtgaaaccccaactctactgaaaatacaaaaattagccgggcatggtggcacatacctgtaatcccagctactagcggggctgaggcaggaggatcacttgaacctgggaggcggaagttgcagtgaaccgagatcgtgccactgcactccagcctgggcaacagagcgagactctgtctcaaaaaaaaaaaaaaagaagtatgaaactactggactttaaagcaaacatgttattaaaagctcccttaaactttgtaatagaaccagaggacttttgtatttatatttatactaagctttcagagttgaatgtgacccaaaggttagttttagaatttgttctcaaacacctgtttactcatagttacaaatgaaacattagataggaatgataaaataacaatttttaagttgtttctttccttgggtgcaccattgattttgcctagaacccatttatcctagcttgcttttctgtaacataatgactattaaaaatatttactaaactttttcttgcaggtaaattaagtagtaagagttaagttgttttttggacttaattttcacatttgtttttattttaactttttatttgatttgtttgtaatgccactccctgagtaatgaaactatttagcgcactttaagagacaccccttgactttgcataggtttagcttcaataggaactgtatttttgcattgtgtgtcttgacacctttgagcatacttttatgtgctgaatttgatttcttatacatcatttaactatttagatatgttggtagggtgaagaggaaaaggcacatctttgccaagatggtggaagtagtaatatctgtggtcttgtagggccaagcattttgtttgttggtgtcctcgtgtcttctgggcatgcaaagagccctaggtcttgagtaagcatttgcaggagttttccatggaggtcacctggttgagctttccttttcttgtggcttagaaagactccatctctctccagtccaactcctggagacctgcctgtcctagttgatgttttaaaactggtggtgcttttgtatttttttatccagcctttatagttgttggcagggaagttggtcttaaaagctatttattttcaggactagaagtggaaatgagtggaatagcattgtgagatagatgttatgttacaaatgaagtgcttatgttacaaatgaagttggtttatcaagcttactgtatggatgaagtcagatgcagaaccagctgtgaaaaggggggcatgaggtgggtccccaccattggctcctgtctctcaccacaggtccacctagcttgtgaaagtttttgctcattgcaggcctgcttggccaaggaatagcaacccttgagagagaactgtaaatagagatttaaaatgtggtttatctctgtggtgatgaaactcacatccctttatgtaaacataatgcttgactcacattaggctttcgaacatgtttttcagaacattttatatttaaaatgcctgtttttggctttaaaaaggcaagtagaaaaagccaccaactttctatctctgctaaggtctctttagtagataagtgactaatgtcaaactcatactacattttggtcactacattttggtcaaagcctgggattaagacattttaaaatcagtctttaattttttttttttctcttttggaatgatttttaaaatcttgttcatactttgagtttgctagttagaggtaaccggagctgggacttttaaaaaatcttaaaaaatagacacataaaaattaaaacctcacaagaatttaaatgatattagaatcatatcatgtgcatatcacaagtttactgtgaatatatgtgtgcatttctgtttaacatatgcacacaaatactcaagggttatgcatctgtacccttaattgtacttgatggtaattaatcatacatgtcagacatttaatataaatgattatttagtattactattaatagttttatagagccacacttaagtttctgtgtttcttctccatttattagctcttttttatctataatgaaattttagggttatcaagtttttcttaatattatatgtcatttaattatcatcacacatcttgacagtctcaagttgaaagacaaaggcttagctcttacaccacagtaacccatggctttaaacattctgtgttctgcctacaccttccagcttcaggttgattttgtctcttacccgaaatgcttgtgaccataagtgttttcagattttgcattttggggggattttggaatatttgcatatacataatgagagattgtggggatggaacccatgtgctaaacataaaattcatttatgttttatatacaccttatatacatagcccaaaggtaattttgtacaatattttaagtaatttgtacatgaaataaagttttggctgcaacccgatgcatgaggtcagttgtggaatttacttgtggcatcatgttgatgctcagagtttcagagtttggagaattttagatgtcagatttttggattggggtgctccaaactatgtattctgatcacatgccttggcttcctttactgaagcatcattttcctctatacacagcattcctgaagaattcatcagttctgactgatgtctttctgcctttttgccagagggcttaagatagcagacattgtaggccataaggtaatagatttacctcctttagtagcgataccatcactatgcttaaagttgggacaggggaaatccaagccatgggagaccgatagcaaatagaaggggaagaagtagtgaagtgtacatttatttgatcctgcatgtatattattttttggtgagaggattttcataggaaatgatattaatgttttagagattatctttaccagccatttgttttactgagggccacaatgaataagtgacttaaggtcacatagccagttaacagtagagccaggatcatataaagaattcctaacttcacatcaaatattattcttactattagaggttttttattaaaaaatttaccataagtgatagatcccccttagaaaagtttgataatttccatacagcccagtaattcctctcttagaatccacccaagaaaaatgaaagcatatgtccacaaaaatattgtacccaaatgtttatagccaccttatttgtaatagacaaaaaatggaaacaacccaaagtatccatcagcttatagataagcaaaatgtggtgtatccatgcaatggagtgctgtttagccctaaacagaaggaaatactgttgtatgttacaacattaataaaccttacaaactttatgcttaatgaaggaaatcagacaccaaagattacatattacaggataattatatgaaatgaccacaaaaggaaatttacagagactgaaagcagaagtgaacaaaggacttgtcagaattgccagtactttctattctagctgcaaatcccgataaaaggttctctcactactgttaggctacttttccagtataatcttccatattcttcacttaccagttgaactttgtgcttattgaagttctgttgtatttttcaaacctgtgtattcgaattgtacttattattaatatataattaatattgtgtaaattgataaaatcttgtgaaaaaaataaaattttttatttggcaagctagattggatgctttggaaagacttcataaaagcaaatggctacatactggtttgaattaagtgtaggtaatttaagacattagagtgaaaatagtaaaaaaaaatctagaaggattttacattcagattacttcacaaatgcctctagttcatgcttcaccttaatgaaactgagctaggaatgctagacaatttattatgtatgagtgtttataagtacactatttgttttctttttgaaatggggtcttgctgtgtcatccaggctggagtacaggggctggctcattgcagcctctgtctactgggttgaactgattgttctgcctcagcctcccgagtagctgggactacaggcgcgcaccaacatgcctggccaatttttgtatttttagtagagacagggtttcaccatattggccaggctggtctcaaactcctgacctcaagtgatccgactgcttcggcctcccaaagtgctgggattacaggcgtgagccaccgcacctggcctgtatgtatacaatattgagcttcagtcacaggactcattttcaaagaaagtcctgatgtctgaatgaacgtttatatttttaaattaaaatgttcaggatgcaaatgtgtgtatatgtttaatagtttccctgttttactacctgtctttagccattcagatagtgtttttgatcacattggttaaaaggtattctcctgtctctggtgcttttctgtacaatatatacttatatgtagaacttagaaaaatcaaatgtgtaaaatagtttaagcaataatagtgattatttttataataaaagggattcttgttggtttttgaattattaaatttatgctagtttttattatgtacatattgttctgtgctgagaagtaaaacacgattagttatgacagtaggaaaaggttgggcctggaggtcatgtgagatgaaagaggaggtttacaggcggtggctcacacctgtaatcccagcactttgggaggccgaggtgggtggatcacgaggttaggagatggagaccatcctggcccacatggtgaaaccccgtctctactaaaaatacaaaaattagccaggcatggtggcgggtgcctgtaatcccagctacttgggcggctgaggcaggagaatcacttgaacctgggaggtagagattgcagtgagccgagatcgcaccactgcactccagcctggtgatagagtgagacttcctctcaaaaaaaacaaaaaacaaaaaacagtgttagccatcaaaagcaaggagggaggctgggctcagaggctcgcgcctgtaatcccagcattttgggaggccaaggcgggcagatcacaaggtcaagagatcgagaccatcctggccaacatggtgaaaccctgtctctactaaacatacaaaaattagctgggtgtggtggcaggcgcctgtagtcccaggtactcacgaggctgaggcaggagaatcgcttaaactcgggaggcagagttcacagtgagccaaggtcacgccactgcactccagcctggtgacagagcgacaccccatatcaaaaaaaaaaaaaaaagcaaacaaaaaaggagggacgtggtcagagggaaacttggaatttaagatcttgaggatggaagtgtgaagtccaagaagttcaaagtcatcaataagcattttgaactcatcaaaattgatgttaagatttcaaaaatgtgatgtgagcttgtgctgagattatatagaatgtagaaatgtgagcactgaagaagataatataaaaaatagctttccttgttattaggtgttaaaccatcatacaagatgaatgaaaggagaaggttggaggaatgatgtcatatgaagcaagaactgcacgtggagaatttaattaaaattgtttggggccgggcatggtggctcacgcctgtaatcccagcactttgggaggccaaggtgggcagatcacttgaggtcaggactttcgagaccaggccaactgatgaaaccccgtctccacaaaaaaataaaaagattagccaggcatgatggtatatgcctgtaatgtcaactactcagaaggctgaggcagaattgctggaacccaggaggaagaggttgcagtgagccgagatggcaccactgtactccagcccagacaacagagtgaatgagactccatctcaaaaaaaaaaaaaaagtttggaaagttgattagtattattctggttacattgttaatgtggtagagctctgttcatgttcaccttatcgttagctataacctgtagattcatgttcaagaatctggtgaaagatatgggctttctttccaaagtacttaagcgtgaacaaacatataacttaataattttagaaggctcacagacccaccaaagcccagagagatccttgctgagacgagaaaggaattacattactaatccttctgtgcattacaaaaaacagtagttttatttcagtgtattttgctatcaatatggattttcaaggaatgcacaacacttctggattatctgtgctctataaactgagatatctgtaatcatgttggtaagaacttgaaagtaataatctgtttgaagtgacagtaagtagaggtgttttaattatgtaatacttaatgctgctctattttatgcattaaagccttttaaatatttatcagtaacaatcaatctaagttgtataaatccgtactttattcaactctcagttttacttcaaagaatatgatcttcaactacagtatttaagaacgaaccatgtttgagtatgctgtagctttggggagaaagtgtgctaccttactatttacctttttttactctgtttttttcttcctggctatgatgcttactttttaccctttttctttaggtaaatgggccaccatttatagccattgtcaattgtaaaaacttaactttatataacttgagaggtgctggaaagttgcacattgcttaagatcatttgaagtgtttctcacctgaaaaatgattgcttttggaattttatttcctttatttgttattgtagcacacaataattattatgctcacaagaactgtactcatatttatatgactttaactgtaggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacaggtaaaatttctctctttactcttgtggttttggttttagtgattatatcttgagaacgattcactgtcttagttttattaaaataaataaaagtttgaatgttgagcacattgggaaaatcctcagaaacttagtatcagagttaacagttacccaaaatttaatttgaaagcacacatcttttatatttttagaagagactatcctaagcttttatttaatatgcttttcagctagccgtcacttttggcttttcatttatttttcatgccagcatttttttctttttttctgtgtaataacatttgtatttttttttctttaagggcttttgtctgtccttcattcctaacatttttgaagaaaactattgaacatagtctaaaatgactaagaactcctgtgccccttttaagtcagatttcatcccccttcataacaatgattgcagtgtcattttggtgatgctgcagctaaagtggcttgaaatgcatgattttttttctctccttatctgttttcagaacagctgttggatgaaaacgtgtaaagttctttttatttcgtctttggtgcttgatcagcattgtccaaaatccatgtagtgcaaaaagttatattgcccaggagtagctgtatattggacccatgtctggcagtacagcttaatctgcctatctccctctctcccttcttccagataaacagcctctctgtgttttcaaatacatagaaatatttagacattttagagtaagaacaccttgagagaaatagctgtgcagtcaagatatgctttccaacttaaaattaggctaaatcctttgttttacatgagtggcctattggagattggtcacttcagtaagagttaaatgtcctgaagatatttttacctactcctttttgtaatttttatgtgaatttttaaatgtaatttaattatcaagtgataataacttttttcgacagaggcgcaataagaaatgcttgccagatgttaatgattttaggtctcgaaggaagatcagtctatgaagaagattttgaggctccttttttggaaatgtctgcagaattttttcaggtaatccgtgaaaatgtaaataaataatcttttaagatgttcttaatgttatttaatatagttactaatttaactattttgaccttttttaactgagacccattaagggaggggagtatgcaaaaaatgcccatcagcacactacctcacattctgaccattccagttaagcaactcatcgataacaaattgaagaggttgaacttacacacatggtttttaaaataacagagatgacccttgaacagtgtggggcatagggatgctgacgcccctgtgtagtcaaaagtccacataaaacttttgactccccaaaaacttaactaatagtgtgctattgactgaaaaccttacagataacataaacagttgattagcatatattttgtatatgtattgcatattgtactcttacaataaagtaagctagagaaaagaaagtgttattaacaccattacacggaagataaactgtaatttactgttcactaagtggaagtggatcatcagggtcttcatcctcgccttcatattgagtaggctgaggaggagtaagaagaaggagggcttgatcttgctgtctaaggtggtaggggaggaagaaaatccacttcatggacctgtgcagttcaaccttgtgttgttcaagggtcaactgtatgttatgaaactgtaaacttagaaatatccttaactttttactatatctaatattataaattatttaagtactataaattcacagcagtacatcaccaacgaagtctcatctgcaggcttttagtcacttaaattactagtaaaacacacataaggatatggatgattctgtagtgcatatttgcctaaaggttgttgattaaaatattacaggccaatggtactattgatagaaattggcaacagtggtccaaaccaactaaattgctaaaagtaaagctaaactggtactaatctgtaatgaaatgatgataacaacaataattgagtactagtaaacataagatagtagttataaggtaactgtaacaaggcatttttcctgaaaaccgtaactacctgagcagttaacagtaggaattttgtagtgttgccaaaacagatgtattcgtaggaagctaaagtgttggccgggcacagtggctcacgcctgtaatcccagcactttgggaggctgagacgagtggatcactatatcaggagattgagaccatcctggctaacacggtgaaaccccatttctactaaaaatacaaaaaaattagccgggcgtggtggcgggcgcctgtagtcccagctactcgggaggctgaggcaggagaatggtgtggacccgggaggtggagcttgcagtgagctgagatcgcgccactgcactctagcctgggtgacagagcgagactctgtctcaaaaaaaaaaagaaaaaaaagatgaatagttatttaaaagctcttattttcaaactttagtgtacatgtttactctttgagactgggagtgggatggcactggaagacttaattaaccagcagtatgccagcaaagcttatgataaacatgatgaatctttctggttataattttactttaaaacaaatcaaaaaagaatgtcccactgtatcttggagtcagatgcttctaagcttttgaccctcactggcgtgtatatacttgttctgctattttttggagtacattggcacagtttgaaaaacattgcttacagataatgttttaatttagtattatgtaaataccaaaggctttaaaggatataattcagactatatcagtctttcgtgtaatgagaaattacacaaaatgctaatagtacttattttatttaggctgatttattataaacactgtagaaacccagctaaaagcaaaaacactcttttcttctatgtttaaaaaatatatatatttttaaatggcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaaggtaagtgttaccgattgaaaaataattaaatccttactctgccttatcgatatttttaaaattttcctacaattaaagcagataatatcagctttcaagaagttttggtgtgtattgttaatttgtctccattgttaactttaatgggatttccaagcttgattctgtcttactaacgaagattttagatatttctaatgaattgagcatttcctgtctttaagtctcattttacatttaatccagaagataaaaggtgtaatagtattggtgagcccagtgagctcctcattcattcctgtacttcctgtataccaaagggtgtgggctctctttagtcctacatactctcttggggttttgtgattctcttaaaaccttaagtttccaccttaagatttttgtagactttcctttgggatttagttgtgacagggtgctgaaaatgcaaaaatatttgtgtcttccatattgacatacttagataaattagattggtttggggaacactgaagttacagaatggaaaaggaggaaggaggagtgcataaaagtaaagaacatttttgagataactaacatttgttttttatagctatttattttcctggggtaaaagaaaaattgtgacaagtatcctagaagaaattacaagttaaaagaacaataaccatatcctctattcttagtttctgatgctttgttttaaaactttgcctttaccacttatatggtattaggaaataaaaaacatggtactttgttctcctgcttcctagacgaaatctaagcaatattttatccacttctttttagtaaaagaaatacatattgcctgttggggtcatgagctatgtagggaatgaaaaaattttttaaaggagaattataaagagaaggaggatacaagagaaaggaaaacgaaagctggtgggaagttgagccatgtttatctctagtggaatccttaccttgtgttttaaaattgttaaatgtttgtatatatgagaaatccctgaaaagttatatgtaatttaaaaaaacaaaaaaaaaacaaaaaaaactagagaggcttcctttttaaaagactcttcagttaaaccttttttgtaaaagccaaaaaaaaaaaaaaaacagaagtcatctagtatatttgctgtgttttctaaaattgaggtccaagtcaggggttggcaagcttttttgttgttgaataaaatggcttgtgagccacgcagtcatagtgagaaaatagtcctagacaataacaaatgaataatcctgtgtttctataagactttatttatgggccctgaaacttgaatttcatataatttttatgtgtcactaaatagcattctttacagtttttcctcagccattaaaaatgtgaaaaccatccttagttcatgagctgtacataaatagatggcaggctgtatttgccccacgggttctaattcgatgacccttctctaagtggtctctggtagactgggactttatgcaaagcatttgccctgcttaaacaaaatgagtattgataaattatgtaatgtactgtttaggtattgaatgaatgctttcttacctaccttaggggataggaaatgtttgatggagaggttgttgggcatacctgaattacagcatctctgtaacctgtgtggagatgtatgtaaaaggtgtcaggtatgcctatcatggcgagcacttacgtgaatgaaggaataccataatagtactcaccagagttctcctttatttagtaccttaggtttccaacaacacagtagctatctgtgattctaaattaaattttaaaatcctgcttttgtccaggcagggtggcaaacgcctgtaatctcagtatttttgggaggctgaagcaggtggatcgcttgagctcaggagtttaagaccaacctgggcaaattggtgaaaccctgtctctatgaaaaatacaaaaattagctgggcatgatggcacatgcctagtcccagccacttgggaggttgaggtgagaggatcatttgaatctggctggggaggtcaaggctgcagtgaaccaagatgatgccactgcactccagcctgggctacagagggagatcctgtcttaagaaaaaaaaggtgggggggttaatttttctgagcttccgctagaaacctggtggcaaaatatcctaattgtggtaggccctgctcttggaaaaaatgttgctcttgttgagaatatagcagagccaacttcaccattatgaagccaaattctcataaatcagaaaatgaaaaacagttttctcactgtgaatggaggataaattggattgattattagatgcagatagcactatgaaatgaagttcagaggtatctttttttttttttgagacgaagtcttgctctgtcgcccaggctggagtgcagtggtgggatctcagctcactgcaagctctgcctcccaggttcatgccattctcctgcctcagcctcatgagtagctgggactgcaggctcccgccaccacgcccggctaattttttgtatttttattaaagacaggggggtttcaccgtgttagccagggtggtctcgatatcctgaccttgtgatccgcccgtctcagcctcccaaagtgttgggattacaggcgtgagccaccgtgtctcgccagtatcttattattttattaagtgtatgtagaaataatgatatttaatttttgcatgccaaattattttcatttacttttacattccctttaccccaacatttaaatacaatgaaattgtagtaatttatgtacaactaaatacacaacatgtaatatctaagcaaaacttacaacaacataggattgaaatagacaagttgtgaaccattttgttagaagtatttggtgtgccacatttactgtagtatgtgtccatagattgttgcatttgtaatacctgttctaaatatgggaaacttggttgtaatttatgctaagtatgtgagaagctataaaattgccatgtgtaggttactatgggcatatattattaatggaaactaactaaaatttgctgctgaaagtcactgaaataaagtttagtaaaactttgtaaatcttgctttgaaatattttaaaaatgtatacaactttaagctctaaactactcttagaactgtagaccaaggtaggcaaattagggcctgcctggtgcactaccagttttgttaaaaaaaaaaaaaaatcaagagtatttacacatgaaaatttatataaattttcagggtccatgaagttttatttgaaacatagtcacactgaataatttatgtattatctgtggctactttcttgctacagcgtcagagtagttgagtcagagctctatggctcacattttaaaatatttattatctgatactttacagaaaaaacattggtcagcctctgatctagaaactcttaatgccattttaaaaagttattgattgtaaaacttttaaaattatcattgtaaagttctgacactgtgttctcccagtaagttgttattgcaaagaaacactagacatatgggaaaactgtattttaaaatctgtattttagtcttgtgaaaaatgatattaaaaaatggataggatccagagttttcattctaaatttaaaaagtatagtgagatagaccaaattttgaagtacagatattggcttaggatgctacctgggaaacattagggattgctctcaggaaaatattgaagaagtggtatttatattatacatttcataaaaactttacctgaggtgtaatgaagtaaatcctagtatagttcatttgatttgttttcatgattatcagttaaacctttggaaatacccataagacttaaactggctttaaaatttcttcctcattacagggactaccaattacctcttaattagtgaccctttttgtagacgttttgtagtgtcattaggtctgcattagagttatgtaggataaagtatttatgaactcaaaactgcagttgccatgtttttgtgacattacttgtttattatggtttttgacatctcttccatgtaaatttaaatttgctaggacatttaattgatggtttcaaagcatctcatctaaaagttgtgttttataaattacaataataaccattaactagcctacttcttcatgttttcatatcaatatatgtatatttttaatagtcatgtggtcagcaaatgggggtaatggagaaataagcttctctcagtattatagcgtgaacagagattcgtgtttttttctttaatctttaatgtagccaatttgtgttttctgatttgtagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccaggtaagtaaacccagaagattctctgtgtttatgataaaggcattttgacaagtgctaaaaaggccacttttaccatgctgtgtattgtgtactttcaacttaattgtcccagtagtaaattaatatttgtaattatcctacatattttaggattttgcaaggtgtgcgtatttatatcagggagctaaaattcagctgctacttttcatttaacttctttgatgaagaccttgtttaaatagcctcaatagtgaatgtgaggttctttggtatgccttagtgtttgtatactgtagtatattggaaaaaacaactggtttaagtattttttgtttgaaaatgttttgttttcaaggagtactatgaataaattatgtgccatgttttgtgttttaacataatcagctttttttggtacattttttaagctaatttttttcactggctaacccattccatcaagacaggagaatgagaaacagtgaggaggttctttggttcgtttgcattgtattaatacatatatggaagttataatacttctctcattgacatttttaatagaggcttagatataggcttgaaaataatatcaaaactgtaagtttaaaaatgaatatacatgtttattaccagcaaagttaagataaacatacatggtcataagtgtattatttatggaaaaattattataatgtgtcctaaattttgtttttatttctaagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaaggggtaagtagtaatgcatttgaaaataacatttaattttatttaaagatataaaattatatgtaaaattaggacatttcacagataaaaattaagcatgacccattgctgtgcttaaatgggtgccatggtctattaaaaaatattgtttgaaatacttgacatgcccaaacgtagttagacatttcacttaatgtgtaattggcttcaaaaacaagcaactggatgggcttggtggctcatgcctataatcccagcatttggggaggccaagacaggaggctctcttgaggccaggagtttgaaattagccttgttaacttagtgagactccatctctacaaaaaaaaagaaaaaagaaaaaaattagtggcacacagtggtatacacctgttgtcccagaagctgaggcagaggatcacttgagctcaggagttcaaggctgcagtgagctgtgatcgcgtgactgcactctatgctgggcgacagagcaagaccttgtctcaaaaaaactgaacaactgtccaggtatggtggctcatgcctgtaatctcagcactttgggaggccgaggtgggcagaccacctgaggttgggagtttgagaccagcctgaccaacttggtgaaaccccatctctactaaaaatacaaaattagctgggcatggtggtggatgcctgtaatcccagctactcaggaggctgaggcaggagaatcacttgaacccaggaggcggaggttgcagtgagccaagatgacgccactgcactccagctggggcaacaatagcgaaactccgtctcaaaaaaaaaaaaaaaactgaacaactacacagctgtagttggtaaacagtcatttttatgactgagagttaggcatgctgaagataaagaactagaaaactttctagtagagagtgttgtttgctctcatctggttctgaaggttatatgtcaaacaataattggatgccaagaatattaaggcatagatagagtagatctcatctcagaaaatggttggtgtagctcaatttcaagcctttgtgatatatgatatctctggaacctgaggagctcacgacagcatagaaaatcaactgaagcataaaacatgctcacatctgaattggtctcttttgacttcattttggaatttgtgacaccaaagggaaaagcaacatgtcgtcacaggttttacaggcagtagctgcaataagggaacaaaatcactaaggttgcacagaatagaaaagtctattaatttatgcattcatttggtcttccgtttttcaaatatattaatacaacctgccacagaatccttttgcccttatttaaaagtaagggcagccaggcacagtggctcacgcttgtaatcccagcactttgggaggcaaaggcggcggatcacctgaggttgggagttcaagaccagcctgaccaatatggaggaaacccatctctactaaaaatacaaaattagccgggtgtggtggtgcatgtctaatcccagctactcgggaggctgaggcaggagaattgcttgaacccgggaagcagaggttgcggtgagccgagatggcgccattgcgctccagcctgggcaacgagtgaaactccgtctcaaaagaaaaaaaaaatagaaataaaaaaataaagtaagggcaatggcctttttactgtttggattataacaaattattgccttttgtttgcacagttgaggctttcagtgagcttaaatgaaaaattccgtcttttggctgtgtaagtttttgcctgcatatgcaaaggcttcataaaataatctctgtgactaaaatttcatttcatctgttctcaatcatcccttaacccagcgctatattaccttatgcctccaattcagtggtagccctctacggaatagaattccactccaacccctcattcatgatgcactaaatgagaatgtaagaatgatgctactgtgtgaagtaggagacactttctcaaaccgtatccctttttttgatgtatgtcaaccagatatctatgttttcaaacaatagtgtttttaagctgtaaatgaaccgtagtactgcttttgtagaactaaaattgtataattgttacatcatcttaattttgcagctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaaggtaaggtgtgttttagatgaaatagagtgcacctaactgaggtttatcatgattgtgtactgacaacgtgattggaaattaatttggtagattattaagtgtttatttctagaaataaaggtagattgttttggagaagaacacagactacactaacatttgttcaagttcagggacattcagagtttgctggaatttctgttggtgtgtcaggatacattcatggaggcctggaagggaggattagtaaaagggaaacaataaagaggctatgctgtgtagttctttttcacaaagtgtggtccatagaatacttgcacgtgaatcacctgagatgctagttaaaaacagttctgggccctgcctttcatgggggtatattggaatctctgaaagaatctgggaatttgcattttaaaatcctaaagtttgataaccacaggcacagagcaactgttggaaaaatttacaggaagattatcagggatagcaataacatgaaataatttatttctttctgtactttctcatagaaacatctaccatttatttgtgtatatttgtgtttttcctccacagactgaatgtggatgtcagttcacgtcaaaactggaaggaatgtttagggatatgagcatctcaaacacaacgatggatgaattcaggcaacatctacaggcaactggtgtaagattctgcgttaatttctacttagatattcatgtaaagtcttttgtaatgggtatattttcatccacttagcagatgacagttgtttctttaaatgtcattagtgacaacatgtgttttatctgtgagtacttaattttccttcacattgcctcttattctgtgtttatgttaaaactttttattcttttaaaatttagttgtttcttcccacttgaaggaatacactgacaatttaataaagagaattattctgttgttaataaagataatacaaatctattataaattgtggaaagagtactgggcttaacacaagtttactgagtttcagtactcttcttttcactttaccccaagattgtgtcatcttgggatagtcacctgaccttcctatacctcactactattattctcctctgtaagtttagcttaaatgggacttacatcctaagggtgcgtagcaggtgaagtgagactataaaaacacagaaattaatgtattataaatgtgtttggtataactccccaaaggtggtgagctggaacttctttagctttggagtctgatgggagttttatgagcatttaatgaaattcagaatttagtttcattttttactctgattttcaacttaaccttaagtttagagaattgtacagtttttaaatttttaaaatcaccgtgtaccactctatggttaaaatgtgtcacaaccatttaacagatttgtgagtcttttcctttggtatctaaatatgagatcatcacttctactggccttatagtctcgcaaaccagatacgtgaaaatacgtaattctgtagaataaccattcatttctatgaaaacattctgactctaatgtaaatagttgtatgatttgctttataaatatcagtgtttacagtggagaagagctgagaggaggaaagatgcaagtccatgacagaaatttcgggtggacaggaaatagtggtgtaattatcctggatttttatttttagattgtttaggaatttatagttaaatctaatatattgatatattttcttgtatttttttgtttgctctagtaagtttttaaatttttttcttccactaatcttacacattgaaagctatagggaagattgggctagatcccatgcatattgatatgggatggatggactgtccactttgtgaccctcccttcccctaaccaacttgcgaatgtataaacagttctccacctcccccagtacaccatctaagagtctcctctatgatcctctcttctgtgcatcatccaagtttattttcagtttccttaaagttaagtaatcatttagtggatacttgtgaagaaatcggagtgtagaatgcttcttgatattcataaactgattcctccccttaaaaatttacattactaaatcattgaggtaagataaaaatggaatgatggtttataacacatcctgaatatcaataatagaaataatatttaatctttaagagtttttgttgtgccttattgttgtttacttaaaaatttaatttgtttaaaggaagaaaataattgtgacagttgatactagcatagaagtagttattcattgtacagatatttgtagagcacctgctctgtagcactggatctatagtgttatagcactggatctgtatgcagaggttgttagaatgtgagctacatgctaaaacgtaaaagttttaattaactgtagttgaaataggtgctggaatattagaaatatgtattaagatagtaaaaatattttaaaactgagacgaaggatattatgctagaattttctctaaaatgatataattgaccccccttgaccttttatttaaaaaggcccaaacttttcagttctcagtgataacagtaagacttgatttatgtgccaaaaactattctttggtcagtgtttttaaattaacataataagcaataattaagctatttgccatgtagttaaaatttgggaaacactgggtgggtctaacctttaaggaaatctgtttttttgccgggtgcgatgtctcacgcctatagtcccagcactttgggaggctgagacgggcagatcatctgaggtcaggagttcgagaccagcctgaccaacatggagaaaccccgtctctactaaaaatacaaaatcagccaggcgtggtgggcatgcctgtaatcccagctactcgggaagctgaggcaggagaatcgtttgaacctgggaggcggaggttgcagtgagccgagatcgtgccattgcattccggcctgggcaacgagcgaaactctgtctcaaaaaaaaaaaaaaaaagaaaagaaaatctgcttttttttaaattagatattagacatggagctaactgctttggtaaatctaacacaatgtctaaacagaacagaaagcaaatcctagttaattttgaggggaatatctctttctgttttacataggtatctttaggtggtgttgatcttacagtccgggtgctcacgacaggatattggcccactcagtcagccacaccaaagtgcaacatcccaccagcaccaagacatgcttttgagatattcagaaggtaaatcaaaatcagactttgtatcactgtgtacaagtaagtgttcaaaattaaaaatgaatttgaacattagtatccgtaattgaggatgaatgtattccatttattacctcgtgatcaaaaggagcatttatcctggcatacagcaatttccccctctataggatcttgatgagtaaagtaaagcaggcataatttatctctagaaagattgtttatatgctggcatttgaaatgccttttatttagagcagcagtaaaaatggaaaaagagaaagtaaatgatgatggaaaactagacccagagaattccttggacttttctgaacacttcagctaactccaattgttggaaatacgtggataccttattcccactagtactcagagtctctgagatggcagttttgatgaggaagaggagcaagatgaaaaaaaaacaagagtgatatgcaagaaaaaaacagagaaagatccaagcaaatattttttttgggctgctgaaaataattggcttatccagtgtggagactgctttgtgaaaagaccactcgtgtgaacactagggatgaagatgagtgtatcacccccttcatcgagcagcctaaggtggacacttagacattgtctgtgagctgattgcacaaggggcagaagtttttgcagtgaccgtagatagctggacacccctgcagggtgcttataagtggaataataccagagtggcttctttatttcttcagcatggtgtagattagttatcagtgaccaaacaaaaggtctcttgacccacttgcatcttgctgctgggatcagagacagcagagctactctagaacatctactggtgaactgttaacctcaaaccagatctgaaaaaacaactgggaagaaactgtatttgatattgccaggaggacaagtatctgtcacgacctctttgaaattgtggaaggcactgtacaaattcttcaccttagtcttaatgattctagtaattgtcttaagtgtccaagtaccagtgccttctttgtgtgagatgtaaaatattcccatagtaaaaggttgacatcaaacatcttactacaaaaaattcattggtacttattaagatgttcttccaggtgaattgcctgaccttgatgtcaaaatgtatttgaaagttgtttgaatatatcttgaatgatttctgtggagtttgtgatttgtatcagaaataatttcgacttgcctacacttaaaaacttgacgtgggttgtacagaaactaaagatatttttggtgctgatccaggagatacgtatttttaaatagcccatatcctggatctttgttgagtattcagcatattgacatgtatctttgtaaggtgaagtaactaagaatttaacttaaaaagcctcgaacattctggtgctattcctgctgtcttctctacattaccatagccagttgctttcattttgaaccagaagcactagcatattattgacttgtagcttcataaattaaaaaaataaaaactagattttgtcttttagaacataggccattttccaggaaagcagctaggttttaatccattaatcttgtatactgtctccaccaccacaattcacataatcctgtagacagtcctgcttcaccctggtcaactgcatgatccttattgtaatagtgaatcagtataacactttagacatgcacacagataacacgctgttgcaagagttcatgatatgtctgctgtccaactagttttatttgcctgatcctactggtttaggcactgcctatagtctcgagttcacagaaatgttgggttttttccctccccaaagtcctcattttttataaactgtagaaaggcaaaatgacaagggaaaaggaattctaagagtgaagggatgattgttatattggggcaagaaccacagagtggctcaggctttggaaaaaatatggtgtggatagtgacaaaaaacataaatataaaaattcaagaaaaactaccagttttgaacaacaaaaacaaagggagagtttatcctttataattttaatatgtaagaaaaaattacataaacttttcccagaggaatattttataaatgtgcattgagtatttttcgtactgtggtataggagtatattttgtactgttgatgtctgctactgacttagaacaaattgattattgggttactatggagaaaggtggtcttaagaacagcaagggctgagcagcagtaggttggggcagagtgtacagtagaaattatttagtgtggggcctttgtcatttaatatctagctgagttacttaggactctctcaaggtcttgcctatagaaagttgaaactgaacttgattcctaaagtttcctttaagttttaaagtccatacacacacacacacacacacaaatgtttaagggatgttatcctgtagtttgtaatttcaaatgtgtaagtttgtttgattttctaaaacctggtttgatttactgaaggttctacttagccaaacacagtggtcgacagctcacactccagcatcatatgggttctgcagatctcaatgccacattttatggaccagttaaaaaggtaaatattgatagtttgaacgtattaagtaacttaaagttagtctattagagctgatgtgtgatttatgttgacctgggtaaattacttacttctgtttctctgcctgtctcacatgttagaaaggttaaaaatcctagctttgatttattacttctgttctctcagttgctaactgcacctttgaaaatatgaagactataccagtatagtcttccctaaggactaaacattaggataattacatattttattcataaaattaggtttgagaaaatattgcataaaatagtaaaatgtaagttgatttcagtgcatacaaagccatgagccccttttcaaaattctgtcacctataatctttatttctaataaatcaagattgggaaaattaacatttgtgatttgttagatatataaatgttattaaagtaatttaaaaaattagtattagaccagtgatttgccttcatttttaaaaagcaatcgcatttttatatctagattgtgaggtttagagtaataatttattttcattacttgatatgaatcaggattttttgccttcagaaaatattaagtcttctagaaaaactgtagaaatatacctaaattgtcatctaggaggcaaataagctttagattttaatgagaattttactagtttggtatgatgaatcactgttaacatcagattaagtattgctgaaaatgcccataaaaatattctaattttgatatttaattgaaatgggaaatagtgctttataatttcgttaaataatattcgacacatatttaagtgtaagtgggaaggacaaggaaactaaagaactcagcttttaattactgcctgcttttgttttaaaagagggttttttttccctaaataatcatgttcttttgaagtttattaagcagatcagtagatttttaaaacatatgcatatgttaattattgaagaattagaaagttccactttgtatcccttaaatcgtaaagcaggaataggctttgagaatggcagttcccccctcctcccccagcccccatgctatgctatgctattttttgatctcttactgtgatcacatcacacagaaagaaacctaatcctgttacttttggtggtagtataacagtagtggtgttttgtaagtctattattattatcatcccatagtgtactgttaaaataattttagcattaaatacagggaattgattagttacttgttcagataacattaaaatgttcacaatggggggacaagggacagtcctaaatactgtttgtgtgtgtgtgcacacattttaaaaaatagatttcctttatataaataagttatgtagttttgttgggggaggatggagattatgggacctatttctgaaacataccattaaagttaccagaaaattggtcaggcgtggtggctcacgcccataatctcagcattttgtgagcctatgcgggcaaatcgctggggcccgttagtttgagaccagcatgggcaacatggcaaaaccccgtttctacaaaaaatacaaaagttagctgggcatgatggtgcacacacatggtcctagttacttgggaggctaaggtaggaggattgcttgagcccaggaggttgaggctgcagtgagctgtgtttgcgccactgcactgtagcctggatgacaaagtgagaccctgtaacatacatatgtacgtacatacatacattaatgttaccaggaaatgattgtgtctttgtttatatttttttaaaaatgaaacaggaagatggatctgaagttggtgttggaggtgcacaagtaactggctctaatacacggaagcacatattgcaagtttccactttccagatgaccatattaatgctctttaataatagagaaaaatacacatttgaggtatggattgtggttatatacattttaactgtgttgtttctaactctcacttgttacttgagtctttcttatttgaataacctttagagagtctctttgggtacttttagagaaaactgtataaaatggatcatggaactgtatgaacatcatacatgtattgagttatgtcttatttttaaattaactttatagaagtacttttatataaaacataccttatataagtagacaatttgatgagttttaaatgagtgcatctttgtaactaccatcacaagaatattgcccgaaaatacagagcattacctccaaaattgcgttgtaccccttgccagtctattccctcctaccacctccagccccaggcagccagtgacctgctttatatcactataaattagttttgtttttttttagactttcatgtaaatggaatcatacatgttgtctgtatgctttaatcctttgtcagttcacctgcatttgggttgataccggatttaggctaagtagagctatatgtttaacattttaagaaactgccgaactgtatcccaaagcaactataccattttccttatttgccagcagtgcaagacggtccagtcgctctacatcatctgcagtctttagattttgagccgctttagttggtgtgtaatagtgtctcattttggatttaattttcttttttttttttgatgatgatgttgagcatcttttatgtgttaatatgccactgatatatcttgtttggtgaagtgtttgtatcttttttgagttgttttcttactacattgtaaaagttctttataaattctggatacaagtccttcgtcagatatatgtgctctgagtatttttttcagtctgttgcttgccttttcattttcttaatggtgtcttttgaagagcagagttttaaaatactgaaaaagtccagttaatcactttgctttttgtagtttgtgctttaagtcctaagaaattattgcctaccctgaatttgtaacgatttacttttattttttcaatagttcgtaattttagcttttacatgtatgtctacgatgaattttaggttaatttttttatatagtataaggtaaggattaagatacatttcccctcacgctgtcagttgtttgttccagcatcatttgttgaaggcactatttttttcccaccgaattaccttgtcgtcattatttaaaaatcaattgatcatatatgggtgggtctatttttatgctgtctgatctgtttcattgatctctatgtctgtctttatgccagttttatgctgtcttgatagtgcagtcatttttctctttgcacccatcttttttcattagagtaactaattttataatatgcttttttttccttttccttttctcccaattaaaatatgatttgattacattaaatccaattagtcttttcctgtacatttaaagggtgttttggggttaaaatgaaggtcatgtgattcacattaagtttaaatttaaggtaatgaatattttgaaagactcaaaattaattccatatttgtacttaattgaaaaccaattttcatatacaggtgagcacaagaaaaaaaatagtgtgtttgaaattaagagcaagttctaggcctatttaatattcatgtccatactcccatttatgtatcccatttatatgggagtatggaagttagtataattaagagagccatcatttttatgtgatatatttaaagggaatgcttgaaatctaggtattttagtagctcagtggctaaattgagaagtttttcttatggatttccatgtgggtcttacctagggagtaaccttgaattttttttacttttatttttattttattattaccttgattttcaagcatgagttatatttgattgagtcccaagaatactgattaagcaagcgttgagtaccttacccaaacctaggcttttcaaacagaggtggaattaaattatctctaacagctgtttttgtgtagtcatttttttaatctgcggctcttaatggataaaatattttaaacaaaattagctacttggtaaatgctagagttgattttcagagtcctggcttataaagacctggtaaaaaataatgggataataaaaaatacgaattcattttttaaagctgttactggaattgctggaaaatttagtggttcaagcttttccttttcccatctgacttggaatcattgatgctaataagcagttattagatggaaggttaaaattaagtagagaatatctgtaagttttccaactttagctaagtcacaaagcagaaactgattgtagtgtatatagaatgccatgcctatggctccaaagccttctggctgctgacacctcaaatctggggcattgtgagaaggcacaagaaatgtatctttactcaacaccacgtgtttctctacagtctgttgctaatgttttattagctagcctttttaaagaaatcacctccacaaattagtggagatagttaaaagtatttaattataataatttaaaggaaggtgaacttttatttttgaatattctgtgtgagttcagtaagatggtgtattgtttaatgccacatgacaaatttcaaaagttagtgatttaaaacaaccactaacaatttattatctctcgtttctgtgggttagggattgagaagatactcagttgggtagttctggcttggggttcatgaggttgcatttagatgttgtctggggttctggtcatctgacggtttgactgaagctggagaatacacttccagggtggttcacatggctggcaaatttgttctggatgttgttaagtggccttagtttctctgcacatgggccttttcatgtggctctttgtcctcaaatcttggtggctggttttcccaagagcgagcaatccagaagacccaggcagaacctgcagtgcctttttgatctttccctggaagacatgtagtgtcacttctcattttcttggttgcccaagtcagccctgatagtgagaggaccacacaagattaacatataccagggttattacgtgctgtcatagaagctggctacaacaggtggcattaatttgtagtgtcatatttaatctgtagtagtcaggctgctgctgaggttttttcttttcatgttttttgaatgactaaaggtaagtttattgtgatttagaacagctaaaaataggaaatacatacagtggtagtctgtaccttggactttagtaattagcagtgggtttttgaaagaggtatggataagaactattaatacatatttttgttaatgttctttattttttataattttatgagaatgagtctgaaatttaaaaactacagacaatagcactattaatgtcagaatttaaatagaaaacttaacagtagtatttgatattcatcaataatttatagcaatcattagggacataacttcacaatatagaaaggaaaatgaaagtacaagggaaagtagacaactcgagaatcatggaaattccttacaaatttattgactaacctgagttgaaaagggggatataggaaatttgaataacacaattagcaagttaaaattgaaggctgtttagcgaactttgaactcagaaggcaaaatagacatactgctctcaggaaatatctgaggctagcataatttttttgctaaaactgagcaaggaaaatacaaaagagaaagaaagcttaaggttattcatcattctgccttgctccttagattctaatacactgaaagcataaatctcaatattagcaagtcatattcagtagtgtattgaaagaataatgcactgtgttcaaaaaggatttatccctacaatacaaagaaaggtcagcataggaaaactttttgaaaagatcgttattaagatattgtaataattgtaaaaacaagcagttgcctaattgccaggcaccattttaaggagaaaaccatttgatctctatagatgaacaaaaagtatttgataaaagccagtcctcattccttataaaagtgggggactcatcgccaccttagaatggattgcccttaatgccataaggttgtatctgatgacaaactaaatcattgtagtagttagtaggaaaatactagacacctttctattagactgaggaacaagatgaagttgcctatctttactactactattatgccttgctctgcaggtcctaatatactaagaagaagaaaggaatgaaattcataagtatcaggaagaaattgaaaaaattatcaaaatctgtagataatatgattgtcaatttggcaatacatgataatcagtgagaaaacatttctttagaagagttttgttggaaagaaaataccttttcagtaaaccagcattaatcagtaaatgacatgaagaaaaggatgttttattaagaatcatagccttcccaggaatcatcttaacaagaactgtgtagacagggtacttataccaagaagacagtaaaagctaaagaatatgaaagggtaaatgtacccaaatgggagaattacaagttataagtgtgctgtttttaaaagtcacctataaattcaaggaaatctgaaatgaaatgtccaaaatatatatatttttaaataaaactcgacaagctgattccataattcatctggacaagaaaatgcacaagattaggcaaaactacttttgaaaagggatgggtcttaggtaggaaagctcagtgaaaggggaaggaatttgtcctaataacaaaacataccatatcacgtttttttaatttataatttttatgggtacatagtacatgtatatatttatgggatacgtgagatatcttgatacaagcatatagtgtgtaataatcacatcagggtaaatggggtatccatcttagcattatttgtgttatgaaaattccggttgtattctctgttattaaaaagtatacaagttaacattatttaaaatgcatagacagacagctcatttgaacaaaagggagttcagaagcaaactaatatatttgtaggtgtctgggatgtgataaatgtctttttttttttttttctttaaagctctgggatgtatgtgcagaacgtgtaagtttgttacataggtatacttgtgccatggtggtctgctgcacccatcaccctgtagggtccagccccacagggtcggttgtttttctccccttgtgcggagacgagagattgtagaaataaagacacaagacaaagagataaaagacagctgggcccgggggaccactaccaccaagacgcggaaaccggtagggccccgaatgcctggctgcgctgttattggatacaaggcaaaaggggcagggtaaggagtgtgagtcatctccaatgattgataaggtcacgtgagtcacctgtccaccagccagggggcccttccctgtttggcagccgaggcagagagagagggggttagagagagaggacagcttatgccgttatttctgcatatcagagacttttagtactttcactaattttgctactgctatctaaaaggcagagccaggtgtacaggatggaacatgaaagcggactaggagcgtgaccactgaagcacagcatcacatggcatgagatggtatctcattgtggttttgatttgcatttccgtaatgaccagggatgatgagcttttattcatgtttgttagcaacacaaatgtcttcttttgagaagtgtctgttcatatcctttgtccactttttgatggggttctttttttcttgtaaatttgcttaagttccttgtagattctggatattagacctttgtcagatggatagatcgcaaaaattttttcacattctgtaggttgcctgttcactctgatgatagtttccttgctgtgcagaagctcgttagtttaattagatcccatttgtcaattctggcttttgttgcagttgcttttggtgttttagtcatgaagtctttgcccatgcctatgtcctgaatggtattgcctacgttttcttctagggtttttatggttttgggtcttatgagtagttttttctctttctgtgaagaaagtcaatggtagcttgatgggaatagcattgaatctgtaaattactttgggcagtatggccattttcacaatattgattcttcctatccatgagcatagaatatttttccatttgtttggtttgtagttctccttgaagagatccttcacgtcctttttaagttgtattcctaggtattttattctctttgtagtaattgtgaacgggagttcactcgtgatttggctgtttgtctattattggtgtataggaatgcttgtgatttctgcacattgattttgtgtcctgagactttgctcaagttgcttatcagcttaaagagtttttgggctgagacgatggggttttccaaatacacaattatgtaatctgcaaacagagacaatttgacttcctctcttcctgtttgaatactttatttctttctgttgcctgattgccctggccagaacttgcaatcctatgttgaatagcagtggtgagagagggcatccttgtcttgtgccagttttcaaagggaatgcttccagcttttgttcattcagtatgatattggctatgggtttgtcatagatagctcttattattttgagatatgttcaatacctagtttattcagtgttcttagcagcaaggggtgttgaattttaccaaaggtcttttctgcatctattgagataatcatgtggttttttcattggttttgtttatgtggtggattacgtttattgatttgcatatgttgaaccagccttgcatcccagggatgaagccaacttgattatggtggataagctttttgatgtgctgctggattcggtttgccagtattttattgagaattttcacatcgatgttcctcagggatactggcctgaaattttctttttttgttgtgtctctgccaggttttggtatcaggatgatgctggcctcataaaatgagttaaggtgaagtccctctttttatattgtttggaatagtttcagaaggaatggtaccagctcctctttgtacttctggtagaattcgactgtgaatccgtctgatcctgggcttttttgggttggtaggctattactgcctcagtttcagaacttgttattggtccattcagggattcaacttcttcctggcttagtcttgggagggtgtatgtgtccaggaatttatgcatttcttccagattttctagtttatttgcataaaagtgtttatagtattccctgatggtagtttgtatttctgtgggatcggtggtgatatccactttatcgttttttattgtgtctatttgattcttctctctcctttattagtctggttagcagtcttatctattttttaatcttttcaaaaaaccagttcctggattcattgatttttttttttgaagagttttctgtttctcttatctccttcagttctgttttctcttatctccttcagttctgatgttagttatttgtcttctgctagcttttgaatttgtttgctcttgcttgtctagttcttttaattgtgatgttagggtgtcaattttagatctttcctgctttctcctgtgggcaattagtgctataaatttccctctacacactgctttagccgtgtcccagagattctggtacgtcgtgtcttagttctcattggtttcaaataacgtatttatttctgccttcattgtgttatttacccactagtcattcaggaacaggttgttcagtttccatgtagttgtacagttttgaatgagtttcttaatcctgagttctaatttgattccactgtggtctgagagactgtttgttacgatttccattcttttgcatttgctgaggagtgttttacttcccattatgtggtcaatattagaataagtgtgatatggtgctgagaagaatatatattctgttgatgtgggatggagagttctatagatgtctgttagtcgagagctgagttcaggtccctgaatatccttgttaattttctgtctcattgatctgtctaatattgacagtggggtatcaaagtctccccctattattgtgtgggagtctgagtctctttgtagagactttatgaatttgctttatgaatctgggtgctcctgtgttgggtgcatatatatttaggatagttagctcttcttgttgcattgatccctttaccattatgtaatgcccttctttgtctttttttatcagagactaggattgcaacccctgcttttttttttttttttttttttggggggggcgggcttggtaaatattcctccatccctttattttgagcctgtgtgtgcctttgcatgtaagatgggtctcctgaatacagcacactgataggccttgactctttatccaatttgccagtctgtgtcttttaattggggcatttagcccctttacgtttaaggtaatattgttatgtgtgaattcgatcctgtcattatgatgttagctagttattttgcccattagttgttgcagtttcttcatagtgtcaatagtctttacattttggtatgtttttgcagtggctggtaccgatttttcttttccatatttagtgcttccttcagaagcccttgtaaggcagacctggtggtgacagaatccctcagcatttgcttgtctgtaaaggattgtatttctcctttgcttatgaagcttagtttggctggatatgatattctgggttgaacattcttctctttaagattgttgaatattggccccccccactctcttctggcttgtagggtttctgcagagggatctgctgttagtctgatgggcttccctttttgggtaacctgacctttctggctgcccttaacattttttccttcatttcaaccttggtgaatctgatgattatgtgtccttggggttgctcttctggaggaatatctttgtggtgttctctgtatttcctgaatttgaatgttggcctgtcttgctaggttggggaagttctcctggttaatatcctgaagtgtgttttccaagttggttccattctccccgtcactttcaggtacaccagtcaaacgtaggtttggtcttttcacatagtcccatatttcttagaggctttgtttgttccttttcattcttttttccctaatcttgtcttcacgctttatttcattaagttgatcttctgtctttgatatcctttcttctgcttgatcgatttggctgttgatacttgtgtgtgcttcacgaagttcttgtgctgtgtttttcagctccatcaggtcatttatggtcttctctaaactggttattctagttagcagttcctgtaaccttttatccaggttcttagcttcttagcttcttagggttagaacatgctcctttagctcagaggagtttgttgttaccccaccttctgaagcctacttctgtcagtttgtcaaactcattctccatccagttttgtgcccttgctggcgaggagttctgatcctttggaggagaagaggcattctagtttttggaattttcatcttttttgcactgggttttcctcatcttcatggatttatctacctttgatctttgatgctgatgacctctggatggggtttttgcatgggcattcttttcgttgatgttgaatgttattgctttctgtttgttagttttccttctaacaatcaggcctctcttctgcaggtctgctgcagtttgctggaggtccactccagaccctgttcacctacgtatcaccagtggaggctgcagaacagcaaagattgctgcctgctccttcctctggaagctttgtcccagaggggcacctgccagatgccagccggagctctcctgtatgaggtgtctgttgacccctgctgggaggtgtctcctgtcagggaggcatgggggacacggacccacttgaggaggcagtctgtcccttcgcagagctggagtgctgcgctgtgggatccactgctctcttcagagccagcaggcaagaacatttaattctgctgaagctgggcccatagctgccttcttcccaggtgctctgtcccagggagatgggagttttatttacaagcccgtgactcaggctgctgcctttctttccgagatgccctgcccagtcaagaggaatctagagaggcagtttggccacagcagctttgccacccgcccagttcgaacttcctggaggccttgtttacactgtgaggggaaaaccgcctactcaagcctcaggaatggtggacgcccctccccccaccaagcttgagtgtcccaggttgacttcagactgctgtgctggcagtgagaatttcaacccagtggatcttagcttgcttgctgggatctgtcggggtgggacccactgagtaagaccacttggctccctggcttcagccccctttccaggggagtggacggttctctctcgctggggttccggctgccactgggatatgaaaaaaaactcctacagctaagttggtatctgcccaaacagccgaccagttttgtgctagaaacccagggtcctggtggtgtaggcacacaagggaatctcctggtctgcgggttgcaaaaactgtgggcaaagcgtagtatttgggccagatagcacagtccctcagggcttcccttggctaggggagggagttccctgaccccttgtgcttcccaggtgaggtgacgccccaccctgcttctgctcaccctctgtgggctgcacccactgtctaaccagtcccattgagatgaaccaggtacctcagttggaaatgcagaaatcacccaccttctgcattagtctcgctgggagctgcagatcggagctgttcctattcggccatcttgccagatctcaaatttgtcgtttctaaaaactgaatttaattgttttttatttgtgggaatgagaagagggtagtattaagacctcaattccatggatcacatcaaatataaaattccagataaatgtgaaaatctaaatataagtgcaaatctatataaataatggaagaaaatgttgaatattttggtaaccttaatgtgagaaatgtctttttaaaaatgtattaccaaaataataaaggaaaagattaacagatttaaccacataagtgataacacatctatatgatgagatatattaagttaaaaatagactaggagaaattacttataacataaaaattgaaaaccataatctataaagagcatcagtaaatcagtatgaaggcaaacaattgagtataaaaacatgaaggaatatagatagagaaagcatagaagattacagatatcctgtaaatataaaaatattttttcccatagtggtcatgagaagtacaaattaaaataatgagatttcatttttagccaaacatgagcaaaagaaaatctggcgttgaagagggtgtgagggagtggatattcatatactatttttgtggggggttaaattgttaagcaacttgaaagcagttcattagtatttatcaaatactaaaaaaaaaaaattttgagacagggtctcattcttgcccagactggagtgcagtggtattatcatgtctcactataacctcgacctcccaggttcaagccatcctcccaccttagcctcatgagtagctgggactacaggctattttttaaatgtttggtagagagcagatcttgctatgttgaccaggctgattttgaattcttgggctcaagtgattttcttactttggtctcccaaagtgctgggattacaggcgtgagcaaccgtgcttggcgcaaatataaaatatttataactttgaggaagcaagtgcatttctagaaatttgcttttgaaaaacaggctttcgtgctcaaagtcagaaatgcatgtaccaacagaacattggatccagtctaaatctccacttgtgtcatgatagaacagtactatggaattccttgtagctttaatctctttttgctagctgaaaaatctgaagaaattaatagaaaaattcatgttatggtctcatttaacactaatactggtgtataggtggatgtgttcgtgtacgttcatgtatatgcatatacttgtattcatgtgtatatatagatgaataggaaaacattgcttttaaaaagtaatttaaatatacaattgattaccagagtgcaggtaaaatagtaatagtaaagataggcatccttatcttgttcctaactctaatagaaagatgtctagtatactaactactgttatgcttaactctctcattatatatacaaccttatgactttaggggcatttcattctgttcttaggcagctaagaattccccactataaggttttaggactgacttttataaaatacttttggtaatagttacctcttgggatgatctgtaatcttaaaataccacctaaggtatttctggttcattgaatatgattaagcaataactaaagtatgtaaataaatcacttttagcatgtatgtaataataaacatcttcattctaataatagcacctattttctgggattagcatttatactatttgaaatgtctaaagtaggtagatataaccagagattatttgaagaaaatgaatatgtgtaatcactgaaaatcacatttctctgaatccttgcctacctgacagttttttaggagaacagaactgttgctcaaagacttgtctagagagaatgactgactctccagatcagttactcgtataatctgaatatcaccatcttcatgcccactcttcataagctgcttttgagaaagagacagatagctgtatacagtgcatcaaagcaataaatcctagtgtcaagacttttactcaatcacatatcactatagacatgtagagactaaatcatataactgtacagtttccttgctgtcccactgacagaatagtgaatttaaaattacacagcattctttcctgagctgctttttctcccctagtattacactttattcataccattcacatcattattcataatacgcagtaaagattattacctgaacttcaaaacagattgcttgttgatatttatgtttaatgtaattccaggtttttttttttcttcatttggtcatagaagcatacatatggtcagtctggatggtaaattttgattgtatggtagaaggcctgagctcaggcttaccttccttttttctatgaaagaaattactaagcaaaagagtagtctggataaacttggatggaagattgtaaaatatttataaaattagcaattatatgttggttaacactttatttttacctaaatgttgaagcaggttcctgataatctctgctggataacatttttggattagccattgtatctcctgaaacaaaaaagtacatgtctttttaatattttataacttgaatcaccctttcctctcgtttgttcaaataatgagattttaatgatgtgtcatagtactcaagagaattcttttttgtgcattatttatttaatggaattacctctttttaactactgcttggtcagtttacttgctaattaactaactttaatctttcaaaaagtctaattatgttaatctgatgaaatttcaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacaggtatctggaattatatttttcctctcaaaaaattatatatttttctctttagaaaaaaaatctcatctattggatttcttttaaaaatactccttttctggtgctgcatgatacttaggcttaagaaagaaagcagcttttattgataagtatttgtatcaaaatgcatttgaatccaagtacagtaagcattttaaaaagtaatttatagtgtgaacaaagtatttcttttcatgtttttcaataaatagaatacagtttatgaacatattggtacttaaaattgtttttaagttgttaactaatagtcagtggaagtctaattttaaagctgatttagaagtttttcagaattgggagacctatataaaagtttgatgtttggatgttgctatttatattttgataaatattttttgtttcaaaatcttaaaacccatatcctctttaatttaaaaacatagaaatgatactgatgtgaatgatttttaatagccatataagtcgataatgaaaattctattcattaaacatttaacataatgtaagatgcttgttttctgtgtatttaaaggggaaaaaaggcactccacccttgctgattgatgtttaaaactaattgtttactacttggcttaaaaactagtattagataggcttcctagtactaatatattcattacagccaaatatgtgtgcaataaaacagtgtcctaagataaataagatgatcttttaaatgactgtcatttgttgattttaaaaaaatgttatttatattgtatattatgatagtctttttaaaagtaatgttaaatatacagttgattaccagagtacatggattctagagctttatatgcacacttaaatttttgtttttcattttgatctttttgtttcgtatgtatactttgtagaacagagtagtgtctctggcaaggctttgccccctttgtcttgtagttgtaaactgtatcatagtaatctgcattagccaagattggcccatgtcttgacataaatatatattaagaataaaacaaaactgtgctagccagtgtcatggaataaaatttatttttcttccaatgcaagacataactactttatacatttgggcagatgcaggttttggattttagggctcatttgtatcctagaattagaggaaaatatgtgggaatatttatctggattgccttaccctcaccctactgtaccctaaataagtaactgtctttgttatcccagattctatcatgtccagcaataataatatcagatattagtattatgtttaaaaaagtcttcgtagatttttagattttcgtgttaagtgtgcacacttacgtgtgtatctggagtatgtgtatgtagtgttttaggtatgttcaaaacagaaatatatatatgatgaatttcactagagcttaaaagttcttttcagcaataaaattctacaaagcaatgtttttttcttgggaatggtttttaaatgatcttggctcttactcatagtttaagtcaaaattttctctttggtggtaaatattgtgaccacattggttttactgtcaaaggctcagtaacataatcaaatattcgaagactcagactctacctatttatgctgcttttactgtagccagtagtaaaagttcatgcaaagaagttaaaggaattactaaaataacacagcctttgaaaagaattagattaattgtaatctgggggggcagtttccagagttgacagtcttcaccaccaccaccaccaccacctgcctttctcaaattccatcccccagcgtgcatataggtcatatataggcacttgcacaacaacaaccccttctgctgcactcaagtgaggagtattgtgttaggctccagagtgagcccctcccctcccatttaaaaagaatactcattttgactcatcagcacgatctgcacatccatgtttttctgcaggtatttaagaagacacttatttaggtgaccacatccagatgagccaaagggattgtttaaacaactacttttttccctgcaactttgtattttttgttttcaaatccacaaagaaagtgaaaagcactataatgaatatcaatatggctgtgacctacgtttaccagtcattagaattttgtcttcctccctgccttcctctgtgtgtgtgtatgtgtttgctacagcatttgaagttaatttacaaatatctcagtagtttccccctaaaaaactttagcacacgtctcctatatcatatccaagaaaattaatttcatgtcatctgtttaccacccatattgcctcagttgtctcaaaaatttcttttatatctcactttttggatccatgattccatcaagatttccacattacatttaatttttatgtctttttagtttcatttaaaccagtacctctatctttttattttttcatgacatcaacttctgaggaaaagcatcataagcatcattcttagtagattattttcatcgaattttttttttttttactaagatattgattatcttacacttgggaaatgacaccgaaagcagtatttttatccaaaggattctaattagaaacagttgaatggatacgcacaccagaatgatcttctaaattgtacaatctgctgtctcgtggctatctatgcccatgcctcagtcagcaatgccccatgtgctgctttgcaattttacggtttctacctccagaaacttcacatctatctccttttggtgaacgaataaaacaccagttttctttttctgctatttcattcagagcagagttgcaggagaagacgacttctgtatttcccttaacagttgctttgaagactatagggaagaatagagtaagactcctaaagattggaatctggtatgaatttgtgatgaggttgtgacataaaaagcataataaaatatatgacaagaaatggttagataacagaactctagggagatttttggcaaggagattttaggaactgacatcctagtggtacttttaaattatttatttcactgactgaatcttggcagtacatactcttgtctcctcataaagccttagagattacagctacattttgagttagtaagacaacagatacctatctgagatacttttggtgagttttaacttggagccatggtaataaaataatcaattgacctctgatagtcataagcaatgaaaattatttactggtaattttactactgaatattttcagctactgtttttcttccaggtaagaaattatattctgcataaaaacaaaatcaactttattatctcaaagttaaattcctcatttttgaaaaggataatttagtattcaagtaaacattaaataagacagtttttgaatgcgtacttgaattaataagtgtgtatattcagaggctgaaattggtttttatctgtggattacattgaattataataagcttgcttataaaccaaattttaaaattagatttatgataaatgtctttatttctattttagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtgaggactcttcactactgggctaatatagaaaaaacagtaacattattaacaaaattattgtattcaactaattttaaaaacaattttacaattaagaaatcctagtgatgtaacacttatgaaatgtatggcactcacttggtaactaaacatggtgatacatccaaatatgtgcacactctcggaaccaatgtgtttataactaaaatgatagtagaatattgtcacatgaagtattaagaaaagattttcactgctattaatacctttgtgtaaacaaactccctttacttctaaaaattaataatggttaccattcattaaatgctttcattttacaaattgggaaactaaggaggggaagaccccttaggaagccattaagataggtgggagaggattaggacctgggtaaagtattggtagagggtagaaaactgaatcaagataattgggaagtagaattgacagactttactgattgataatgggaagtgagagggagaagttgaagacgccgtttaggtttctggcttgaatgagtagatagaggtttgtttctttaaccaaaaagagaagggtaatgtaatgtgccgctgtggtccagatgtcacttaatattgttttgtacaagttgactttattgtgtattggcacatccaggggcaggtggaagacaatagacatgagggctagaagttgcattgggaattagctatatgagaatgcagttaaaactacaggtgtggattaaattgctcagtgttagcatggagagcaagaaagaactatgggatagacccctcccttattttaggaacagtgagtgtaacaacagaaactctttagagcactggttttcacagtgtggttcttggaacagctaccttagcatcacctgggaactcatgagaaacacagatccttaggttccaccagagcctgagaattgaatcagaaactctgaggatagggcccaagagtctggttttttaacacgagctgtaggtgattctgatgttttttcaaatttgagaacactgctttagaaggaaaagaaaacaaaatgacagtgtcctatgacaagggaagagaattacaaggagtgagtggtcagtaatataaaaaatcatggaaaaaccaagttgaataaacactttggcaattacgtgacaggttaactttctcagacattttcattggactcgtgaaagtggatatccagtggtagtgccttgagaaggaaatggaggtggaaaccaccaagagtggcttattctttgaggtattggctcaagggaaagggcagagagagtagtattagaggattcagtgtagagttgaagggtttgggctttttcccccccaaaatgggaggatactgagcatgtttatatcctatgaataaagaatggatccttaaattgaaaaaaatgagatgaagggataaataccacattctagaaaaggaaaggtgaggattgtatagagagtatgatgatggtagtgtactgacacagatgttactgaacatgcctcttcctgagaacctagggcagggtgcaggggtatgtgctaagcaagatttggtgtaagtatggataaatgtacatgtgtagggtgggtatttaaagaacttcaaattgaaatggcttcttttctctatgtgaaacccgatgtgagcttggtgcaggactgggttgaggagtttaaggggattgtcagaaatttgaaataatacttgtcgaagaatggtgctcaggaacttgctgaacttttgaatactataaatttgtgttagtctacaccagagattggcagatgtttttgtaaatggccaattgtagcatgaaagcagctatagataatacataaatgcgtgtgactcgcggtggctcacgcctgtaatcccagcaccttgggaggccaaggtgggcggatcacctgcggtcaggagttcaagaccagcctgacaaacacagcgaaaccccgtcctactgaaaatacaaaaattagctggtggtgggtgcctgtaatcccaactactcgggaggctgaggcaggagaattgcttgaagctgggaggcgaaggttgcagtgagccgagatcgtgccattgtactccaccctgggcgacagagcgagactccatctcaaaaaaaaaactaataaaaaataaataaatacatgtgactgtgtttcagtaaaattttacagaaacaggtagtggggtgtatttggcctgtgactgcagtttgctgactcctggtgtacacatacggtgttaacaactacatctttactcagcaaagacctctgtggtaggttgataatgatgtagtacatatagaatataggtttaatcaaatagtgtttatgggataggaccaaaagaatcaggagtagaaggtcctgttgagagtgcagctttcaagagaagtgatcttgaatgcagtttaggctcggttaaacaggggagggagcaagtcgataggagctgttaataggctggaagaaaagaagggcaaagggtgggagatctcaggtgatgggttgagagcaagtttgtcgatacaggagtggtaatcctggaagggcgataaattgtagttgcagaatgaagtgctgaattttcagattccaaagaattatcaatccattgtggctttgggaaatgaactgatcaacaagagtaaaagcaaagctggctcatggatgcattagagcaaagaacatggactttgaggtcagaaaggtttagattcatctctgttggctctgttatttactacttgttgatgtcagttttcttctccggctttattttcctcgtttgtaaaatgagacaacttattttgcagggttaagaacattaaataggccgggcacggtggctcacgcctgtaatcccagcactttgggaggccgaggcaggcagatcacaaggtcaggagatcgagaccatcctggctaacatgatgaaaccccgtctctactaaaagtacaaaaaattagccgggtgtggtggtggacgcctgtagtcccagctactcaggaggctgaggcaggagaatggtgggaacccgggaggcggagcttgcagtgagcggagattgcgctgctgcactccagcctgggcaacagagcaagactcgatctcaaaaaagaaaaaataaattaaataaactcatacatgcaaaatgacagatgaatagtgcatagacagactatgactgctgctttagttattattttattattatatatagcacagtacttagaatcctgatagtacttggaaaaaaccaacagaagcacttactatgattgggcagcattattctttattctaaggcattacatctgttaacacatttagtgtacacaccagtgggccaaggtcccagagctagtagtggtagagctgagtttatccaggtactctgagtccggagtttgtgttctttaatacataggctacccaagttctgtgagttttgagtataactcagaattcagtagataacagcatcaaaacggttaaactataggtggcatatgctcacactactgtaattccaactaattcaattattcaactgctatccactttagcattcacattctgatttgaggaagtgtgttgtaaccataatattacattttcaaacagaacctttttaaagtttctgtgcttttatctttggtaatccagttagtaaagttcagtctctgagtgttaaaatgacatatcagttctgttcaaagatacgaatttttatgtgtttatataaaaatactatctactttcttttttaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtaagttgggtaacaaaaatggcaaaagaaatgcagatttcccagttatcttgctctgaagacatttctttagctagtcttatttaattttaaaggtttgataaatatacaaagacccaagcatacaatttgagcatgctgtattctaccacttgcacttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtatagggtggtgtttttatttcatttattgtagacaaaaataatgaatttagtatacacatacccactaattcaagtatgtcagagcacaaagttggcagctggttatatttaattcagcccctctgaaaagcacatacagtctatactttgtttataaataccctaggtcctccctgcccctaaatatatattttggtgaagctgtggtgcactattaattttctgtttcaaaatgcaatctaaagatgcaataaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatatttttccccatgcgtcttgggttataattttccttttagacttgcaaatatgcttttattgcaattttgtctccatctgtactgtagaattacaagccttgtgctctttatctctacattttccacttctacatgatgcaattaagatgccaatgaaaagtattgtgaacattattctcaggacacttttaccatacttgagtagtactaagtcaggtgtaacatggaaagctaagggtttcaccttctgattttgacataattggaaattttctataatggtaagatgtttataggaaagtaatggtagttcatgtttgagaatttttttattgctttcatttcccagttaaatgatatttaacacctgggaaaacaggacagctcagattgtcgagttagtaaacatgagcgatgtaaaaactttatttgaaatctcctaagtgagacattaaacattttagtgctagtttaagccattaaaagtaaagtttaagtttacgtcattgtctcaagtgtggctgtaaaaatcagatctagagtttagagacatacttgttaactttggagcacaggtttgatatttatgcttctaaatacattaaaacatttctgaattgcagttgaatggttggagattgctggcgatgtgatgctgcactgaaaaaactggtcacacaaaatgtttatatgtttgactgcataagtattattttaggtcataaaggttataacaaaatacatttaacattgctttctttttagcaagaggtcacagatgctattttttctcagtttttaatgctttaatttgaaagaaaaatgcatcctaaccattccatcctgttggtgcagagaaattttggtgatttattagaagacttttaaggagggtggatacatagtttttcaactgcaaaaatcatgtcatctcttcagtaactgttaaagtgtaattctctgccttcattatcaagtccaggacagtgtttattttgaatcgttaacattatttaaagactgaaaattcattgcaattagggaacgcacagcctcacaaaaagtggttgtgattgcaaggattctttatgtcagtgaacttaaaaagggaatgggggaagagatgcatgcctttctaaaggtatgctagagtcacctgtgtagcattgtaattatgtactatcaaacccccaagatgctgatgataggccttctctgtaagaatccttctcatagtgaagcactgttgatgttttgttcaccggatatgttgggtagcagaaaaggcctagaaccagttttaagattatgcctacatctctagaagactagtacactggcatcatcttaggtttctaaatattatttaattccttaatttggaaagcagttttaatgtttacagtttaagatactcattttcagtaactagtgttaaagatttttatctttgcctgtctactgtaacttaagactttcatagaataattttttatagagtatatggtatattgtgtcaatcttggaaggaaagctgttgcatatcaattgtaggtcatgtattttactatatgttgcatagtattttgcattctgtaaatacgaatgttaaaacatttcaggtcagcaaaattagaagtcatttctagtcctcaaagcagaaataattagaaatgttaacatttaagtgcttatcatatgccagatactattctgaatattttatgtatattcattcatttagttgtcatattggctttatgtgacataactgtcattataccagtgttgtccaaggttgctagcaggaaatggcagagccaggagttggacctaggtttaatcctatccatattccatgttacaaattgacacgattttccatattaaaaaattttcatttattttgtacctcattcacatgaatagtaatgtgacaaactaaagttaatacatgaagcattgcaatatggaattttgcacatttttgttagctttacattatttgctgataccaacttttggtaggaaggaaaacagggaaggtgattgctgctattctggaatgtgtccattgaaaagaaaataggcgctttgtctcctacaatcttagagaaagttttacatacttaagtgggtaccacagataggcatgtaccttaaattcaaatctacagttttacaaaatgttttcctttgtgtgcctttcctatgtcaaattagccagaaggaagaagagacgttaagaatggcagataaatttaacaggtaatgatacagagattggccattacgccagctctcaggagaaaaacaactaggatgtcttgaaacccgtgcatttaattttagaaatggcaaatttgtaagcgtgtcatttaagtaatttgatgctcagttttagggtctaagttgacctcgagtgagccatgcaaaaatagctttaaaattatacatgagcagctcaaagtaaacgtgtattttttagtaacaatgaaattgtcaaatttcaagattttaataacaggacagttcaactaataaactttattgcatacaagatttattgcaatgtgggaaaattaaaattctcagtctcagaattctttctgcagttgtgattcttgaataaatgcctcagcacgatgtctggtatgtagtggatgtaggcactcagtaaatcttcagatgaatgtgctaaatgatcactcagtgtcttgaaagaaaatctttaaaagaattgaacttcacattaaaatttgtactgcactattggggctatgacagtataaggatatttttataagtagaagttatttgatacttgactttaggtaaaaagtggaaaatacagaccagctcttacgtggttgcagatgggtgtgtgtatgtgtgtgtgtgtgtgtatgtgtgtgtacagcatcttgctctgtcatccaggctggagtacactggcataattgcggctcactacaccctcaacctcaatctcctggcctcaagcgatcctcccacctcagcctctcaagtagctgggagcacaagtgcacaccaccatgcaagcctttttttttttttttttttttttgttgttgttgttgtaagtagagacagggtcttgctgtgttgcctaggctgtcatcaaaccgctaggctcaagcaatcctcctgcctcgccctgccaaagcgctaggataacaggcatgagctactgttcccagccggcatgttgtgttaaatgctgacttctaagccctcttgcatagcatctctgtgataagaacttgaccggtattagatcatttggtcctatggagagcctgtgaaaaaactcaggcttagtgacataaaaatttttacgaaatcccactaatagttaatggggtgcaggaatttggacccaagtctcttaattccaaaacctgtgcttttaaaagcgtgtgtccccaattactggctgttttggcagactgcacagaaccttgaaaattgaatttgaatctgaaggtagattttcttggcacatattttggtgaaagtttgcattgttttattagaaaatgtttttggagaacttgatcttgtaaaactttatagatccttcacaaaaaataggcaatatcagctatgcatgttggtatatggtataaagtattttctttctcataagtttatacaactgatgtcagatattaatacctacagaatgaacctttttactttctatgtaatactatcttctgtattaaaaaatttttctaatggaatggaattgtagactgaaagagactgaggaagcttacctcaagagtgtgaaatcaagtgaggaaaaggacagaatttgcatttgttccagtgcaactctagcaataggcaaccagtgtatgtgtgtgactataaaatagacggtcacaaacctatttcaacatctacatctgatgggggagagggtgctgaggagggtacccctcagggcaagaaagtctgtatgcatactgtgttcatcgcattttaaagattctcctcttaagcttgcctacagactcatgcaatactcctaagagtcctttttttttttttttttttttaccaaaattagtattatccaagtttgtaataaggcatccatattctccagtcttcccttgagctaattaaaaattaatgcaagccaccaggcccggtagctcacacctgtaatcccagcactttgggaggccgaggtgggcggatcacctgaggtcgggagtttgagaccagcctgaccaacatggagaaactccgtctgtactaaaaatacaaaattagtcgggcgtagtggcacatgcctgtaatctcagctactcaggaggctgaggcaggagaatcacttgaacccgggaggcgggggttgtgagccgagatcgctccattgcactccagcctgggcaacaagagtgaaactcaaaaaaaaaaaaaaaaaatgtaagccattttcatagaaatgaaagtttgtaatcattaaggctatacaagagtgctatagatttttaaaagcaattccaaaagaagcgtggcaagtgctttggtgtttttcaatctagcttcacaccagattttcc

SEQ ID NO: 13305 - DNA, 68452 bp, Human
gccaggagatcgagaccatcctggctaccacggtgaaaccctgtctctactaaaaaaatacaaaaaaattagccgggtgtggtggtgggtgcctgtagtctcagctacttggggggctgaggcggaagattgtgccactgcactctagcctgggcgacagagcgagactccgtctcaaaaaaaaaaaaaaaaaaagctatttctgtaatgagcatcactggagagttagttgctatgggtctaaaggacaatatgaggcagttatagtaactttccatgatatgaacaaagaaattgaaaatgttagatacatttacaagaagatgtagaaaaaactttagtcaaaatttttgaaatattttttgaaatattaaactatgaaatcagacagtcttatctatggtctcaagccatgtctgtctgtaccttttttttttttatctcatttcagggaatattacactggctgacttattaatatcttctgagccagaaaatgtaaggaagctgcattttcagaattgcatttgagtcatttgtgaaattgcatattacaatttgccgccatttctaacagtcctataacttttttttttttttttcttaactgggtgttcacattcatgccaatgacctctaggggctagtttctcttctagctcaagagaattgctgcagagttggaagtaaggacaaaaatgtgtatgcttcatgtttgatttcaaatgcatagaaaattagaaacttaaggtatgcaagggatttgtgtggaatttaagtacctttgaggggcagtggacaggacaaaaagttattttttacctgtttgtttacaaatagcaaagatcaagactgaaacacatgagtgtgatttagaaagagttggctgcaggtgctgcttgctcaggtggttcatttaaactgcaggtcagagcaaccttgtctcatggtcctggtgcccaggtatcaggttgggtctgtcttgctgcttatgtccttgttaccctctgagggccccagtccaacgcagatcaataaagaataagttacataaatatgctcataggtggtcattcctagacaagaaattgacaacatttcattcaacagtatctgggctctacaggacagacatgcctccatttatgcaacaaataagaacagcatctcatgacagtggagaaaacatgggatgtgcaggtaggtaggtaaagttgggtggaaactttcaccctaccaaatgcacatgggtgactttataaaataaatgttagctctctgagcctcagttttcccatctgtaaaatagacagtcccagggaattttcaaggattaaatgaaataaaagtgaatcaacctatgcaagcctgcctactgtggtgtccaggctagaaaaatgctcaataaatattaggtttgtttttatttctacaaaagatgtgatcctaaagagctctatccaaattcaagtttcaaatgtcaaatcacattttgtgaactttatgttcagttgagatgatctctgacatattaattagtaatcctatctttttcattcatcaccaccaaaaaaaggtgttattgcacgttcaattaatctttcccctttattaattccataagtgtagggttttatctctcagattctcttaaaacagaccaatttatacccacataatataaataagcttgttcctataacactctggagcagataactatcccagaacccaaatcctcctacttggcttcaagctcagagaataaagcaacaatccaaaggcaccctttggcatgacacccttctagacatctgtagcattcctcctttccctccacttttcctattagcttttgctttcttgccttttacagggttttgttttgcctcttggtagtttctttcctacggaaaattctccctctgatctttccaagtcaaaggcttcagcaaacatttgttgaacgcgtggattgtgctaggtgggtgttatggaccatggagaatgctagagatgtaagacatgcgctgtccaatcgcagcgcaggttgtgttgacaggtaagatgagggctgtgggggagccaatgtgcacgttccactgggctaatgtgctcttcaccttatttaggctcttggctttgggatgtgtaagactttgctagacagagaaggggtggggtgagaagatgaggaaggtgcaccttttatggagaggctttccttcctcttcacagcaaaccatacctgtactacattgacttcctttgctttcccaggtgacatctagctcatgctgcaagctcatcttgttaatcataaatgctagtaagttaatattacccatcatatataacatgacttaattttaacaattcaatgctttatccccaaaagatgacttaatggtgacaatttcaatccccattgtaggatattttggagacaggcagtcctttcaatgtcatatgtgggtgcttccttaggcaggtcaggggtgaggtggaaatgaggctgggaccctgctcacttatatagcaggcatcgttctcaataccaggcttcagggggctttttggtctagccattggtatgaactgcctcaagaataatcccttcatcattgtggtcacaattcaggtagaattggaataatcatcctctccactctgcattaaaccaggcaaagtttccatctctgggtaccattgtctttcttgatggacagggtgagtcagaaggaaacttactcactcccattcattttctgcttattatttcctgcagtgaggtttccttgtataataaacagcttctgtgggtgtttgagctgctctgaaaagagaacatgctgttcctgtgtgtagaatgccttctgaaggaagcatcacagtgaacacagagcagaagcttggcacacaggtggcagaagtttgtctgcagtgttctgcatagagcagagagtcaagccattttcattctgattgattggaggcatggtatggaggtaaatgggtccttggcctctctcctggattcaagtccttcttagccactgataggtcatgtgaccatagggaggttgtttaaccttcctgaacattcattttctcaagtataaaatgggggtaatagaatttgccttataggcttgcgtataaaataagaattattgagagaaagcggggcataaatgtccaataagcggtagctgtctatgaagccactgttgttactgggttcctttctcactaggtggcttcaggtagctgacagaagctctgtgagcctcaatttcctcactggaaaagtggagtcaatatctcactgagctggtgtgaggattaaatgagatgctgtgcaggtgcttagcacagcgtcaggtatgatgttaatattgatagatgcattttcttcaccctcacctatctttttctgcctgttggcttatggttgaaattccttcatgacggtttccatttccagagatatcttgttaacaagtatataccaccaaatgaagctgatttttttttttttttttttttttgagacagagtctcgctctgtcgcccaggctggaatgcagtggcgcgatcttggctcactgcaacctccgcctcccatgttcaagcgattctcctgcctcagcctcctgagtagctgggattactggcatgtgccaccacgtccagccaatttttgtatttttagtagagacgaggtttcaccatgttggtcaggctggtctcaaactcctgacctcgtgatccacctgcctcggcctcccaaagtgctgagattataggtgtgagccaccatgcctggccatgaagctgatttttttaaaccatcatttaacattttctccataaggtggcaaggaggaagagcatatggggactgggtactttgagagaccccaggacaggagacagggaggctgagattggcatgttgtctgctgcagttatttgccagcgacacactcttcccgtccaaactaacttctctgcctcaaggacagggagactctgcctttcaacctgagagaaaccaggactctcagctttaatgaaaattggacttagggtggggcagtggagacttttcacagctattgtttagctgatgaagcagatgcttctccatctttggagcctgtcttcattacctgtggacctcatctttatcaacccagagcacacttgcgtctctctattttggctaaacaccaaacagctgaggctggtactgtaaaactttccctccaaatgccccccctcgtcttcctctattagagatctggatcacaaccctcaaaaaccatgtcccttatgccacctgagtagatggtttgatgattaattaggcacagatgtgacactggggggttctcacaatggcctgtgggtcacatgctactttccttttcattttcatcagcaacagctgccttaaagccagttaagactgtggtcctagtctcgcaccctggggctcctgctggggtgggtgaggggaacaccccattaagctgggggaactggggctgccaccagggggcgcgaggggccttcgcccgagaagaggggtgggcaggtgcctccagcggagaagggcgccgtggccggaggcacaggtctccccggtgccacttcaagtgagttcgaggaagtacctgggatctttgatctaacgcgaaaggccttcccagtgacctcttgagagctgagaacccactccctccacctctagtccacggctttgccactccagggcccgaggttacgtttgctgctggggatttgacaaacccaaagcctctctggtttcaccactggctccttagaatcagacatctgttctgaatgacacttatgtgagtcaggggctgaggacgtgatcctcgaagtgtggtccccagactggctgtatcagtgtcggcatcccccaggacctggttggaaatgcatattctcaggccctactccagacctcttaaatctgagactggggctgcggggagcgccatctgtgcgccactatccttgtgggtggaccaggagtcggttcgagggtgctcccacttagaggtcacgcgcggcgtcgggcgttcctgagaccgtcgggctccctggctcggtcacgtgggctcaggcactactcccctctaccctcctctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaaggtaagcgccccttcgctcgaggtgtggtttaattgtctcattttgtttgaaatcctgcggtgagaaaccagtcgtgttgagaacaataaaagaccaaaaaacgatcaccaaaaccaactgtcctgaaagctactggaaagttggaaaatgcatgctttgattaaatgtcttcattcaagacactggcaagttaacttatttagtttgtgccgtgagctctgggttgattgtgctaatatgaataactgaaaaacattttatttccctatggttttcctcgatggacttccccactatgggtgaaatgacaatggagttgaatacactttctgattgaactttgagggcctgggaagatgtacacgtctcaggcaagatgataggggttttaaaatgtattaattggcattccttagccatgtcagcaagctgcgttcctcctttcctgggcagaccaagctaagctctaactggtctcctttatttgctgaagaggagtccaacaactgccctctaacaccctgcgtgttattcttattggaaggacaatattaagtcaagtgaatgtcatttttgtgaaaaaactttgagtggacttctatttaggaagataaggttgatttaattttactcgctgtttaaaaagcaggattgtgttttggtgtggtaggcaacattttggaggacagactttgccttattttgttatatttctagtatttacatgggcattccattagaaagttttacttttgctctaagtttcgtaactcggtgtctagtgaggggaaacatgtttgtaatttaaaaagtgaacatgtgaaaggaaaggcttttctgagagtgttgtaaaacaaatgtaacgtgactatgaaaagaacatgattaacatctttgactcctattttttctgaagaaaatgtattttgatatgagttctagaagaaggaaactataaggatctgttcatcaacaggcattagagtatacaccgtaggattgcattttacgttcaagcatttttttagatgaatttctgaaacattcttattttaaaagccatcagatgcttgttaacacttaagtcttgctcaagacatagaagtttctgaaatcaattaacatgtttaggacacatttcgtagtgttctgagggatgtgaataaatctaatcacagtttacatttcttaatgtatttataattcagaaaaggtagaatttagtagtaaattcaactcataaccatataattaacatttaatagatattgatatgttcacttttaagaataagaaggaaattttctataagtgtatgttgaacacataataattcaaaattcatgtgataattttaggtgatgctttgagtcgttttatagaatataaatatggataaaatataaaatactgaaggctgaactcaaagtgtttaatgataagtttttgataatacatctagaaaccttgagaattgtatgcttgaacgttagatttcataattcagtgtctagcacattgttttatatgcaatagcactttaaaaaaattaggctacagcagtataatttacatacagtaaaatttagcctctgtaaatgtacctctatgaattctgacagatgcacagtcatgtaaccagcaccgcacacatgacacagaacagttccattaccccaaaagtcccctttgtacctctacctaccccactgcccctgaaaatcactgatcaaaactacataatgattatgtggttttgctctttagtacgtttttacttagacatattttcctttacttcttttgaaagaaaaacctgtttttccctttttataggatgagtcagtttgtgctatttttaattctagtaccttgggataaatcaaggcaaagacaatgctatttgcaaatgggaaacttgagacttggactaagtgttaaattcatatagggctaatagatttagttcttagcagatttagattctattgtggtttaagcctttggttatggcatatatcattagttatcctgaattgaaatacaaggccattaaaagttatttatatcatattaatagaatgcatcattcttttataatctttgaattttaaaacttctttattaaaaaaaaaactacttttcattatacctgagattaagaaagctacctgaaattgcatattatcaaatagtgagaagcaaaacagggattgaaaatgacaaattgaagacatttaaaatgcagagtgattacaattgctgaaggtaaaatatttatcttcataggggcttaggtctgtgtccaacttatttgtagatgtcaggatttttaaatttctgtgctcatgtcttgaagtctagattttcctgcagggtggagatgtataaccttttgtaaactaatatttttcactgtttaacacagtattcaattcagtatacagttaggagcctgttattggtaggtactgctaacatatatatatataaaattgatgtctttttcctttttcctttgttctatgaaaaacagcctgtattttaaatatgtaacttaccttgcatacccagttacagtggtagtaactaggatatgcagagtggcaagtttatgaggagctagcaaactggatagttggccttcctagctggaattatgacaggtcttgaaaatgaagggcttttagtggagaatctttgtgtgggtgtacttgagagagggcaggagagttagggtgacctagaaagatagattgctggacttgtatatgtttcctcaaagccagactgcagcattttgttagtaaattgttgtgtgttctactgtcaaacccaggcctggaaggggagttgagtgcattcagcctaacttctggattggctgtgtcatcttgaatcccttcactcggaattctctctgaccctgtcccaaatgaatatttgaatttggtccagttcctacagagcatggtctgtggctgttgttggtgttagggaagagcagaaacttgctgttgagagagaagacacttgagaagactgatgaactctctcccacccctgccttcgaggcttggtcctcctaccctattcaaacccttgaaactctttcctatccaactaaataagcgccaattggttactaggagaattagcttttcctcattttagaaggaaacagggtttccttatgtacatgttcttaagaattacatgcaaatcagttattaatgatgagttctctggtgattttggagtgttttatcttcctaatattaaattaattgagggccttaatattttgttttgaaagaatatatttaaaaaggctgggtgtggtggctcacgcctgtaatctcagcactttgggaggcctaggtggctggatcacttgagggcaggagttcaagaccagcctggccaaataatgaaaccttgtctctgttaagaatacaaaaaattagctggccatggtggctcaagcctgtagtcccagctactcaggaggctgaggcatgagaattgcttgaacctgggaggccgagtttacagtgagccgcgatcatgccactgcattccagcctgggcaacaaagcaagactctatctctaaataaataaataaataaataaataagaatacatttaaagataataattggccaggtgtggtggttcatgcctgtgatcacagcactttgggaggccgaggtgggaggattgcttgaggcaaggagttcaagatcaatctgggcaacacagtgagaccctatctctacaaaaatttaaaaatcagctgggcatgatggtgcatgcctttagtcccagctacttggggggctgagtttggaggatcccttgagcccaggagatcaaggctgcagtaggccatgatcttgccactacactctagcctgagttacagagctagagtataacccccaccccccaaaaaagctaataattgtcaaacagctacttatgcacatcaaggatgcttgttgcttaagaaatctttttaaatcttttccatgaaattccttctagttgctgctttgtgagcgtgaattttttacttctgcaggacacacaaatgtggagcatttgaactgaatgcttgggaaagtgtgatgggcaggtggaagaagaatagggatgaggacttatcctctattcttatcctcctagacttatcctcctagtctgcaagcttgagaatatggcatcaggaatatgtggcattttgtccacacacacagtgttggcaggctaccagcagcccagctatctggactaggggtgatggatttctgtggacagaagtcaaaaagtaaaattaggaggcaaaaatcttcagggtggccataaagacattgtaacttgtctggaaattccaaccaacactaaatgtgtatccagtgatataccaatagactggcttcatcttcttggatgtgtaataataccttacagaatgctttctttttttttttctttttctttttctttattttttttgaaatgaagttttgctcttgttgcccaggctggagtgtaatggcacaatctcagctcactgcaacctccacctcccaggttcaagcgattgtcctgcctcatcctcccgagtagctgggattacaggcatgtgccaccatgcccggctaattttgtatttttagtagagacggggtttctccatgttggttaggctggtctcaaactcccgacctcaggtgatctgcccaccttggcctcccaaagtgctggggttacaggcgtgagccactgcgcccggcctcagaatcctttcacagacatcatctcatttcaccctcagagcaccgtgaaaaggtacagcaccaaataggtacctgattctactgaagaagatgtggcagctcagggagtttgtggatttgtctaagattgcctggctttcaggcagagctggggctagaatgaatgttctgctctatccattgatagaatatacataagaacaggcttgatggtggctgaccttttttttttttttttttttgagacagagttttgctcttgtcacctaggttggagtgcagtggcgtgatctcggctcaccgcaacctccacctcctgggttcaagcgattctcctgcctcagccttctgagtagctgggtttacaggcaagcgctgccacacccggctaattttgtatttttagtagagactgggtttctccatgttggccaggctggtcccgaactcctgatttcaggtgatctgcccaccttggcctctcaaagtgctgggattacaggcatgagccacccgcgcccgggtgactgatttcttattaactagatttacaggtgctttgataaaaaccagtctagtcttggctggcacggtggctcatgcctgtaatcccagcactttgggagcccaaggcgggcgggtcacgaggtcaagagatcaagaccatcctggctaacatggtgaaaccccgtctctactaaaaaatagaaaaaattagctgggcatggtggcgggcacctgtagtcccagctacttgagaggctgaggcaggagaatggctgaacccgggaggtggagcttgcagtgagccaagattgcaccactgcactccagcctgggcaacagagcaagactccatctcaaaaaaaaaaaaaaaaaagtgtagtctttttggagtgtttttctgccatttctagggccaaactttttcttgtccatgaatcattgtcaaaattgggaattttaaatactacttttttcttttaattcaaaagccatagtatgtttcccagccagtacattagaacaccatgcacgatcccatgtgtacaaaaagctttctggctgaattcagatgtgacctgagagggccaaatacaggggtgtgtgctgggagagagagagaggtctctggacagaaaacaaagcctgttcaccacccaggatatggaccaactattttaggttatggtgactaaagaaaattgacatgcaaataaatgaataattcttagaatcaggatgtctgggtactggttctttggttggccaggtgaaattccatgccaggcccaacaattaaactctttagagacaattttttcctgttgtaccagaacattgtactgaggccatgtttgaacattcaatcgatgtgttgggaaaactctgccctacaatgttaaagaaattaaatcttttggggagtctttcctttgaccagtttatatctctgttttagaggagggcttctcaaccagaatgggtttgttgacttatttttacagacctctggtagaaaggaggtctttttttgctacctgttctcctgtctcagagaactattacaatggtgtaagttcatcatttcttccccttattatggctctgcttaggaagaaaaactctttgcattggctaccaagtacctaactattcaagatgccactgacaaagagttaatctgtgaatcatgtgaatctgatatatctgaaatatatccaaacaaaaagcacctagccttttaatgactctccagaagtcagttctctaactttaattatcatccttctggggatatgtggaaattctacagaagttgattggtgatatgttgagatgtgagatctgtattttctaagcaaagttgccatgcacctgattgattggctaggtgtatcctggcatttgtcatttgttggtggggtctgatagttggtttcaccactgctgggtacccagagtcatcacatccatagagacagaatgtaggctggtggttgccaggggctgggggaagggaggagtggggaatttgtttaacagagagttttagttttgcaagatgaaatgagttctagagattggttgcacaataatgtgaatatccttaacactactgaactttatacttagaaatggctaagatggtaagttttatgttacatgtattttaacacaattaaaaaagaaaaaaaaaaaaacaacttcaggccaggcacggtgactcacacctgtaatcccagcactttgggaggctaaggcgggcagatcacttgaggtcaggagttcaagaccagcctggccaacatggtgaaaccccatctctactaaaaatacaaaaattagcctggcctaattgtgcatgcttataatcccagctaattgtgaggctgaggcaggggaatcgcctcaaaccctggaggtggaggttgcaatgagccgagatcacaccactgcactctccagcctgggtgacagagtgagatttcatttcaaaacaaaaaaccactttagaaactgctagttttggcaatagttatcactatatgttttatcctgcatattttctgttaagaataaggaattgtttatgttgatcaggaatctaagtaattaaaatacaaaattctggctggtggctctcgcttgtaatcccagcactttgggaggccaaggcgggtggatcatttgaggtcggaagttcaagaccaggctggtcaacatggtgaaaccccatctctactaaaagtacaaaaaattagctgggcatggtggtaggcacctgtaatcccagctactagggaggctgaggcaggagaagcacttgaagtcaagaggcggaggttgcagtgagccaagattgtaccactgcactccagcctgggtgacacagcgaaactccatgtaaaaaaaaaatgaaatataaaattccatactcattattaattacatatagtattaaaataaaacccaaacaccaaaccttccttgatcctatatccttctccagctaccattctctctcctctccttggtccaaatttttgatttacaatgttggttggaagtggtaccactttggtgttagttccttatcattttacctggtctgtcctgcctcttcctggtacattagctccctgaaggcagggtgtatgtcccagaactccttgaagtcccttttctcagcatactaccatgcctactgcagcaccccccatctttaatgtccttgacttggtgaaatattacattttgaacacatttcctcacttccttatgacaaatattgattgagtttcagtgcaaggtgagtaagaaatggtacttgctttcaaggagctaaaaatctgaatttccttttttttttctttttctttttcttttttttttttttttgagacagagtctcactctgtcacctgggctggagtgcagtggcacgatctcagcttaatgcagcctccgcctcccagattcagtgattctcatgtcttagcctctcgagtagctgggactacaggcatgcaccaccacgcctggctaacttttgtatttttagtgaagatggtgtttcaccatcttggccaggctggcctcaaactcttgacctcatgtgatccacccacctcggcctcccaaagtgctgagattacaggcattgactttacttcttactctcctatgcacctctatcattttgaagaagggttcaaggtagttctgataagcaggattaggtttgtatgtaagtgattaaaggggtgctatgagcaaaaaaagtgtgaaggtataacaagccaaccacctcacaatgcagtttgcatgtttcttaatggacatagcaggttttctgtaagaaaacagcaggagattcgtgtggaatgatgggttgaggcaacatagtggcatcccttgaatgctcgaagaatgtgacttagagtttggtgggaagcagagagctgggttttaagaacatgaatctgacaactctatggatctggaggagaagctaactggggacgaggagcagtaagaagcctgttacagatgcactgataagaagtaatgagagctggccgggcacagtggctcacgcctgtaatcccagcactttgggaggccgaggcgggcaaatcacaaggtcaggatttcaagacgagcctggccaacatggtgaaacgccgtctctactaaaaatacaaaaagttagctgggcgtggtggcgggcgcctataatcccagctactcgggatgctgaggcagaagaatcgcttgaacctggaaggtggaggttgcagtgagccgagattgcgccactgcactccagcctgggtgacagtgcgagactccgtctcaaaaaaaaaaaaaaaaagtaatgcgataatgagagcttacttcaagatggcagcaaaagacagtggaaaaaaggcattgggaaaaaaagccaatgtgccttgatgagtaaagttaactgagtcaaggggagaagtcaaaggtaactatgatgggctttttctattaacacaaataggaaatgagtggttttgggaaagaaagtgatgaattacccctcagatattgtattaattgtctattactgtggccgggcatggtagctcatgcctgtaatcccagcactttgggaggccgaaacaggcagatcacttgaggtcaggagttcgagaccagcctggccaacacggtgaaaccctgtctctactaaaaatacaaaaattagtgtggtggtgtatgcctgtaatcccagctactcaggaggctgagacatgataattgcttgaacctgggaggcagagattgcagtgagctgatatggcgccattgcactccagcctaggcaacaagagtgaaactccatctcaaaaaaaaagatttgcctgtaatcagccagcacccccagccttgtgctcactttacatacaaaaattctgttttttagagcataaattgaagggcacattcaaaactgatacgtaggccaggcatggtgacttatgcctgtaatcccagcactttgggagaccgaggcaggtggatcactcgagatcaggagtttgagaccagcctggccaacgtggtgaaaccccatccctactaaaaaatacaacaaattagccagtcacagtggtgcgcacccatagtctcagctactcgtgaggctgaggcaggagaatcactagaacctgggaggcaggaggttgcagtgagccgagatcatgccactgcactccagcctgggtgacagagtgagaccttgtctcaaaaacaaagacaaaaccaaaacaaaacaaaactgagaagcaacagattgataagtgacacagttacactggtcagtctcttcagctaatacccattgttttttattattggagattcataatgtgttttctttcttttaaaaacttttttcggaaatggtaatttctctctttttttttttttttttttttttttgagacagggtctcactctatcacccaggctggagcgcggtggcacaatctctgctcactacaacctctgcctcctgggcttgagcaatcacacctcagcctcttgagtagctgggacaacaggcacatgccaccattcctggctaatttttagtagagacggggtttcaccatgttgcccaggctggtctcgaactcctgacctcaagtaatctgcccacctcagcctcccaaagtattgggattacaggcgtgagccactacgcttggcctcatagcgtattttaatattggttgagactagccttgctcattgatcttctcttagcgtttacttggttattcttgcttatttttccataagaactttcatttttatttaatcctgtgttttttggttttaaagactattttataataaattttcgtgattaaactcttgtgcttaaactcttgattaaacaaacaagcaatgaagagatgaatgaagcagaaaatgtgagtttcatgcctcacattcccactcctctgaggttaatattttcatgtatatttttcaggatgtatttgtaatctcatacaaacgtatgtatttttttaatgaaaatatttaaattttcatagttaacagctgtagctctaacttggcaatatcttctgtgtttctttacagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacaggtaagtccagtcttcattctgaattatagttgctagccatttctcaaatcactttatggttgagtgagaaggaaataatatgttagacaaggtctttattgtattaattacatagtttacttacagcacccaaaacacaggatgccctgttctattctgatattttagttctcattaaaaactggtatgtgtacatcagtgttgtggggagaatttgctatcatgactattgtctttatacagtaaatactgaacttaagtcactccttttctttttttgagacagggtctcgctctgtcactcagactggagtataatggcacgattgcggctcactgcaaccttcacctcctgggttcaagcaattctcgtgccttagtctcccgagtagctgggattacaggcgcgtgccaccacgcccagctcattttttaaatttttagtagagacagggtttcaccatgttggctaggctggtcttgaactcctgacctcaaatgatccacctgccttggcctcccaaagtgctgggattacagacgtgatgaacactgtgcctggtctgaacttaagtcactcttaatggagttatttggatttgaaaaatgaatttttactttactttcagtttcaaagtcttcttatagtgaaaccacaatttaatgttcatgacaaattgtttccaggataaaagtaactgtgatagtattacaacttaaatgaaattctagacatgcgaagcatgaaaagatagatgattggtataagctttttaaccatgaactaaaataataacattatataaagattggtggaaactattgaagtttaggcttcagttgacattccctgaagttaaaaaggatatgtgtactctttaaatgcaaggtaacataatggattatttccatctaattattaatatttctaatgataatcataggtatgaagggaatggatagtataatgagaaaggagagggggagataaaaatctaaaagtactaagggcatgttggatattgaaattcactactttcaaatattatcataaaactttgagacagtaacattgcaccattatttttcttcttttaaaaacattttactcattggtaaagagaatataaacattgtggataacttttttaaagtaatggtttgttttttttttctccttcctcctttaaaggaagacatattttgtttctgagcatgaattataatcaaagttctgctaatttttgggcaaattaatccattatataattaccttcatttataaatcaataatacctttaccattccctttccaaaagaaccatgcctggcaacatcaggaactagccagatgtgttttggaggctgcctggggatcccttgttagacttttcgttcctttatgaacctcttgcctgtggtccagcattgagcctctgcttccttccaagcctttccaggccaggcacttgcttgttctctctcttctcttctctcttcttttttctctctccctttctcttctcttccccctttttcttgtctcacattcatctcaaggtaacttaaagtccatttgttattcctcttaaagttatttttattttatttttttgagatggagtctcactctgttgcccaggctggagtgcagtggcacagtcttggctcactgcaacctctgcctcccgggttcaagcaatctcctgcttcatcctccaaagtagctgggattacaggtgtgcaccaccatgtctggctaatttttgtatttttagtagagatagggtttcaccttgttggccaagctggtctcgaacttctggcctcaggtgatacgcccaccttggctccccaatgtgctaggattacaggcatgaaccattgcgcccaacctgaaagttattttaaatctagacctttatctgaaattgcagagtgtgagatgtttgttctccatttaaatgggaacttcaaatgtctgaagggctgcttagcaatgctgttgggaatgactgatgtttggaagtggttgaatgccttcacacccatccatgcagcattcgtgaactctagtaactacagaagaccaatgcatatcctgcctgtggttcagacctgtgggtaagatttgatctggccactcctttcattacacttagagatgtagctcccaccccatggctatgactggtcttcggcagtgacaaatgctcatcagcatcacgtggatgggcataaactcacctacccactttcaaacattagtcattccccacagcgtggctctttgtagatatgatatcagtatcaaaagctttgctgtatcagatttccgggaatatatttaccaggaaccctggaggaaaaagagattaaattaggcaatgttcatgctatttttttttcctagaaagcccttcctttcccttttatgctctgttcaatggatattttctttgctccctagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggtacaagagaattgttaactgcttctttagtttcctacttttgatttcaaacaattttgcagagatgacttggcagaaatgtcactactggcctgtttggcacacaaagtatttgatgagcagttcagaggatcatgtgtgtttggaagtgggttgggtggtggggtggaattgcagatttctaccccagaaccccaagattatacagccaactcgaatgggtcttacccctcgttcacccacatgggtgttggatagaagacatcgagttacaaccttgtgaagatgtctcttggaaaaaatgtgctcacaaggagttgcaaagattgtttctttcttttacttaaatttaatatatagcatgcttaacagtcatgatggtgggctggctcctgaggaagaaagaataaacacattttttggaaatggtcagaaatcaggaattcagctacagtggactttgagaattgatctagacacatttcttcccctaggctaggagggtctcagttcacaatccccttgttttctgggctgtgtttagattatttccctaactttctctaaacgccttctggatttttttttttaaatcaacttgttgatgaaaagaatcaaactctgtaaaatatttgaagagatttattctgagccaaatatgagtgacaaatggcctgtgacatagccctcaggagatctgagaacatgtgcccaaggtggtcaggccacaacttggtcttatacattttagggagacataaggcattaatcaatgcatgtaagatgtacattgattcagcctgaaaaggcaggacacctgaaagcaggggcttccaagtcacaggcagttcaaagattttctgattggcaattgattgaaagaattattatcagtaggaagcaatgattgggttacaataagggattgtggagaccaaggttttatcatgcagatgaagcctccaggtagcaggcttcagagagaatagattgtaaatatttcttaggggtcttaaagggtctgttctatcagtgattccaaaaggggagggagggtataatgaaccatgtctgtctcccttgttccatcatggcctaaacttatttttcaggttaactttgtaatgcccttggccaagaggagggacccattcagatggttgaggggccttagaattttattttttggtttataaacttcaagttgtgcacccctgatttcaaggctggtcagctcatctccctgcatgtgtctttgctacactccttctctcgtaccagccctgatttgctgaagtcactttcttgcttactcttgttttctctatttgccccataacctgtccctcaactgctccctcccaggcaacaccctatgtttccatctgaaagctcccttcctttttctatcaaagccccaatgctttgttctttgccagttaagaaaagcaacgttgagagaattcatagtgtgtaaatggcaaatagcaatttactaaattaactcacccattgataactctaagaggatgttttaccttaagcagagaaatactgatagaatccaggatatggtgaggagtgaaatgttggtagtcaccttcctacctgtcccctgaaattcaccctgtatgaatggcagcctctttgtcctggattttataattactagctctgcgacttcacctcctagcctgtttcctcctctgtgaaatggagatactcatagggattttctaaagatgaaataaggttgattatatgaaaacatattcagtgctcaaatattttatttgtgacaatcttaacagtagattataaggccaagtccatttcctggctatatgataagaacaatattgattttctgaaattctgaactgaattcttgatacgatgactattttgtatcttgctgagtttctaggattttaccccttaagaacgtttggacctattactactaaccatatcttttaaaaagagatccttcttttttttttttgcttttggggaaacattggtctgcttgaaacatctttgacccctgagactacagctaataacaattgaaagtaaatttcctttgcttctctatgttgtttcttccttcctgctgcatcagacaggaatgtcaaattctaaatgtgcaaagaggaaagagttaaagctgttacagttgtacagttgtagtgcctaaatgatcctttctttgcatgcttcctgtctttgatataagtgcattacagtaactgaaagtggccacttatttttaaaattgtctcaaataggccaggatggtacagtattgagaaattccttgcatgtaacttttttttttttttttttttttttggagatggagtctcattctgtcacccaggctggagtgcagtggcacaatctcggctcactgcaagctctgcctcccagattcacaccattctcctgcctcagactcccaagtagctgggattacaggagctggccaccacaccctgctaattttttgtatttttagtagagacagggtttcggcatgttagccaggatggtctcgatctcctgaccttgtgatccgcccgcctcggcctcccaaagtgctgggattacaggtgtgagccaccgcacctggcccattcttatgttttttataattttaaacttgtcttgctaacttgatttataagctaattgaccatatcttagtcatgtacctgtccccttcactgtacaaatgcactggaagctgtgttgtgcttgcttttccattgatactttgttggcttcttcacacaatgagttgccatcagagtgataagtgctgttgtttctctactgggttatggagcacagaggaaggaggacatagggagaaggacctcatcacttcatctggtccagatgacagcatggcttattttttgagcttatcctttactttttgttctctttcctattggtgttcatttaacaaatatttattgagcattgtaccaggctctacggatgcagtggtgaacaagacaatagattatagattccatgagggcaaggatttttgtccattttgttcactagtggcacttaccaattccttgaatatgatttttcaaaattaattgggcttatacacagagttctgtatcatttttcacttaatattgtcgtataagcatttctgttgttaaatttccagagacccttttcacaactgcacaactgtgtaatattctatcttatgatcagatttaatttatttaactctttattattgaaggccctatcaattattttcattgttttaatgctatggttactttatttgttcatgaagttttgaaaaaaataagtttctctggatatgtttttagaacaaatctgtggggtcagagtgcattaatgtttaaagttcttgacagatgttttcaagtgttcaagtcttaagaaggttgtacagacttgctcttttaccagcagtgtgagtgtcgctttttccaacctcttggtagcattgactcttatcaaaaagaaaaaaaccttgctacattgatacgtgatgtatagtatcttttggtttcaatttgcttctctttattagtgaggtaaatgttttctcataaatctatctgccatttgtattttctcttttatcttctttattcagagattttgcccgtttttatattgggttctggcatttgcttgataaatttattgtgtgctttatatattaacctattattacatgtatgacaaatattttttccacttgactctgattttgatatgcagaaatagttaatctttaaatagtcaaatattaccaactttgatagttttgtgtatagtttttaagcctaaaaaaagtcctttcatacccaggcattatataaacttttgcgcatattttgttatttaatagtttgtttttacattttattatttaattcaaaagaaatttattttggcatactgaatgaaataaccaaatgtatttatctctcgttaattttctccacatcattttacttaataaatccattcatttttcattgatttaaaatatgggagccaatttttaaaagttgagtttgagatataatatgcatacaataaaatttacctattttcattactggtaatagtaagtacatagaaaaccacagaataatataacactgttaattgtggtttgtaacctcatattttgagtagaaagtctaaaggaagaaccaatgaaaaacaataactacaactttttttttctttttttttgagacagagtctcactctgtcatccaggctggagtgtaatggtgcaatctcggctcactgaaacctccgactcccaggttcaagggattctcctgcctcagcctcccaagtagctgggattacagacacccaccaccacgcctggctaatttttgtatttttagtagagatggggtttcaccatattggccaggctggtctcgaactcctgacctcaggagatcagcccacctcagacacatgtagattgaaaataaagggatggaaaaatatttcatgcaaatggaaaccaaaaaagagcaggagtggctatacttagaccagaccaaatagagttcaagacaaaaactataaaaagagacaaaaaaggtcactaataataaagatgtcaattcagcaagagaatataacaattgtaaatatgtctggagcacacagatatataaagcaaatattattagagctaaagagagagacagactgatatggtaatagctggacactttaacactccactttcagcatcgaacagatcatccagacacaaaatcaacaaagaaatgtcagatttaatctgcactaaagaccaaatggacctaatagatatttacagaatatttcatccagtggctgcaacatacacattcttttcctcagcacatggatcattctgaaggatataccatatattaggccacaagacaagtgttaaaacattcaaaaaaactggaatcaaatcaagcaccttctttgaccacaatggaataaaactagaaatcaataaagaattttggaaactatacaaacatggaaattaaaccatatactcctgaacaaccagtgtgtcaatgaagaaattaagaaggaaattaaaaatttcttgaaacaaatggtaatggaaacaacataccaaaacctataggatacagtgaaagcagtactaagaggaaagtttatagcttaagtgcctacatctaaaaagtagaaaatcttgaagtaaacaacttaatgatgtatcttaaagaactagaaaagcaagagcaagccaaacccaaaattaatagaagaaaagaaatattcataaaaagatcaaagcagaaataaatgaaattgaaaccaagaaaacaacacaaaagattgacaaaatatgaaggtttttttgagaaaataaacctgacagatctttagccagactaatttttttaaaaaaaagatagaagagtcgaataaaatcagatgaaaaaggagatgttacaactgataccgcagaaatctaaaggatcattataggctattataagcaactatatgataataatttggaaaacctagaagaaatggataaattcctagaccacatacatactgttaagattgaactatgaagaaatccgaaacctgaacataccagtaacaagtaacaagattgaagctgttataaaaagcctcccagcaagctgggcacaatggctcatacctataatcccagcactttgggaagccaaggcaggaggatcaccttaacccaggagttcaagattagcctggacaacacacagagatccctatctctacaaaaaaaaaaaaaattacaaattagccaggtgtggtggtatgcatctgtagtcccagctcttcaggaggctgaggtgggaggatagcttgggaccgggaagtcaagactgtggtaagacaagattgcaccactgcattctagcctgggtgatggagtgtgatcaggtctcaaaaaaaaaaaaaaaaagtctctcagcaaagaaaagccaggactgatggcttcatccagaattttaccaaacatttaaagaagaactaatgccaatcctattcaaacaattctgaaaaatagagaaggaggagggaataatttcaaaatcattccgtgagaccagtattaccgtgataccagaaccaaagaaacatcaaaagaatatgacagaccaatatccccaatgaatattgatgtaaaaatcctcaataaaatacaaaccaaatgcaacaacacgttaaaaagattattcatcataaccaggtggaatttatcccagggatgcaaggatggttcaacatatgcaaattaatttgatgcaccatatcgacagaatgaaggtggaaaaccatataatttcaattgatgctgaaaaggcatttgataaaattcaacatcccttcatgataaaaacccttaaaaaactgggtatagacagaatatacctcagcccaataacagacatataacagacccacagctagtatcacacttaatggagaaaaactgaaagcctttcctctatatggaacatgacgaggatgcccactttcaccactgttattcaacatagtactggaagtcctagctagagcaatcagaaaagagaaataaagggcatctaaattggaaaggaagaagtctaattatcctagtttgctgatgatcttatatttggaaaaattgaaaaattccaccaaaaaactattagatctaataaattcagtaaagttgcaggatcagtagcatttctatatgccaacagcaaacaatctgaaaaaaaaatctaaagtgatctcatttacagtagctacaaataaaatacctgggaattaaccaaataagtgaaagttctctacaatgaaaactataaaacactggtgaaagaaattgaagaggacaaaaaaaatggaaagatattccatgttcatggaatggaggaattaatatgtccatactacccaaagcaatctacagattcagtgcaattttatcaaaataccaatgatattttcacagaaatagaaaaaacaaccctaaaatttgtatggaaccacaaaagatccagaataaccaaagctattctgagcaaaaatatcaaaactgtggaagaatcacattacctgactataaattataccatagagctatagcaaccaaaacaacgtggtactagcctaaaacagacatagggatcaatggaacagaatagagaacccagaaacaaatccatacatctacagttaactcatttttgaaaatagtctcttcaataaatggtgctgggaaaactggatatccatgtacagaagaataaaactagatccctatctctcaccatatacaaaaatcaagtccagatggatcagtgacttaaatctaaggcctcaaactatgaaactactaaaagaaaacacggggaaactctccaggacattgggtggggcaaatatttcttgagtaataataccacacaagcacaggcaaccaaagtaaaagtggacaaatggaatcacatcaagttaaaaaactgcttgcatggcaaaggaacaatcaatgaagtgaagagacaacacacagaatgggagaaaatatctgcaaacatctgacaaggtattaacaatcagaatatagaaggagctcaaacaactctacaaaaaaacttaaaaatccaatttaaaaatgggcaaaagagctgagtaaacatttctcaaaagaagatgtacaaatggcaaatgggtatatgaaaaggagttcaacatcattaattatcagagaaatgcaaatcaaaactacaatgagataccatcttaccccaaagtagcttatatccaaaagatgggcaataacaaatgctagtgaggatgtagagaaaagggaaccctggtatactgttggtcagattgtaaattagtacaactactatggagaacagtttgaagtttcctcaaaaaactacaaatagagctaccatatgatccagcaatcccactgctgggtatgcacccaaaagaaaggaaatcagtatatcgaagagatgtctgcagtcccatgtttgttgcagcgctgttcacaatagccaagatttggaagcaacctaagtgtccatccacaggtgaatatagataaagaaaatgtggaacatatacaccactattcggccataaaatgaatgagatcctgtcacttgcaacaacacagatgcaactggaggtcatgttaagtgaaataaccagacacacaaagacaaacctcccatgttctcacttatttgtgggagctaaaaataaaaacaattgcagtgcctcatgcctgtaatcctagcactttgggaggtcgaggcaggcagattgcctgagctcaggagttcgagaccagcttgggcaacacggtgaaaccctgtctctactaaaatacaaaaaattagctgggtgtggcggcatgcgcctgtagtcccagctactcgggaggctgaggcaggagaattgcttgaacccgggaggtggaggttgcagtgagtcgagatcatgccactgaactccagcctgggtgacagagagagactccgtctccaaaaaagaaaaagaaagaaaacaattgaacttgtggggataaagtagcaggttggttgccagaggctaggaagggtagtgggagtggggaaagtgggagtcccagctacatgggaggctgagatgggaggattgcttaagctcaggaggtggaggttgcagtgagttgagatcacaccactgcaactccagcctgggcaacagagggagaccctgtctcggaaaaaaaaaaagatgataaatcaaagtattttaataaaattgggccatactagagatgttattgtttgaaatcaaatatatgaagtatagttaataatataagtgtaatagaagaaaaggagccttagaaagcttgaaaaacatcgttgtacttcatatacatcttctttgcttacattataatggacaatgctgcaacaaacatggaagtgcagatatctctttgcaacatgagagattcatgtagatctaagagactgtgaagactgtttcaatattggagttacaattagctttttaattacctcttctggccagctgtggtggctcacgcctgtaatcccagcactttgggagaccaaggcgggtggatcacctgaggtcaggaattcgagaccagactggccaacacggccaaaccccgtctctactaaaaatacaaaaattagctgggcgtggtggtgggtgcctgaatcccagctatttgggaggctgaggcaggagtatcacttgaacccggggggcagaggttgcagtgagtcgagatcgtgccactgcgctctaacctaggcaacagaggaaggttctgtctcaaaaaaaaaaaaattaccttttcattgtttgctaatgtgtagaattctgcatgtaacatgtccagtttaaagaatgattatagagcaaatccctgtgtaaccagcgctcaaacaatgaaatagaatataatggcagcccagaatccctttgggtggtccctcctgccacacctacttccctccctgcagaggtgggacagtcctcctttctgccttccttgctgtgtatggttttaccacctacacgtgcatccctaaacgatgcaggttgattttctctgtttttgaactttatgtgttcatgtcttctacatatattttgtgacttttttcttttatgacttgctcatttcatttatcattgagattcatttattctccgcactgaaattctggttcattataggcttaatgtaagatgttgaggccatattgtttattagaaaggcactaaaatgccctattcactttcacttttgcttctcatctattttattataatttctatttcttaaccctttctcaaacccatgtagctgtcctcatcctccctaccaacaccccatccagacatctctcatttgcacaactacagcaggctgtcatctggtctcctggcctcatcagttttgctgcctctgattggttcttcgtactgcatctgaaataatttttgaaatataaatattcttagctcttccttgcataagagaattaaaagtaccattgtcttagagattgctatataactaacaagttcaaactcttaggattttactacaatgggccttattttctgtacttctgtgtctttgagttgtttagagtagctctacttcataaacttggttctgggcttttgtgggaggtcaggtctgttccacatgtccccacgttcttcttggaccagtggctacctcacaggagctcaagaggccaagccaaactgttggagcagcacatctattgatatatcattggctataaaaagtcctgtggtcaagcccaacatcaactggtagggaagtgtttgctctctgcgcactctagtacactgcagggtcgcaaggctgagggagagaatgaagaattgagaacggtaatccaccacaactcttgtcaatagcagtactttctgtcattatttagattgctaatttctttatttgttccttttgttattttatttgactatgaattcccataaaaatattgtattaaacccgaaagagggatatatgtaaaagaatataagaagttgaatttgatgacttgatttacaactcttgagttctgtgacttggagcaaatcaatttaatgttagtcttattttccacatccaaaggatatatttttatatctctcttttgagaattctaagaatatgcagagaataacatattagtaaaaaaccaggatattgaaatgttcctaggtctcctttactcattaacaaggtgacaatgtagcttgactttggctttgtacctgtactggtcattaagaagatgtcccctatctctcagctggaaagtgttatcagtgttgttgaccaggaagagatttaactaagagatcatagcaataatctttttttccctcccactctgctataggacataatgattatatttgtccagctacaaatcagtgtacaatcgataaaaaccggcgcaagagctgccaggcctgccgacttcggaagtgttacgaagtgggaatggtgaagtgtggtgagtgcttgcttcccttcttattgaatatgggccttgctaaaagccctgtcctctgaggaactggggacaggtagccgggaaaagagaagatttgggacatagtaattaagtatttgcgtgttgtcacattggagggggcattgacttatccacagtaactgcagaggacagagctggggtgaatgggaacagattatgggaggcagattttggccccaggtagagaagagctttctagagttcaagtggtctgaccacagaataggccaccagatgggttaggggacttctagccactggaatcctcaaacagggctgggtggccgtctgtctgtgatcttgaaaagtccagttctaaggatgaagtcgtggtaaatgtccatggttaaaactcgtgacaaaaaagtaggatatcttgtgggttactggggtagccatggggaggctcacacctatcccctcgtctagctttctagaagtagaaaaatatgtaggagtcagaaacataatggaactatgaaaagtacatacagcatagattttgttctatgacagtcataggtgtatacatatgtgtatttaacatattcacatacatatattcacatgtattttgtacactcacatacattcgcatatattttatgcacaaagaaaagtgagcactttggtatataactgacaaagatgccaacacccagctctctccacctggctagattttggttcacttgtctgtactcacttgcttgtttatatgtactcagagcagttctgcctgcacttattcttctgctagccagtattttacctgtggttaattgtaatttctctgtgtaattatttgaaaatttaaaacaaaaatccatcactttactctctgacaatttctttttttttttttttttgagatggagtctcgctctgtcacccagactggagtgcagtggcccattctcagcccactacaagctctgcctcccgggttcacatcattctcctgcctcagcctcccaagtagctgggactacaggcacccaccaccacgcctggctaattttttttttttttgtatttttagtagagatggggtttcatcatgttagccaggatggtctcgatctcctgacctcgtgatctgcctgccttggcctcccagagtgctgggattacaggtgtgagccactgtacccagccctccctgacaatttcttagtagctttgccttgtgagcattctctgcccttttcttttctctgtgtatgtaacagattagaaccctcagctattatagttcagttacagcagaagttctcttcatctgatcatgcttctctggcttcctagagtcactgatgatcttcatttcctctgtagaacatcctgccagtgcccatagcctcacagcgtgtattattggttattctctcaaacacctaaacatttccattcccaccgcttcacattatccttgtcagaaaccggtgggcttcttttcaaacctgtttctactcactgtaattgttacattataaaatttaattaaaatttactcaaacatattatgaataggaaaagacaagtttggtttttttctgtgaaagtttagttaaggccgggtgcggtggctcacgcctgtaatcccagcactttgggaggccaaggcatgcaaatcatgaggtcaagagatcaagaccatcctggtcaacagggtgaaaccttgtctccactaaaaatacaaaaattagccgggcgtggtggcatgtgcctgtagtcccagctacttgggaggctgaggaaggagaatagtttgaacctgggaggtggagcttgcagtgagccgagatcgcgccactacactccagcctggtgacagagtgagactctgtctgggggcggggggaggaggaagtttagttgaaagttttgaataaaatcttaaaggactaatagctattgagataggtatgggtgagactgggggaaaaaaacccataaaccttgggagatcctgaattcagaattctttagaagtatctaggttcttgctctgtttttgttttaaagaggctgaaactgaaaatccagagataatatcttatgtgtatgtttatgcagaaaagtgactttgtctaattggcccagatgcttaaagagaaagccttggcactctgacaaaagattgcaaataaatgttttaagttttaagttaaactattttaaagtgagtatgtgtgtgtgtttaaaaaatgatttccaagttagtcttaagaatgcttttattatactaggatccgttgcacagctattgccctcatggctcaaggcagtgtatgcagggaagagcatggaggttggatcccatagagtctatgtttcattttcgtttcatcacttcctgctgactgtaactgtgctcaaactactgaatcacctctttggcccttggttttcatgtctctgaacagagatatctgcttcacttggttttgtgaacaataagtatgaaaacatatatgaagacttagcacaatatctgacactcaattttagttttccttccattctctctccttccctgaaaaactcatatgagctttgatacaacactgtttcatgagacagagtacagagggatagttaaagaagctttcatagaaaagggaatgagagaaaggttgttgtatttagccagaaagtctaagaaaagactgtattctctttggagattatggaagaaatgagatgggttgttgcacatatacaatgggatattttgcccttcactgaccatagagaaagatcattagagatgaactttcttaactctgtctctctcctttcccatcactcttcttatctgccttccccaaaaccctctatgcatgctttttcttctatcaggtttggaggactagagattctacctgcttgttggatcctcctgcaccatcctgcttcttttattttgaaaccatgtagtctgttatcacccttttcttctgaatttctgatcttgtcttttctactgaagtatggatgtggtcatataatggtaggacaacacccacctagactaactttatggatgaaacttcattataaggatatactgaaatgtaaggagccaggaaatccctctgaatagccatgtatttggcctatatccccatattgggacaatagctcaacatattttgggtgccatatctttatatacctgctgtatactcttctgtgaaagggatttgataggtgggtagtataaaatagtggttaaaagcaccagctctggatttaggctactgcttgggtttagatcctgcttctgctattttctagctgtgccatcttagacaagttatttgagcttatgtttggttcctcttctgtacattggagacagtaatagttcctgtactgtagggtagctgtcaggacatgtgcaatatgcaatgcctggtgcatagaagcttccagtagacattagctgccatttagtgtcatttatcactacgatcatcatcatctttggctggggctatttaccactgcctaatatggagcactcgatttggtggagctgctcattaagctcactcagaggcagctgcctaggttacagtgtcaaagccacaacactagaaacatccttgatagaaaaatgagctccttgtcaagggctttattgagtctagaacccccagaattcactacaggacctagaatgttagactttgtcagtgaaaatttgtcaagtaaatttgaacgtatgaattcaaaatctctcactttgggtatgtaaagggtatataaatctgttttgtaaattccttatccttatatactctatactctacaaaagagaaatgtatgatcagaaaggtgcttttttttttttctttttttttttttgagacagggtatcactctgctgcagcccaggctggagtgcagtggtgcaatcttggcttactgcaacttttacctcctcgggctcaattgattctcccacctcagcctcccgagtagctgggactacaggtgtgtgcaccaccatgcctggctaatttttgtattttttgtagagacaggatttcactatgttgcccaggctagtcttcaactcctgggctcaagtgatccccttgcctcagcctctcaaagtgctgggggattacaggcatgagccaccttgcctagcagaaaggtgctttttaaaactatacattttgcagcaaaccgccatggcatgtgcatacctatgtaacaaacctgcatgttctgcacatgtatcccagaacctaaagtatattaaaaaaattaagaaaaacatacattttgctccattttatcctgggtgtataattgaccttagcattctgcttgattactaataaaatgaattgtattttaggcctttaattcttttagcagtaaatttggttcaaattttctgaataaatagagccctttcttctactataactagtcaatgttaagaggaaattctgacaaattttcctgggagccaataatttaaatttgctcacattttctaactaatatttatttttaaaaatgtaaacaattgatttagtgaataaacataatgatgggtgtataaaaccaagcattttgcagatttcaacttttagggtttctttttttaagggaaattcatataaaagttataaccatgctaatgacatccttacttacaacatgtctttcttaatttccattttacattttttgtctttaaccgatgaaaacttataaagatgttggtgctcaaatgtatagggatttggaagttatatttttgttgttgatttccatttttcttatcgtcagagaatatgatctgaataatacctattttaagattttcttcattgcctagcatgtgataatttttgcaaaatatctatggcctttgtagatcaagcttgttaattatgtggttcaaatattctgcattctgactttttgctctttcagctgttgagagagagatttaaatagcccgttataatactgcatctgtcagtttctctttttctttcagttactttttgtattgtgtttggaggctgtgttttattgtttgtctatttatttatttatttatttattttttcaacccaagtcttgctctgtcacccaggctggagtgcatggcacggtctcggttcactgtgcctcctgggtttgtgcgactctcctgcctcagcctcttgagtagctgggactacaggaatgcaccaccatgcctgggtaatttttgtatttgtagtagagatggggtttttccattttggccaggctggtctcaaactcctgacctcaggtgatccgcccaccttggcctcccaaattgctgggattacaggcatgagccagcgcacctggcctttgttgttttgaagtatatgagtttagaattatttatctttttaaaatattctagcgatgagtctccttatctataataataatttttgccttaaagtttatttgtctggtatcaatagagtaatgtcaatttatttggttaattttgcctgttaaatatttttctatctgtctactttgtttttctatatgttaggtatatctcttacacctaatctatgtctagatttaaaaatatgtataatttcagagtcactcttaaatggtcaatttggtattttttgtttattgtgataactgatatttgggttcatttctatcatcttattttttgatttaaaaaattttattatgtattttctacttcttcccttttaggagttgatcacatttttatgttttctttttcttcttttgctagtttaaaagtcatacattctgtttcaattcccttttatcttttgagacagagtctcgctgtgtcacccaggctggagtgcagtggtgtgatcttggctcactgcagcctctgcctcccaggttcaagtgattctcctgcctcaccttcctaaacagctaggattacaggcatttgccaccatgcccagctaatttttgtattattagtagagatggggtttcaccatgctgcccaggttggtcttgaactcctggcctcaagtgatccgtcccctcccgccccacccgccgaaaccacctttggcctcctaaagttctgggattacaagtgtgagccaccatgtttggccatgtttcaattcctttaatgacgtttatgttttgtaacgtgttcttgattaatttgagaatttaagcttctatcttcccaaaaaagaatcttagaaattctaaccaaaatcattcctctctgattttgcatgttattgtttgttattttggttccaccttgtttctatatcactaaaacttaattcttgggccggatgtggtggcttatgcctgtaatcccagcactttcagaggccaaggcaggaggatcacttgagcccaggaattcgagaccagcctgggcaacatggtgagaccctgtctttacaaaaaatacaaaaattagtcagatgtggtggtgcacacttgtagtcccagctatccaggaggctgaggtgggaggatctcttgagcctgggaggttgaggctgcagtgagctgtgatcatgactgtaccaccatacttcagcctgggtgacagagaccttgtctcttaaaaaaaaaaaaaaaaaagtaaatccaaagaacaagcatataaatcaactttgctagtaattaaaacatacaaagtaaagcgagatggtttagttagattagcaaacattaaaaatgatttttaatgcccaatgggttctgagaaaacagtcaaactattgaggactgggtaacatagtaagaccctagttctacaaaaaaatttaaaagttagctgggcatggtggcatattcctgtagtcccagctactcaggaggctgaggcaggaggattgcttgagtccaggagatgaaggctgcagtgagctatgattgcatcattacactccagcttgggcaacagagcaggactctgtctcaaaaatacaattaaaatagtgtagatactacaatctaattttgtgtataaaggctgggtgcagtggctcacgcctgtaatcccagcactttgggaggccaagatgggcagatcacttgagaatcaggaatttgagagcagcctggccaacatggtgaaatcacatctctactaaaaatataaaaattagccaggcatggtggcgggctcctgtaatcccagctacttgggaggctaaggcaggagaatcgcttgaacccgggaggctgaagttgcagtgagccaagaatgtgccactgaactgcagcctgggtgacagagtgagactccgtctcaaaaataaataaataattttgtgtataaaacgtggaaaaatatggtggcaggcacccatagtcctagctactcgggaggctgaggcaggagaatggcgtgaacccggtaggcggagcttgcagtgagccgagatcacaccactgcactccagtctaggccacagagcaaggctccgtctcaaaaaaaaaaaaaaaagaaaaaagaaaaataaaagcattaaaaagactgaaagagtttatgccaaaatttattctcttctatatttttcagattttttcacttaatttgttatttgaaatatacttgttttgtgtaagtataaggaaatatatacatatgcacacatgcatataaacattttaagaatgtgttataataaaagtatattatttgatacctttggaaatatccccatttttctacctgaagaaaattcctaatttcatggtttggaaacaggtttatgagcactctttatagagaaacggtgttagtatctatagatgacctggaaatggagacctaaaaagtttctgaaaagttatgtcgttggttttgctagtacggtcacgaccatagtaatctttggtacgtgccccacaggctccagaaaataaaagtcaagctgcttttgcttgactgcggttttaccctggcaattcgaatgactctgctttcctcttcaggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggtagggctttctggctatcagttttccatgtacttgtagaaaggccggccgctaatatttaaggggcaagagtacaaagtagaggtccatgagctgtgcctagatatttaacaggtcctcagctggatttgtaacttttaagtgcaatatgttccttccttctgtcttggcatacctaccttcaacaaggccgtgttctgatttagaattctgagactcttctgagttctgtacccaacatggtagtgcagaaagagttgtgcgtggcccagccatttctattcttgactgccttcttttcccatggctagatgcatcccataccaccttgcacaaaccctatcctgtgtgtccacatctgctacagacactcacctgttggccacctctcatgcctagaggtggtctgggaggatggacccagggaacctacctaggctctggaattgggcttggggtcatttgggcaagaatcctagagtcctggaacctggaacgtggttaaaatgatagactccacattgacccatttcttggctgtggattcctcaccttgaaaggaggggtggggtagagtacagtatgactagtttgaaagtgaaaggtttgtcagatgctaaatagaattttgtaaattattgttccagtagagaatcaatattatgtacataaatgaatatgtatggacaaacagagtaaatcagtggttgaagttacacgaatcatcaatgggcccataaacctggaatgccatcaagttaaaaatgagcttagttactcatgagttgtcacttggaacctgcgttttccatcctccaaagtgatcacttctctcaagcccatttgtaatatatatctgaagtgctgtatgatgctaaaattaccagctaattatcatttgacttggtgtttctgtggaggagtgaatctaggattctaacctagagtggcaacaccccacgatccccctgtgacagcttctccatgctgttctttacagtccttgaagaaatgaagtctcttataagttctgagccactgggggcattcccatggcctggagggcagcgactgcactgggcaagctgtaaagatgaggaggggtgagaagctgggggaagagaagttttgggtaaagagcctggggaactgaggcctatggtgacagtatcatttggggacttttgttggcctgggcccatttcttctgagcttcctgaggatttttggtttctagttgtattttgttttgtctagcatcttcacctttgccagaattattttattttctctgctttttcccaggggaggcaatactgatgcactttcctctagtttttgctttaaatgtattccaaacacgattttgcaggaccacacatggagagcagtggtgaaattaattattgctgaaagctgtgcaccttctttgtgccataagaaatctgaactcttaaactgcattattccttattcaagcctggtgttttgaaaagttttcaggaaacgtagacataatctgaaggcgtgattttttttctcctctcttagctggcatagtcattgtccaaaccaaaaaatatatattaaaatatcatctagccttgatcttgttgaatatctacaagattaagaaccgtgatctctcttgggtaggcttattgtcaatcactatgggtgagactgggaaggtatatacacattaggaacctaaactgagcaaagcatgtggatttagaaagtatttatccatctttacattcataacaccattacattctccttgaggcagatttgcgttataattgttcaaagacttgaaccatgtgtgttctctctgctgtagtttcctcatctgtaaaacaagaatgataagagatcctgcctataagacattctcagagataggcattgttacccccattttcctataagaaaaacaaagacttaatgggagattaagtgaacagctagaaagaggctgagctggggttcgaaccagagtccatttcactccaaggcggtgtcttttgttatcatatttatattacatggccctctctttttatcatggcttgtgaaggaagccccggtgttctctgctttgcttttgaagtgcttccctccccagagattacctgtttgcaaacagtactgtgaccaacatgggttattaggttgtcaggacctgcttcgttattatatttgctctttatttatttatttatttatttatttttgagacagggtctcgctctgttgcccaggctggagtgcagtggcgtgatctcagctcactacagcctcgacctcctgggctcaggcgatcatcccacttcagcctccagagtatctgggactacaggcacctgccaccatgaccagataattttctgtagagatggggtttctccatgttggccaggctggtctcaaactcctgggtgcaggcaatccacccaccttgacctcccaaagtgctgggattacaggtgtgcttggctatatttgctgtttaggatagaatcacccagaaacagtgcttctacccagaagaaggatcttaacactggataggaaattttaatcaatcagagaaatccttgcagttgaggccttggttttctgtgagggctggcactgctctctgcaagcctccaaccccaacctccacctaccccatcccccacctaccccatcccccaccccttctgatcccagtcaaggattgggtcagacaggcaggtcttctgactggcagccaagcatcaacattctcagtagtgcagaggaattatcaggacacagctaacaaagatcagttctgagccgaggtcgtagtgcttgacaaactctaaatgaagtatatttgtctctagaaggggtccaagactggaaactaagttgcgcagcttaacttcaaagttttcttcctttaatgagcagttaatcacatctataaaatatcaactccctaatggtttgtgttttcttagtgttttaacacttgccattctgtctctacacacacagggagctgaggaggaggggtgggggtgtctcaccgcctcttgctttccccaggctttgtggagctcagcctgttcgaccaagtgcggctcttggagagctgttggatggaggtgttaatgatggggctgatgtggcgctcaattgaccaccccggcaagctcatctttgctccagatcttgttctggacaggtgagaaaaaatacattgtgtttcttctctgacttgtttgagtaaggtgcttagtgagtgggaacaaagtcctgggtgctgcaattaaaatctcacacttgcagggcagaggatgatagcatcatcagctccttcactgggtcaagaaccagagaaggagagagttgggtccaaggattcagggtcctgtgactcatttttaatctgtggtgcagcagcatttacaggccagcgctttaataggggactgtatcccgtaggtatgtggccactatgtgtataagtcgacacagatttttctccattaaaaattccattttcaggttataatcttaagttgtcctgctgttttttgtacctatagtgaccaattatatctggagctttctggacaggtgataaaattcttagaaatgtgccaagtttattttcacatgctttaactcactcttttgtttttttttgttttgttttgttttgttttttgttttttttctgagatggagtctctctctgttgctcaggctggagtgcagaggtgcaatcttggctcactgcaacctccgcctaccggattcaagtgatcctgctgcctcagcctctcaagtagttgggatcacaggtgtccaccaccatgccaggctaatttttctatttttagtagagaagtggtttcaccatgttggccaggctggtcttgaactcctgacctcaggcgatctgcccacctcagcttcccaaagcgctgggattacaggcgtgagccaccatgcccgatctgctttaacacattctaatgcatgtactatatagcatttttggcaatagcggtggaaggaagggttactaaaactatatgaaacttaacagaaaatgggacatgatgctgtatcttggttgtgtttgattttcttttaaagatgacacagaaaaggaaacaatttttaattgacttaggtgaactgtttatggagggaaagctggactgtataaaaatactcaagctttttagcaggaaagtagaacaccctcttggtgtaaattcgagcagttcgaaatcttcttggaaattgatttccacatctcttttatggaaaaagtgctaggttgaatgttcagccacatctgactctgcatagcgtgggaggatgcctagtgtctaccccaactcttgcattataatcctgttaccactttagatcatcagaagaccctgtgttacacagatgaagagtgatgccccaaggtatcagtccccattctgccttttgtcatggttgacaatgttattaaaagagcactgttctgcataatggtgttttgatagagaacagatcctctgagaagagctggaggactgatgtgacttgaacaggagcaagcccaggtggtaaaccatggagggaggctctggaagaccagagaagttcagggcacaagacccttcagtaacaaacaaaatagttaacctattggcttgtatgtgcttggcagcaccttatgcatttaacttatgtcaacacatttaatcttcacaatcttcctgccccctttgagggagtaggatccattattatctctatcattcagatattggaaatgggagattgagaaacctgcttacaggtaggataataggtggtggagctggacttggggggttgccaaatggcaaactaactctctactttattctacctgttgttatgggtgacaatgttgacaaagagcacattctgcagaacagagatgttttggtagagaacagccctgttttacttgtaacacactgcagaaacccactctccccactgtcatctcagggtaccatgtcgcaaggcaggctgaaaagccaagcacctagccaagccattgctctcattcattcattgtattctgcttggtgttttaactggggccaaatatacatatgtataaatatacacatataattttccttgaagttagtcctaggaacacattccatcccttgacaaataatttgcagactttaggattattttatcttttgtcttgatttctaaattgatgccaaatttagtgtttatttttggtgactatttcattcctggtttttagtacaattaactctccactctcccatttctctgtatgcgttctttaattcctgtaattgtgtgtatacattactataagtggacacaaatcctggaaaaatattaggcctaccttttagttaatagaagaaaagttatttttcttacaaattatttctaatagacttacactgcctttataacttaagtgaaagtattatgttgtaaaacataaatctagtatatttgattgagtatagaagaggaattcttgggaattgtaaatgcattcatgttgagcaggcatttttttttttttttggaatgactactggtgtttatttgttgttgcaatttctagtagtttttgtttgtttgttttttgtttttgagatggagtctcgctctgtcacccaggctggaatacgatggcatgatctcagctcactgcaatctccgcctcccaagctcaagtgattcttgtgcctcagcctcctgagtaggtgggattacaggcatgtgccactacggctggccaatttttgtattttttttttttttttagtggagacggggttttaccatgttggccaagctggtctcgaggtcctgacttcaagtgatcccccagcctcagcctcccaaattgttgggattacagacgtgagtcaccacgcccagcctacagtctctagtatttttaacacattaactttctgaagtctggaacttgaagtctaagatagttcagttacttagtcctctcttatacaaatgaatatacttttatgtaataggtatatttgtagaggagttgctcattcaaaaagtcaggagtcatgctccataaagacttctattacgactcttttttgcaaagtgaagggaatcttcacaccatttgaaaataactgtcttctgctggattgtcctagcagagcttcttcaagtggtaatatggctgaataaacagtgaatacaactaacagttgcccatttgtggatactgaaactataatttctgtttccctttattcttgttgaggtgtccacaacaagaaaacttgtgtctactgaggatgagaggaaaatctcattacttcagcttatttctaagcatttagtttttcttttactaaccactaaattcatcataaattcacgtgaagatctaaagaacctgactgtctaattgctcaaaaaaaagtcacatatgcaaagacatttttgtgtccttagtatcaacaggcaactgactaatgttaaattattagtcagaggaagtttgtatctggcttggatcccattgtggacatttgcagataggtccgtggaattgtatatgtataaatgtcttgagtttacattcacattagttatttgtatgctaaattccttcaagataaccaccgaattttcaattcccaattctaagccttaaacactccctgccattgccatacacacagaggtaaaccatggtctgtacccaggtgtgtgctgcgagcagagatatatatatatatacacacacacatacatacacacacacacacacacacacacacacacacacacacaaatagtgtacccctaagggaggcccactcattcaacattttgttgttgtattaaacaatattcttctttaggccaggcacggtggctcacgcctgtaatcccagcacttggggagactgagatgggtggatcacctgaggtcaggagttcgagacaagcctgagcaacatgatgaaaccccttctttactaaaaatacaaaaattagctgggtgtggtggcaggcgcctgtaatcccagctacttgggaagctgaggcaggagaattgcttgaacccaggaagtggaggttgcagtgagccaagatcacgtcattgcactccagctggggcgacagagcaagactccatcttaaaaaaaataaaaaataaaaagcaatattcttattttataaagagtgattattggccgggctcggttgctcacacctgtagtcccagcactttgggaggctgaggtgagtggatcacttgaggtcaggagttcaagaccagcctggccaacatggtgaaaccccttctctactaaaaatgcaaaaattagccaggcatagtggtgtgtgcctgtaatcccagctacatgggaggctgaggcaggagaatcacttgaacctaggaggaggaggttgcagagagcagagatcatgccactgcactccagtctgggcatcggggtgagaccctgtctcaaaaaaaaaaagtgattgtcaagtaataaatttgatatggtttggctctgtgtccccagcaaatctcatctgaaattgtaatctccacgtgtcaagggagggatctggtgggagtgattggatcatggggatggtttcccccatgctgttctcatgagagtgagtgagttctcacaggagcttatgctttaaaagtgtttggcagctcccggctgtcttgctcagtcactcgctctcctgcctccatgtaagatgtgccttggtttccctttgctctctgccatgattgtaagtttcctgaggcctccccagccatgcagaactgtgagtcagttaaaccttttttcttcatagattacccagtctcagatagtgctttatagcaatgtgaaaatggactaatacaaagatattccatgttattactgattttatttagtagtttatggacagatagtgtgcaaaaataaatttcctgagtaggtcagtttggttgatacattgtttcaatattttaacattcaaatcatatgccctgtttttgtttttgtttttttttttttagagacggtcccgctctgtggcccaggctggagtgcagtggtgccatcacggctcactgcaaccttgggctcctggcctcaagtgatcttttgcttcagccccctgaggaactgggactataggtgtatgctaccatgcctggtttattattattttgtagagacaaggtcttgctacatcgcccaggctggtctagaactcttggcctcaagtgatcctcccactttggcctccccaaagcacgaggattacagacatgggccactttacccagccagccctgtctttaattcaactcttttaaccctgtcctaatttcttactcataattcagtttcaatctaaaattataaaataaataaaatagatgtcattaatttagagtctttactaactttgttctgtgtaactcatctgaaagacctttactgggctgtcatttacgatgtcttatactttattgcctcttcatttctcatttattttgttgaaatgtatttggtttctgcagactgtggagtgaataaaaatattctaactttgccaccccttgaatgaaatggttgactgtcacacctgcttaaaaagaaagcaatcagacctagttctttagactttgtttagaaattaactttctccatgagttatgtatggtctgattactgtgagggacagcctttatcagggtttaaaatacctcagtatgccaaccctcctcccatttttggaacataaatttgcagtgaaaatggcatatattttaatgaggaaatgataccaatttcaatattgaggaactaaggcacaggtacttctggaaaataggattgatttcaggtgggttcccttaccataccacttggggaggggtgtgtgtgagtgtgtgtgtgtgtgtgtatgtattgtgcatgtgtgtataatcccacatcagcacagaagaataaagagataatcaaatatcaatgcaggagttggtgggtttttttgtttttttttttttttgccccatagagatattttcaaactagctttccttagtatcaaatgtccccaagtccaacagttacaatttccaataattaattgtccgcaggcaaggtgattcaggtgttttttgtgttatctctgtgcagggcttgtgttgtccttactggatgcctgcatcaggttgcctgggagagcctagagctggggaggtggaaagatgaggcttcctgtagatttggcactctttgcccagtgctctggattctctaagacggccttttcctatgagtgacttccagggggcactggtgttttgtcacttaacctgtgtacttatagaaaattgcaggtgtttacagaatttatgatttagtaaatttagtaacttagtaatgctcatataccaaagtgagcaatttgcatgcttgtagctctgtgtgagcgagtctgggtgggagagtgtgagtgcttcggaatgcaggatcccggtgagtgccatgtacggcaggtaatgggaaagacttctgcaggactggtgtatccagtggtgtcagaggctcttccctgaaatactgccatcgctggaaatgccctgagttcggggaaggaggaggggagcagccagctctttgaagacctcaaggccccttcaggggctgctagagactaaaaatggaactcgcataaacccactgccctttctgtgtgctgcaggcttttgggagcaaagggtggttttgtgacaaaatcatctaactgcttgtcaaggacttccaataaccctgtgactgacaataatagagtgttttgggggagcagtgaggtggaataatgtgtgtctggctggagtgaatagaagctggtattttccagataaagttcaagtaatttacttccaaagtatatttaaacatttatttctacaaggagtgctccaaagaattttgattagatggctcaaagtttaaagataatccttgcttgaagataatccttggcaagtcaaaaatttttccccacctccatgtataccttcttttcctgattctaatccatcttctctaattgcgatttctttctcatagtcagctttttcaaattacaggtaaatgtcttagttgctacacaagtttctaagtgaccaccaggaagtgagagttaagccctagatatggagttttattcttgggatatttgcttctgtgacacacggtcttcctcattaatacttcccgatgggaacatgaagtgtctcattttgaaatacgtgtcatatctggggctggttgactgatatggttttgattgaaaacaatcaataggagtggtattgctgtaagaaaacatttggtgaaaatgtagaaggaaaatattccaatgcacatttttgcctaaataatatttattcatatatttacttcagggatttataggaaatggcctatcttctttatatgaagacaattctagtaatttcatattgctgggtgtggtctcattaacaccctgttgtagttaaaatgatattatcagatgaacatgttacaagatgaaacttgagattaaaaataaaacattccttattgtttttttgatggtttcctgaagctatgttccttaaatttccaaacgaacttttgtagggatgaggggaaatgcgtagaaggaattctggaaatctttgacatgctcctggcaactacttcaaggtttcgagagttaaaactccaacacaaagaatatctctgtgtcaaggccatgatcctgctcaattccagtaagtaatcacacagctgggccatgttttatcggggagagatgctgtttctacaactagcgtgatattaagaagaatgttgaacttctattttatttgaaagggtaaaatggtttccttttggacttcgtttttattttgatagcgatttaaactgtaggtaacttttggtaacttggacataaattactcattaagtgaatgactggcaatcaatttaaaagtagctcaagccacttgctggaaaagaaaaaaaaaggaactttaaattgtttatcttttaaacttttttcagtgctcacacagacactttacatggttggcatgcatttatacttatgtctggggtcctccttttttacagattcattcgttcagtaaagatacaatcctaccctcaaatggctcatagtttaggcagggagagagagaaaacaaatcattaaaaataatgatttctgtgctatgataaagtctacacaaaatactacgggaaaataggaggagagatgctggagttgttgcagaagggaatgattgaacaaatcttcaggaaagagcagagggaagtaggtatgactttaaaatgcagtgctgaagattagaaactgctgcccaggctttgggcagcttagaagaggttcaggcaggggagtgtcatgcacagatatgcgatatagaaaggtcactctggcttccatgtggaggactagaaagggcagagactgaagccgggggcccattagaggcaatgagagcctgaactgacattatggcgtgaggtcagggagcaaaggacttgacttgaaggaaaagtgggaggtagaggagggaaataaggtgtctaggatatgcagatggtttcgttttgttggttttatcttatataaatatctgattattgttaataaacattcaaatgagaaaaacatacaaggaagaaaataaaatcatcaggaatacctgccctcaaaataaccaccataactttggtgaccattcctttctttctttttttttttctttttttttttttttttgagacaggatcttgctctgctgcccaggctggagggcagtggcatgatcatagctcactgtaacctagtactgagctcaagtgatcctcccaccttggcctcacaagtagcttggaatacaggtgcataccaccagacctggttaattaaaacaatttttttttgtagagacagaatcttgctgtgttgccagaggtggccttgaactcctggcctcaagcagtcctcccacctcagcctcccaaagttctggaatttacaagcgtgagccactgtgcacagtctgtatcttgttttttcacttttctttttgagacagggtgtcactctgttgcccaggctggaatgcagtggcacgatcatggtttactgcagttccgacctcctgggctcaagtgattctcccacctcagccacctgagtagctgagaccacaagcacctgccaccacacccgaataatttttgtattttttgtagaggtgaggtatccctgtgttggccaagctggtctcaaactcctgtatttttgtttttcttttcaaaatgctgtgaaaccattctgggtcaactaggagagatctaacacaatctttgatatgagggcattatactaaattgttcaaccatttctctgttattaaatatccagttcctcttcctttttaaccattataaacattactgcaataaatagagatgtgttattttgtatgaatttctaagtttctggatggttgtcaagactggtcatttcacgatctacctggtgtctaagccagccgctctagcagatattgatggctttgcttagccatttactcttgtcgagcctttaggttattgactttttttcttcctcaaacactgtatatccaggttttaatgttcacctgaagacttacagatatctctatttagacaacatattgggccttatttatccaatcttagagttcgatacttgaaacaacagggatatatcagatcatattatactacggtctttaaatcagccaaagtagcagttcctgaagccaagattcaatgcagaattcactgtggtcacatgtttccagctgcctcttgatctggggccagctgaccttcatacgtgtcttctctcacagactcttggatattggcactagtttttttgtttgtttgtttgttttgagacagagcctcactctgttgaccaggctggagtgttaaggatagttacttttgcaaaatataacaaaaatgaattatgagaaaaataaaagtgtaaaatacaagtcctagtttataatattattagttatcacattcaactgatttaaaattactctgtcgattgctaaaaatgttcctaaatgcttacactcaatttctacccatctctttgtaaatgggcaacagaccatacattagctctggagagagcacaggatactgtccaagagttgcttggatctagggtggagggtggggttagcccctgaagaactgggtgagggagaatgaagaaggaatctgaaggccatgtgaaggtacagagacctggaagacaacctttgagcatttcctagttaagtctcaatctggccttacctgcctaacaggtcatttcccctgcacccaacacacccttccctgtttattgttaccattcaccttttacagaataacatgagggcccagcttatactgatgattatgttgatgtgcatataaggaaagtccagccaggtgtgttttttttttttttttttttttttttttttttgacagagtcttcctgtgttggccaggctagagtggagtgcagtggtggaatcttggctcactgaaacctccgcctcccaggttcaagtgattctcaagcgatgcctcagcatcccaagtagctgggattacaggtgcatgccaccatgcctggctaatttttgtatttttagtagagatgatatattagtctgttctcacactattatgaagaaatacctgagactgggtaatttataaaggaaagagatttaattgactcacagttcagtatggctggggaggcctcaggagacttacaataatggcggaaagtgaagaggaagcaagataccttcttcacaaggtgccaggaaggagaagtcccaagcaaaggcagaagagccccttatataaccatcacatcttgggagagctcactcactgtcatgagaacagcatgggggaaactgcccccatgattcaattacctccacctggtctctctcttgacacatggggattatggagattacaattcaagatgagatttgggtggggacacaaagcctaaccatgtcagacagggtttcaccatgttgtccaggctggtcttgaactcctggcttcgagtgatctgcccaccttggcctcccaaagtgccgtgattacaggtgtgagccaccacatccggcccaccagccaggatatttgaaattgatcatggaataagatcaaccctttctgaccttttccaaaccacctaccaacattacctcacataggtgctgccatttctgtcaaagggaggatctgcttgaagagtaccttcccatcttggcaatggaagatcatcaaatgccagatgatggggcttctctcactttcagaaataatttagatctcttttctgtgcaggaaagtgcttctcggaaagcactgtttgcttgttgttacaacactttacagtataaagccttctgtttggcaaggctccttataggcattttagcctcccagacatcatattgtgttgttgtcaaagctagacgcagcatctgtgcaaatgggaaagatgaaggctacagcattcccctgcagcatgacagaactgccacattgagataattacagaaggcgagggagacatgtgatgtaattaccacttgtggcagtaaacgagtaaaatttgtttactgtaaatccaagtttaagaaatctttttttttttttttttttttttttttgacagagtcttgccctgtcgcccaggctggagtgcaatggtgcgatcttggctcactgcaacctctacctcctggcttaaaacagttctcctgcctcagcctcctgagtagctgggattacaggcacccaccaccacgcctggctaatttttgtatttttagtagagatggggtttcaccatgttggccaggctggtctcgaactcctgacctcgtgatccgcttgcctcggcctcccaaagtgctgggccctcgcctggccagagatcttcttttaaggaagttcctttcttggtagtcataacaattgtcaaaataaattgatcctgttcagcattgctatggcgaaaatgggacaattttcactgctaggttaagtgagtcttttctatgctaggttttaaggatttgtaagtacaggcttttttcttctggattatttgtggtatttaaatttaaaaaaaaatagggatggaatctgcctccccgccttaaaatttaaaaccctgacagaatatataaaacagatattggacattggacaacagtgatccccaggaggagggacacaaacgaggagagccctttgattgtccagtttactgcctggagccagtttccaggttgcaaagcagggatgggtgtgttaggtttctccagagaaacagaaccaataggatggataggtaggtaggcagataaatgagaggggatttattatgaaaactgacttgaacaattatgaaggctgagaagtcacatgatatgcgtctgcatgctagtgaaccagggaagccagtagcatggctcagtgtaaatggaaagacctgagaactagggagctggtggtgtaaccctcagtttgagattgaaggcctgagaaactgggaggccactggtgtgagtcccagggtctggaggctggagaacctggagttctgatgtccaagggcaggagaaaatgggtgttccagctccgagagagagaattctcttcctctgccatttcgttctatctgggcactcagccaattggacggtgcctgccaacattggctaagggcagatcttccttacttagtccactgttctttctttttttttttttttgagatgaagtcttgctttgttactcaggctggagtgcagtggtgccatcttggctcactgcaacctccaccttctgggttcaagcgattctcctgcctcagcttccagagtagctgagattacaggcatctgccaccacgcctggctaattttttgtatttttagtagagatggggtttcaccacattagacaggctggtctcgaactcctgacctcaagtgatccacccactttggcctccgaaagtgcagggattacaggtgtgagccactgtgcctggccttagtccactgactctaatgccagtctcttcctggaacactctcacagacatacccagaaataatgctttatctgctatctgggtatccctttatccagtcaagttgacacctaagactaaccatcacaaagggtaacccaaatagacaccagtggtctcccttggtagcaaggcagctaggacttggaggggagagtactgagtgggaaagagctgcacaaagaattttggagatctatggagagtcctcttcaagtcttcagctgagtgctaatctgcccatgcttatgaggataccaaggacagggaaagaaccatcagaaaggagcgggcgaaacaatccctagagttcacacagggccaggaacagttcacattctcaccagccagtgggaaaaaccttgcagttcactgggtattgggcacttctcagccttcctatagtattcagaagggtattgcctcagtagtgggcctagactaaaagccattatgatcctaccaaacaaaaaagcaagcctggaggatcaaacaattgctaagtgatttaactgcatcccagcacaaagctcaagagtagagacacatcccatttcattacatgttgctttattgtgcatcacagatactgcatgtttttacaaatcgaaggtttgtggcaatgctgcattgaacaagtctgttagtaccattttttccaacagcatgtgctcactttatgtctgtgtcaaattttgataacactttgcaatatttctaactttttcattatatctattacagtgatctgtaatcagtgatttttgatgttactattgtaattgttttggggtgccacaaactatgcccatataagctggcaaacttaacctataaatttgtgtgttctgactgctccaccaactggtggccccaccaccatctggaattctgggagaattctaccatgcatttgaggaaggaataataccaagtgatatggtttggctctgtgtccccacccaaatctcatcttgtagtgcccataattcccacatgttgtgggagggacctggtgggagatgattgaatcatgggagcaggtctttactgtgctgttctcatgatagtgaataaatctcacgagatttgatggttatataaaaatgggagtttccctgcacaagccctcttctcttgtctgccgccacatgagatgtgcctttcaccttctgccatgattgtgaggcttccccagccatgtggaactgtaagtccaataaacctttcttttgtatattgcccagtcttgggtatgtctatcagcagtgtgaaaatggactaatacaccaagtttacacatactcttacagaaaattgaacagcatggaatgttttccaattcattctgtgaggccagcattactctgatagaacactcagactaacacactagaagaaaagaagacaacagaccaatttccctcatgcatgtataagcaaaagttctctaaatttttttttttttggtaactagaatccaaaactgtattaaaagaatagcacatcatgaacaagcagaatttttgggaatacaaggtttctttaacatttgaaaatcaatcaaaattcatattaacagaataataatgaaaaaccatatgattttatatatatatatatattttttttgtttgtttgtttgttttgttttttttgttttttttttttgagacagtctcactctccgcccaggctggagtgcattggtgctatctcagggctcaccgcaacctctgcctgctgggttcaatcaattctgtctcaacctcctgagtagctgggattataggtgcctgccaccatgcctagctaatttttgtgtttttagtagagatgaggtttcaccatgttggccaggatggtctcaaactgctgacctcaggtgatccacccgccttggcctcccaaagtgctaggattacaggtgtgagccactgcacctagccatgattatcttaatagatgcacacagcatttgacaaaatccaacatccactcctgctaaaaacactgtacaaacaaggaatagaaggaaacttcctcaatccattaaagggcacctatgaaaatcctacatttaatattatacttaatcacaatcaggaacaaggcaagtatgtccactgtccttaattctattcaacattttactgtaagttctacccagtgcattaaggcaagaaaagaggtaaaaggcatcaatattggaaaggtagaagtgaaagtctttatttaaaaacatgagaatctatgtagaaagtcctaaggagtctaaaaaatgtgaatttagcaagtttgtaaggtgtaagggcaatatatataaatcaattgtatttctgtgtggcaccagtgagcaattggaaattgaaatgaaaaaccactaccatttacaatagcatcaaacattgtgaaaccttgggaataaacttgcaaaagacatgaaacctgcacactaaacactgcaaaatatagctgaaggaaattaaagaaatcctgaataaatggagagagatgttaatggatcataagattcagtattgttttcaatctatagattcaaactgataaaaatcccaggaggctttttggtagaaattgataagctgattcttaaaatcatgtgaaaatgcaatggacatagaatagtcaaaacaactttgaaaaagaacaaactgggaggacttacactacctgatttagaagataatgtggtattgatgtcaacagaaacaaatagatcaatggaacagagagtccagaaataatctatacaactacagatgttcctcaatttatgatggggtgatttcccaaaaaacccatcttaagttgaaaatattgctagtcaaaaatatacttaacacacctaacctactgaacatcatagcttagcctagcctatctttttttttttttttttttttttttgagacggagtctcgctctgtggcccaggcgggagtgcagtggcgcaatctcggctcactgcaagctccgcctccagggttcacgccattctcctgcctcagcctccccagtagctgggactacaggcgcccaccatcacgcccggctaattttttttgtatttttagtagagacggggtttcaccgtgttagccaggatggtctcgatctcctgatctcgtgatccgcccgcctcggcctcccaaagtgctgggattacaagcgtgagccaccgcgcccggccagcctagcctatcttaaatgtgttcagaatacttacattaccctgcagttgggcaaaatcatctaatataaagcctattttataatacagtaatgaacatttcatgtaatttatggaatactgaaagttactgtactgaaaaacgaaaaaacacaatggttgtatgtgtactggaagtacagtttctactgaatgcaaaaacttgcagctgagtgtgttcattatcttggttgtggtgatggctccaccatgtatatgtatgtcaaagtacatcaaatcgtacacgcaaaatatgtgcaggttattgcatgtcaggtatacctggatgaatctgtaaacaatgtaatgaaagcaaaacaaaaagattaagagagcaaagtttgtaggctaaatggaaaagaaataccaccaagcggggaaccaaatcacagggtggaggccctggaggataagggtcaggagaggagaaatgggggtaggtctcttaagtcaaaaggctgcgaacttctctattccatgttaggatagcagagtttccaagcgctgcatttggttgctgctagatggccttgccaggctagataagcattgggctgtctgacgatggtctcctgcatagtttggtctcctgttttcctgtgtatgtgacatgcttaagttaggattatgtcactcaatcacatctgcagtggtacagcacgctagctggccaggtcgcggtttgtcagtagtcatgttttaaaagctgcccatttctgggttatgcatatctactaataatggctataatatggaatggaaattaactgtgtcatccagctaaatttcagctcagtttctggtatgtatattaatgacttctaaatactaaggatgtcaaaatgatttagatataatgcttttggtctagaatgggatatatactcaaatagttaatcaaaggtctgatccatggtgggcttaagtggagaggcacatatttctctcttggggaggcaagggaaaggaccacaacattctaactctctcagccaatcctcttccactatgcatatataggttgtgtggtacttggaattcctgtatcatacttagcctttgatatggctcttgagagtaagagacaacagaaaaatgttgcatttaacaacctgttacaatgcttgttagagtgtttttataaactctaaggtgttatgcaagtgtcatagttaataaaatagcctacccaacacccaacagacagactggccatcttgccacccaaatcctcccttggatagaattagagggggtatggaatttaggaattagagtgtaattaattacattgattatccatagtctttaaaatattttaaattagaaacaagtctatttaaacagttttaagatttacaaaggatgaaacttttcattaaatgaaagaaatagaggggttaagccaggaaatcctattttacattaagaaaattattaagagacactggcttaaaccctagttccctctgagtttatagggagagttcccatggagtgggtgggtggagaagacaaagacatagatggatgctgatgaggaaagatgcgggggtccttttctgttgaccaagaacactggggcaaagcacagttgaacagcagcctgcagcctcacaccatggcaccttttgagtcccatctgccctcatgtgctgggggcaggaggtggtgacagagggcgtgggtcatggccagaggttcctttcctcaaagcaaacaagcaaacgccacatacggctccccaaagccaggacttcttccctttggtcagtattctgggacttctattagcacattagatttttctcatttatttgccttcagtcaaggaaagcttatgttttcatcctttgaacaaatcagacgtggcaaatcttgaaggagaggtggctgtcccccaccactgtgctgctcagaatgtcaccaggtgggctggtgagaggagcacacagctgttcccagctgataaaggggagagaagattgtgtccttgattttatttcactttctttggtatgtgtgaggcatggtgccaagatcttggttttttttgttttttttttttaaactatacttcttccgtttcatcaaaagtaatttaattttgttttacagtgaatcctaactgatgtttttacttttgggggatggagagggtgctatatttttgtggttttctgtgcctgactgggcagagctttggatcttgtcccttgccccatgctgcccagggcctgccacttagcaagtactctgtagatatgtatttgatgagcaagggcctgagcatggatgtctgaggtgcaggcacgcactgctgactggagagccaggcagcagcatgggtattcttcagcacagttcttttctgggagggtatttcttttctatgtgatcaatgagaacaggagtctccaggataattttatgtaagtcagtctttttgtatatacactgcccccctaccccaccatatgtaaaatggatttcgcatatgcctttccacaactgcagtgcctcacctccccaaaccgctgtggctgatggactctgggccccaggtggagctgtgctgcccctacagcctgcagaaggcccagggtctggccttggcaatgactgtggttcgtgaagtgggtaacacaatgacacatacgtgttctctgaggggaaacttcgttgcacacagcccagggaatttatgttattgtaactttggttctgaggcgttcttttattattattattactattatttttagtaacagctttattgtgatataattcatttaccatataatttatccatattaagtatacagttcaatgtttttagtttattcacggtatgtggtgcaaccatcaccaccatcaattttagaacattttcatcacctgaaaagaaaccccatgcttcttagccatcatttcccactccctatcccacccacagccctaggcaaccactaatttgcttttctgactctatggatttgcctattctagacattttattataaatggaatcatacaacatgtggtcctttgtgtctggcttattttgcttagcctgatgttttcaaggttcatctgtatcagtacctcattccttttcgtagctgaatactattccactgtatggatagaccacattttgttgagccattcgtcagttagtggacattccacttttaggctgagttatgctgctatgaacatttgtttataatctgaggatttgtttttatattttcaatctttgtcactttgaactgagacatgtacaggcacacaattttggctccttttggaattcccagacatagtattgcttgatggcagcggaagtccatggagcacatgtcatgcagctgaacacactacggggtagttaaaaggaagtacttgtttatgcagatggggttaattttagggaaagtaagcttgaaataattttctctgtacttttgataattttctgtgtgtacctaaaacatacattagcatgcatatttaccatttcaaatatgatgtgtgtttggctaaaaaaaataagggtctggccgggcacagtggctcacgcttgtaatcccagcactttgggaggctgaggcaggcggattgcgaggtcaggagtttgagaccagcctggccagcatggtgaaacactgtctctactgaaaatacaaaaaatttgctgggcatggtggcgcatgcctgtaatcccagctactaaggaggctgaggcaggagaattgcttgaaaccgggaggcggaggttgcagtgagctgagattgtaccactgcactccaggctgggtgacagagtgagactctgtctcaagaaaagaaaaaaaaaaaaaggtctgtgccctcaaagcactcatgtccagtcttgctgagggcagaagggtggctgtggggtgtgtgtggggacaaggcagacatccagcatgtggggcaacatggtgtctctgctgaggatgaacagggcactgtcagagtatcaggggacacctcagaccagacttagggtgggatggtagggaggttgggggaagcttccagaaggaatttctgaccaggttggaatctacaggaggaatgggtataaatgagcaaaagaatcagggtagagaaagaggaaggagagagtttccaagcagcaagttgagcatgttcggagcaccacacattcagggagttgagagggggactcaaggcgaggtgtggtgggaactgcagatgagagaagcggggagggccctggtacctctgatagctgcaccaggtggtttggactctatcctatgagctgggaagtcattaaacggagccccatgagcagatctgctttttggcctctcagaaggggacacacggggccaagggtggggtcttgtttcccctgcggtgggagggcaagtcatctctggggcgacagtgggaggtttgaggctgtggggggattctggaagaaccaatgtggagaacaaagtgagcacagggattggagaagcagcttcagggctattgaaaagatgaatattttaaattcgtatcatcagacattatggaggtccctagggatgtggcaaagcactacacttacgtaattgtgcttcagaatgtcccttgccttacctgagttaaacttagttgaattgagctgccttaattgaactgaaagtgccaataaaaatagagaacaaaaactgccaaaacaaattctgtggttgctggagcaccagccatcatcagtctcatgacagccaagactcagcagctccctggttgatttcacatatttattcttgctttgaaatggaaagcctggaagagaagctaattattaaagggaatcaaggagtcaggcaggggtcggggggaggagatttatctgagctgttactttgctgccattgggatgccacagtatctcaatcctagagttggaggggagttaaacacagggcagggcaggatgggggaggcagcctacccaggacgtggctgtggggacctaagcagatgtgttcctgcatgcgttgctcagtgaggaactgaggctcagagagctccagatggtggctagaaagtaggtctgtctgactccaaatcagtggtcttcctgccccagccaggtgccactcaagcgagatgcagaggtggtagcaggggccctgccatggctggctgcggcacgtggtacacacaaggaggtggcagaggaggcttcatcacattggccattcctttgtttattaaactccctttagatggggagccctccgtggggctaaaagtagaattaatctcaccttctgaccatctctgtatctgttgctgcagatgagaaacaccacgtaatgatttcgggagactagatatactcgccacggcaaggccacaattatgggcctggtggacacttcaggtggcaatttagtctgtctgcattaggccaggcttctcttctagctctgtgacggggctggctctcagggaagatcccctgggggaggtaagaccatgcttataagctcctgccacacatgcagctgtcaaagcaacccagatcacctcggagcaggcgcacggaacagctgagcacacgacttctgctcctttgctcagagcaatgacttctggcttttattctttgtccaggtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgaggtacgcgccctaaggagctgctctgcttgggcttgggatgggattatgtgctccacggagggtgaagtgatttgggaaaagtgtctgcaagttaaggaaaatgaatgcctgaaagggaatggggaatttgtcagttcacacacctgtaagcaaagatgggcacagagtgggcatggaaggaatgtcatgtggtatcttacaggctctgcatggcagccagtggtggctcatgggtttttcaattgctggggtttatagcctgtttatggagtcctaaaaggggcagttcctcccctaacacgaactgccacccctgtttacaccacccagggctgaggccctgaggccactttttgtggagaggctaagacccgctcccctagatggcccctcgagctggtgatgcgaagaagtgcacaaatgcttccctaagagttgttctttcggtggcatcaggaaattaaggataagacttaagagaagtggtggacccagcagatttaggaaggcagggctgtaggtagggcatgtttctgatcaggaaacgtaattgtgtgtgctgatgaagagggtgtgcagtggtggctactgttggtacaatgatgctcagtgcttggtgtcacccacgatgagggtagccttgccctggagctggaggaggggaggggagggtggaaggtaattaactggtcactgaggaggcaagtctagaggctgtggagaaggacaatatacacctcgagaatcttaagtgagatgaagacctctgcctttcccctttaatgattgctcagcacatagccatttgcagaacagatcctgtgtttgtagattccttcattgtgaatttatctgcttgctaaaatttatttgtaaccccaaaatcaatatttgtggtgtttttgaggtcatgaacagagtggcagaaattttgagttgccctttatgtacagtcccagctgagatggaacaagcagctgctctcatactgtcaacaagtgtcctttacttggtctacttagtgccatggttttacatttttgtgcttttggtgacttcactgtttaaaatgcccccctggtgtggtgctgaagacctgtctagtgttcctcggtgtgaaaaagctgtgatgtgccttatggagaaagtatgtgttaagctttgctcgggtgtgagttatagtgctgctggccatgagttcaatgttaatgagtcaatggtatttatcacataaggcatctttagaaagaaacacacataaaacaaggttttgtattgatcagctgatgaagatgtggccagaggcttgcaggaacctaaccctgtatttcccctatgagtgaggattcagtgttcacagtgactttacggaacataattaccgcaaacaatgaggattgattgtcctatgtgtcaggccattgtaggtgtgtggtgggacacagaggctgacaagacatcgtccttgcccttgagcctaaattatcagggggagctggatgcacgagccatggataaatgggctgggggaagagtgggtttaggggtggggtagactggctctgagcaaagagagccggggaaggcttcggggttcctgtggctgcctcggaggagggaatctcagcacctttttgtccccatagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtgacgcctggccctgaggtgaactggcccacagaggtcacaggctgaagcgtgaactccagtgtgtcaggagcctgggcttcatctttctgctgtgtggtccctcatttggtgatggcaggcttggtcatgtaccatccttccctccaccttcccaactctcaggagtcggtgtgaggaagccatagtttcccttgttagcagagggcacatttgaatgcagcgtttccacactcaatggcctcataggatctcagtgtggtctttcttactttccttcttccttcctcccctttgtgaaacatcttaaaggttttggaatgaatggtggaaatctgacttggaagggctgcgaatcagaaaggggagaggaagtgacacgcttacagaagtgggctaacccttcttgtgtggcacacactacccttccctctgagagttgacctttgctgttttccggaccactccattgtaagattgaaaacccctgtggcaattgcgtacttacctcccaggcctgtggggactgatcatatcatatgatgcttattctgtcaaaggccagagggactgtggttaagctgggatgtgagtcatgttctctccctgaccttgctgccagctgcacacagatttgtccctctcgatttgtattcacagagcctgccaataatttggggtatgtgtgtatgagcgtgtgatcattttcatgcaggactgtgggagatacaaatctcgctgcttctggagctgctcttccttaaacctgttgtcccatggggccagcgtgggtgctggagaaaggccgtgtttgcaggaatggggttctctcctgtgggtgtgggtgacagccacagtgtttccctggggcaatgtggatgcagtttccatcttgtacaacctcataagtagcagccacaattgccccatcagtcaccacaagtagtcagggatactttgggctgtggatgtgtgcagtgtgctgttttatggatggatgagtagctatgcaccccagtgtgtcagctctggggccacactgtatagccttgatgagtacgccccttgaacaagacccagtttgtgaactctccttaaagagaaatatttagggataattatttatagcaagaaagaattcttttacacttgagagctcttttaaaaatattttcttattggaaaatttatatggtgggcagggtgaaaaagaaacagtaaaaatattagttcttattccaagtggaacataaataggacatgaagaagggcacctctgaaatgacaactttaactcaccttttaaaagatgtgaaatttccagttttggatacacggtgaatatgtaaaatgagtaacagcatactatggaagccagcaattaaataatcatgtttcattattgcagtaacgttttaaacaattaccttgtgatatgatattaaatatattttctttttgaaaatatgttcactttgggtagcacatcctgtatttactaagtcattaggaagactgcattcagtgttaccaagactggtttttgctagtaagacctcgaataatccataattttgatattggtgcaattttactataagttgagcttagctgtttcagaaatgcttggacaagtacctagagaacacactgatgtctgtgttctgaggcagtctgaagttattcttagagactcagttacagctttagtaagatttagtacaggcaggataagcttggtttcataggaaccagggaaccagtgttagtgtcagcttctttcctcctggtcagcctagaatcccccactcccaatagaggggtttggaagctggagagtaggaagtaagaggcaaagaaggcagccttcagcaactcattatctgccagtgaaattctattaaatgtatttttaaaagagattaccaggtaacaaaaacataaaaaaccaaaacaaggccagatgtggtggctcacgcctgtaatcccagcactttgggaggcc

SEQ ID NO: 13306 - DNA, 95561 bp, Human; identical to SEQ ID NO: 12768
  misc_feature (1)...(95561): n = A,T,C or G

SEQ ID NO: 13307 - DNA, 95561 bp, Human; identical to SEQ ID NO: 12768
  misc_feature (1)...(95561): n = A,T,C or G

SEQ ID NO: 13308 - DNA, 61664 bp, Human
  misc_feature (1)...(61664): n = A,T,C or G
aattgtcgcagtactaatttacttacctgtggaatatacaacttccccagcctgctgtcaagaagatgcataataatggaataaaggatttaaaatgccgaatactataaaatatttcacttatctttcaatagaaggctttgactaagccatgtattaggtggctataattactcattgctggagtgtaaaacaaacaaaaaccttgtcacatatacatttacctggtagaatgacaagaatcaagtgaaccaatcttttctgatgtagagaaaaaaatactaatcagattacctaaaacatgttcttgatctgcatggtttagagtaaatgtaccagttcaattactattatgttccgaattacaaaacacttcctttttgttgttgttgttgttagtattatttaagacaatgttttttttttttttttttttttttgagatggagtctcactctgtcgcccaggctggagtgcagtggtgcaatcttggctcactgcaagctccgtctcctgggttcacgccattctcctgcctcagcctcccaagtagctgggactacaggtgcccgccaccacgcccggctaattttttgtatttttttagtagagacggggtttcattatgttagccaggatggtctcgatctcctgacctcatgatctgcccacctcggcctcccaaatttgctgggattacaggcatgagccactgtgcctggcaagacaatgttttttctatatcaaatagtaagacaaaggagtaatttactgtttttttcgcccaaaaatgtggcaaagtttctaaaggagatataggcatatatggctttaattgcataaactagtaaaccaatttgggacatctgtaccaagcaatctggccaccaggatttttttaatggtagattgtgtttttgaaaattaatatttcccatggaaaagtatcactcaaaagtataatagctgacttttttgttacagtttgttacagttcttacagttgatggccctcactggtacttagatatgtttgacacatctgtgaaaatgacctagcaactgtgcaactgtaatttttgttataacaaatgtcattgtagttttaccagttttaacaaatatgcttgattgtttatgatacaggcaaaaatttatagataaagtttaggatttcctaaggaaatttgaatagaatcgctcatttaattcttacagtctattaaatacaaattctataggttgctgaatcacccatcctatagtattattaggtcctctaaggaaaaaaaaaaagttttctggtcaagtttgggaaatgctggattaaatatgtataggcttatctttattgttgcaaaatatcactttaaaaactttatttcaggcactttgatatgctaatctgcactccgaaaagaaggtgtatggtcttttccaaccttatttgacccaaaggtcctatcacagctcatctctgaagccaagagtctgcagagctggctctgcctgactcacgcctggcacatctcagggattcaatacattttagcaaaatttcaacattatccactttcaattgaattcaaatggtctgtgatatactttgccttaaacttgttcatgaggataaatatgcaaatagaatcagaaacacaaactcattttttctaccagatctcagcccacatattccaaggtaaaagagtagcgcaataatccattctggcacattgacctatggcaacactattccttaaaataggatttttaagcggtagaaaaggagaaagaaaacaacagcttcctacccagcacatgccttccatttagcatgtctggaagaccgtctccttcgtttcaaaattgatagccaactttttttgttgttttgctattcaaatttctgtcctcttttttcccagcctatttgctctaacactgaattttaagcatctctaaaaatgcttgttatgttattattctttccagatatcctctgagagccaagcaaagaacattaaggaaggaaggaggaatgaggctggatacggtgcagtgaaaaaggcacttccaagagtggggcactcactacgcacagactcgacggtgccatcagcatgagaacttaccgctacttcttgctgctcttttgggtgggccagccctacccaactctctcaactccactatcaaagaggactagtggtttcccagcaaagaaaagggccctggagctctctggaaacagcaaaaatgagctgaaccgttcaaaaaggagctggatgtggaatcagttctttctcctggaggaatacacaggatccgattatcagtatgtgggcaaggtaggattcctttgagtgctttgacattctgggtttaaagcctgaagaagttacttctaataaatagatggggaggatgtgtactattccccaatatagtaagaattgttgcttaactggtaagactttttttttttccacttgagtagtttcgggaagaagactagcaaaaagctgagaaatgttagccctgcaacaaagagagagaaaatgctccagttgaaacacccacaaccatccgcataggattatcataaatcctttaatttttactgtagcttaaaaaatgtggtctggctattctataaagtagggtgtattaaaaatcggaatggagagattaagctgtaaggaaaggaagtctcctttttctctcattctaaaagcaaatgttctgagctatagtcctttggccaagttcaaattaactacttcttaactctgctacctatagaaccatccattctctggccaaatggagccctttgctgtcaaaacccaccactgccttagatttggcagctgctgctgctgctactgtttagtcttatctcaaatagttggcaaaaaacaggtatttcaaaatcttttgatttaactgtggcaaaatttgtaaaagagaaaaatgcttatgtaaaggtactctttccaaatatcatctgaccattttattgactccagaaagtaaagtgaggaggcatcacttattatagccctcacagattctggagctgagtcagggaaacagcttggttagcctgtcatcgtgagtttcgttggaattttatcatcagctccatccttgttgcagaatatctgcatactgaaaagatgtcaaagaaaaaaccagggttccaggttctgtgcctcataaggtaatgttgattttttaaaaatcattgtcacacatcccttcataaacaaactgataatgaacataaaaagatacatgagaaaatgcattcatttgtgattacagctatgattttaagacatctatattaggatatcatgcaaaaaacatacactttgcagattccaaaggctgcatgttcacacttcaatctgtgatcaaatatccctgaataaccatatgtaaatattctctttaagtatttaccaccgtaaatgaaggaaagccatccacggcttgggctgatgtaaccaggaagtattccaatgctgtgaattattaatgtagaataaagtaagagaggaagtattcagtgaaggggtgaacgtcaacacagatccccaaggatctagccatgtatttgctgtgaaattcacactctgtgtgactactaaagacagttcagctactcgtacttcactccatttcctttgtgaaatctgaagaactctaggtgaatcaggtgatggttgtaaaaaataatcatcatcttaaaatctttaaagcactttttacaacacaaatagcattgttgccatagaagattaagttttaaaaagtgctttatctaaatgatgtttcccctttttcctttccagttttcctctccaattgtgatgtcattttacatctataatgccacatattcttaaaaaaaaaaaaaaagcggggagggggcaggttatttcaggatactagaaacagcagtggctaaaacctcgtaagaatcagttttacaattataattgtgagaatattgccatggggaaaagttacaagctgtggactcaaacagatccgagaatgcgtcacagtgctgccagttgccaattatgtgacctaggacaggttgttaacctttctgggctttcatttcttcatctagaaagtgcatgcagcaatgcctacctggtggagttgcagtaaagtgataaaggcactagtgacagggacaaagtaggtgcataaagaagttactattattggtaaaaaatccgttgtatatgttctactaaatccatgtgcaacacattgaagtggcatattgactttcatatcactgcagaagtaaactgaggtaattaacaaagctcagtggaaaatacacagaatcatggcaaaatctctttacaaccacagctttgactggattcgttggatttggatattttatgggcagctagataaatttccctccctcttcatcacctgtccttccctgctgcccctccttctcctccttgtagttataacacatgagatatttgctggaaaaaaaaatcaagggcaacaactgaatttgtcaaagttgcctcatggctgtatcagacacgcgttagaggtggttttgagctgttgatatggcatttcctcaaattcctctttgaagttatatgatataaacagatgaaacaattagactagtattttttaccacaattaaaaataatagaaaaaaatacatttttaaaaaagataaaggagagagttgcccctcatttgtggccacaagttggtccacctttaatttatctgggataaaagagacacctgatgcgattatccagctccactaggtcaggaaacttttggcaggaaaaaacgattagaccagagcagaggttccaaaactttacttggttcacagagcccttaggctcaaagaaataccttatagtgccatgtattaaatagttagactcaaacaacttaataagaatttttgttctaacaacttaataattatttgaaaaaataatacacgtaaattgacaaaaaaaattatttcactcttaaccacacttacaaatggtatgtgtgcatctcttgagcacggcacaatttctcaatcagatcaaacacagccctctcatttccttttccactttgatttttccactgtaattgctttttatcacagccactatggaaaacccagctttataaatataaatcattgaaaggaatgcagcaccacctactgttgaaactgtgaattaccttgagctagtaattcgcaaggggtctgcagaggtcacgtgctgcttatttccctccttttccttccttttttttattttatttattttttcttcttttttgagcgggggtcttgctctgtcacccaggtttaagttcagcagcgcagtctccgcttactgcagcctcgacttcctgggctcaagatgtcctcctgccccaactcccaactagctgagactacagacatgaaccaccacaccaggctatccctgaaaattgttaaatatttcctggtcagctcccccctgcaatccaggttgcctcagtgcatactctgggaaccactagaatagttcgcttgacatataaaggtgtaccaaggctaatagaacctttaatcatgccattcaagcagattactactaaataaaaatcactcagagcttaacatgggtgcctaacactcaaaagatctatctgtatgtggaaggatagaagcattaactgaggaaaagtaatgctgttgagaaaataacacttaaaatagaagaaagaaatatttaccttataaacatctgtttgtgttgatttgaaattatgatgacacaaattaatttgtgataagtcatcgtaggatggtggagtgaggaaaatgagagtaagtgagggaaacaaaaggctttcaggtgtagaagggaggaaaaaagagagggtcgtgggtggcggtggggttcacaacagccaatgacaagaatagacaagatggtgctttacaactgaagcacaagcaactgcagcgagaccttcctcctctgtcttaaccttcctcagccttccactgcgttctgttgccagtgagatgaatgcagagacacggacaagacaaggtggggaggaatagtggagaaagcccattatagctgaaatattgacaaaccaaattctgatttataagaaaatgtcaacaaccactcacttaaaatggtagtggcagggacaagtaacaggataggaagaaataagtggtcctgtgtcgggtaagtttctgagttcgtgagtttaagatataaaaatgggatgtgattgttttctaaaccacatctccatttgggggctgcttggagctgctttagcttgagtggcatctgtggcacctgggaacttgttaggaaggcagagtctcgggccccacctccaatctgaatgaatcagaaatctgcattttaacaagatccccaggtgaatcgtacgcatgttaaaatttgagaagtgctgcttttaaaaataccttccctgggtctcacctccccagaaattctgatttagttggtttttaattatttatgattctaacatgttgccaaatttgggaaccactgtcctaggaggatgttactgccaatcgtgataacagaatgtggcaagttcagtgataaattgggcatccacaaagtgttatcaaaataaaaaggagaagagccaaccaggctctgggggctcagcagagcttcctaggtgtttgaaccccatctaaagacagagccggtgttagcttatactgcagagggagaattgccaggacctcccaattaatcggatgaagaagccaaaggtccgaaagctggagttcaaagagtgagagatttagagattgaacaaccagcagagtgaatgagtcctaacactgacacagaaaacaaagaggtacatattttcttgtcaggggctaaagaaaagagtattttatttttgtacaaaatccacttgggttatctttggcttatgtaaacttaatataatagaaaaatagagggaagccttataattccacattttcagagatccctgtaactctctagcctgttttatgtaacatagcaatttcttgatgatgattggtatatagtctaagattacattccataagaaaaaaagagcacaggtagacgtagatacagattagattttgaagacataggcattcattaatacaaagatgaatttacttaaaataccagaattatgcctaactttaggcagaagatttgcacagtaccattcaacagctacagcaacacttaattcccatctgctccattttatcttccacaatgttctttaacccctccttccacacaatgtatacataagaccagcctccactaacgcattcgaggtgcttctatttttagtaacatgccaggaaatctgtttttatggaatttaataaactgtatattttcaaaggtattttctgatggaagttggtgttggttttggggggatagttttcaaaaaaattgataggctgtatttttttaaaaacattatgaaaatgtgggttctatttgaggccttaatgtacaggctttcccaatatgcctttatcctcagtctttaaaattaatgcctacccaattcaatgaagccactcttctcaagataattaaacagtaacgttttaacggaccataaaaataaaagttgtcagccatacacacctttaaaattagaaatgagcaattatttgttactataattacatgatccaaattagtaaacatgaagcaatattttatccgttctgaaaggttacttaaaagatgccatcgttgaaatgttgcttttttaaattcttacactaatttttttttcctaaaaagagcataagctgaagaatagaaacctcctggcactaattccatgcgtgattcagcgagtctctgaaccacttgttgcttcaaatagcaatgtcagatgaaagcatcgtcatagctgatattttccgagcattactttgttctaaaccctgtcctaagtgcttcaagtgggttatctcgttggatcctcgcagcaaccctaatgcatgggtattgtttccatacagatgagtaaactaaggctcagagcagtcaagtatttcaggccattgtctcacactgctaagaccccgacagacgatactgtctgaccacctagctactcagttatacaccctcgcctgtatgtccactttgcaaagccattttgaagcacaagtgaaaaaaacccggaacatgcgttggtgttcaatgattgcattctacgcaataccacaaatacttattgagaatctattgtgtgaaacccaaaggtagagaaaaaaaaatttttttaaaggctacttttaaagagctgcacgaatgtctgccttattgttatgcacattcctttcactttttaatttccagaacacattagtggtattcaaaatagttacatgtgagcattttaaaagtagatatgcaattagtgatctttctggtcattgtgatttttttttaagcgtctttttctttcccttgataaccctctctaaacttccgttctggttcaatgacctgcaataatcttttctccctgaatcagggcaagtgccttgggcacatctctcgtcttcatcatttaaatttaatgctcagccatttaactaacatttttatgtttctatgagttagcacatttaagaaaaagtgcatgcatacacttgctcattggatatacttcttagaaaatatttctagaagtaacttctcaacagccattattggcaataatcctcatttgtttccactgaaagtgaaaccaactgatttcactttcttaatgacaaaagtttcaatctgctatttaatactaagaaaacgtcttctatagcagcaattttctggctcttaaacttccctctgtgcacagtagctcatgtggaaagcagaaaagttagaatgtctggccttgatcataaagccaaggtaactcttaccctggccagccgcacagcagagtaacagagaaagcctcacaaggaaccgatcccagatcctccggcttccatttcatcatgcctgtggaatcctagagcctcctgctcgaatttagtttgttgaacaaaagggagggatcgagctgggcatgtggcttacgcctgtaatcccagcactttgggaggccgaggcaggcatatcacttgaggtcaggaattcgagaccagcctggccaacatggcaaaaccccatctgtactaaaaatacaaaaattagacgggcgtggtagcgcatgcctggaatcccagctactcaggagactgaggcgtgagaatcacttgaacctgggaggcaaaggttgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgcctattgttgccatccttacgtccatgagtacccgatgtttagctcccgcttataagtgagaacatgccatatttggttttctgttcttgtgttaattcacttaggataatggcctccagctgcatccatgttgttacaaaggacatgatttcattcttttttatggctgcatagtattccatggtgtatacagaccacattttctttatccagtctaccactgatgggcacctaggttgattccatgtctttgctattgtgaataatgctgcattgaacatgtgagtccatgtctctttttggtagaacaaaaatccctaattttaattttgactaaattttatttcaaaaatcagataataaattcctgacatactgtaatcaagcatcagtagattcctaaaccatgggtgtttttcatttccattgatatgaaaagccaagaatacattgtaaccagaattatacatttaacttttagaggcctcaacctctctagccaaattttaaaatgtcttccttatgttccacccacatttaccaaaaataaacagacatacgggaggggtcctccctttgacagccttcatcaaattaggagattatgtttagatgtcaatgtgccattgcaacctcgagggggcaactctgtgtgtgttggtgtaggctgctgggcgcaaactcccatcttcctacaagcttttattttgccagttaccaagatgacaataaaatgtaaccgtcatgaacatgctaaatacatcagcgttctttgcaaacctttctttccatctagaattgaagatcaaaaagaagtacagaattccccataagaaaattagagcttttttatcacaattatcaatacataagtaaaagtaatgggtattctcaaaggcccatgtaaggagtcaaatttgaaattatgtgacctggaataagaagcaaagaagcatgccaaaatatttcccagggaaagcatttataatttcttccagttttttattcacagagaatatatatgctcaaaaaagagaggcattttaaaagattaaaatatatacatataaaaatatgaataaatattttaggtgagttggtgtgtttcaaaggacttgagggcagtgataagggcataataaaaagcttgaaatatcactctgaatatgggatttaatgcccactagagggaatggagattggagttaagaaggtagttgaagaagttatctcagttatggcctttttggaatagatttggagagaaaatgcttttcattcattcaacaattacttgctagagagtgtaagtccatagcatgagcagactgtctatgtttcagcctcagctgcacttctgactacgtgtgtaatattaggcaagtaatttaatctccctgtgccccctcgattcctcaactgttaaatgaaaggagtcataaaattattgaggtgagaattaaataacttaatacacagaaaaggcttagaacggggcccaagatatcacacttaccagtaaggaactaaagcaagatccacgtaaggagggaaggtgccctgctgtgaagtgtgccttcaaagaacaggtgaaatggagagaaagaagagccaaaggtgaacaggtgatcccactgatggccaatgttgtgaagccaagtattatgggtcagaagatgctgccaaagcagtgaaggcagctgagtctgatgcattaacagcaattcggggcatgagtttatataaaaatatgaagttgcctttattattctaactataagaaaaataatatgcacacgacacctcacattgtttgatgatccctggcaactggtagattcccctctatttaaggatatttatcctttcatttgaaaacatcatcactttatggtacaatttggggtttatattatttcaattgccatgaatgttattatagaatccggttaactcttgtttgtttgtaataagaaagtttaaggcacccaacaattttttaaatgatcttttcacttgggttataataaggttttaaataggaatcgttatcacagttaagttaggattaatatcgtaatctccttatataattgaaccaaagttttattttgagaaaattactgttgatttaattatttaattaccctgaatgtttcacctttttaagagcagaataattaattctttgtttaaggttgaactttgaccttaaatatattgagcagtgtttcaaattggatcccaggcctactctttcaattagcacttcagatatcgaatgcaaactctggaatacttacatctttgcaaactctgcaagaccctagcctacatgtcttactcatccttatatacccagtagtgcctagcacatatttttgcacataaaaacagccaaatactacttgaattaagctacagtgagcacagaatattaaaaaaccaccttgttatctaaaaactaccttccaatttttccagctttattgaggtataattgacaaaaattatatatacttagggagtacaatatgatattttgatatacgttgtgaaatgattactatcatgttaattagcatatccattacctcacatagttaccatttgtgtgtatgtgtatttgtgtgtgtgtgatgagaacatttaagatctattcccttagccaattttaagtatacagtattatattaactatagtctccatgttgacatttgatttctatgcctcccaattgattgatgcaatggtttgatatgaatatctttgatagtgttttgcagcattagcttaacaatggaaaatctaatgtctttaaagttcaaggatgttttagatagtaaacatataaaccaagtgtgttatgaaagtctttctatgaaaactacctctggaaatttcatatcaaaatggcacaaatattttatgatacaaaagaagaaaactcaagcttccttagtgcaaaacaagggaactaaagacaacatggtggtccgtgcacaaactaacaagaaaaataagaaaagatataacaaataatattgtatcatgaaagctggttcctttgagacttttacaaattaaaatcagacattatttagggtctcagtagaagaaagtttgaaacaaaatgagaaaaaggcaaacagatttggccaatggaaaacaaatttatttttcttaaaattgctaagaagctacattgtacagacaattcaagtgttcagcaaaagagaaatcatttaaaacctgagattgttgattgcaaccattcacaaaaatatcagctatagagagaaatgtgataatatagggacagaaaaattatatgtaatgacattctttttttaaccaactatatatcttttaatcaacatattttgagttctcacagaaaacaatcatttctggaaaataatctcatcttaatgctttctactacttatgagtacaaatcagaaaagaagcacaaaagaggaaatgtagagaaaatcctgctttaaaatacagttacacaaagctttagcatgctggattgttttgttttcataaattgtgaaacataaaaatctggctcatttccttattattctagagcatgaggctttttgaggggtcagaggtattaggggtcaatgaggatcaacatcccccaggcagcaaagttcccctttaagaaataagaaaagcattatacttgaacattgaacaacccaagggttcagggcaccaacctgcatagttgaaaattcttgtataactttcaactccccaaaaacttagctacaaatggcctaccattgactggccgccttaacacatattgtgtatgttatatttttatatactgtactcttaaagtaagctagagaaaagaatatatttttaagaaaatcatggctgggcacaatggctcatgtttgtaatccaagcactttgggaggccgaggtgggtggatcacctgagcccagaagtgccagaccagcctgggcaacatgggaaaactccatctctaccaaaaaagaaaaaaattacaaaaaattagccaggcgtggtggcatgcacctgtagtctcagctacctgaggtcggaggatctcttgagaccaggaggtcaagactgcagtgagcaagatcatgccactgcactctagcctgggtgacaaagtgagaccctgcctcaaaaaatatatatataataataaaaactaataagaaaatcataagaaagggaaaatatgtttactattgattaagtggaggtggatcatcataaaggtcttcatcctcatagccttcatgttggggaggctgaggaagaaggaggggttggtcttactgcctcgggggtggcagaggcagaagaaaatctaagtataagtggacgcatacagttcaaattcatgttgttcaaaggtcaactgtactttcttatgctgtttgtgccttgactgttctgtctatcctcccaaccacatatatcatgttaaaagaaaaaacaaagggcagctatttagcttgtattaaagctatgatcttgctgattaccaatccacttgcctcttaaaggaaaatagagtcttcaagtcaaatcgagaaaattcagtgacttgggcaaagttgagtggtggtacttcatttcattttatctccttttcaacagtagacatcgcttccctgagttttaaaatgataacgtggccattgaaatcttgactgccacgcaaaccagcaattaacacctgaagaaggggaaggtgtagggtgggagagagagaaaagagaattcaacacaagagaaagtattccctggcaggctacgagtcatcacagattatcttttagcagagtttcatggcagaaaacttgtagtgaagatagggagcaatgataatattgtctcgcattgtgtcgagctttacagcttataaaatgctgtcacatgtacaagcattcctcaggtgatccacataaccactctctagttgaactttctcaggggatccacataaccactctctagttgaacatgattcattccttttgcgtgtaagcaaacacaagctcagaggagttcagggaccccagggccattgccagcacagtaccaaagctgaggctagagttcagctttcttgaggggtttaagtctgatactctttccctatatcacattattaagttattaaagtagcagagagtatttcagatacggtgggcaaatgaaacaatgacatacgtgggagggagaggagcacaaatttcatgccactgacattgcagtgaggaaactttccccagcggggtcgtcagatagtatgaatttctctttgctaatgtttcagttggtttctttaactgaaagaggaggagggggagaaggagagcttttgaaatggaggaggaagaggagaggaggagaagaaaaaggacaacagagaaaggagaaaggagaaagggagctttcaaaatgaggaggatgaggagagcttttgaaatctaagctggctcccaagcaaaaaaaaaaaaaactaataaatgagctcattatcttctttcctagaatcatttgctattaattccctgatggtatgagaggttatagaattcaatttactcatcatttattgtgcacatacaggatgcttgagagttatgaattcaagtaaaaaaatagtcatttgtcttatagagatacatagctttaactttttagatcctaagtaaaagtcaacataaaagaatataatatccaacatattttttacctttcaggaagaacatgttttagaaaaagtccatttgctattaaggaacacatttttttaaatttctgccctttgaattatcatatctcaaatgcctgcattttatctattgatactctcctccaagacatatgtgtcaaagagaaagagagagagagggagaaagagaaagggggctgggggagtgtgtgtggggggtgtgtttgtgtgtgtgtgtccttttttggtgattgctgaagaggttacactataaagcaaaaaaggtagcattctaactggtgagttacaacgccttactcaatcaatttttgactgggatctggctctcagcttgatttaccactggctttctgaaaatgaaaatgttagactaagcaggagctgagactaatgtcacagtctgccaaggcaagagggaccttggacttcaaaagccaagcataaagcagtaaacaatgcctttttggggaaataactttatgcagttaataaactaaaaggcatttgtttaattgacaaatcctgaatgaacaataacatttattatagtttgtatcatttgtggcagtagaatttacaaataacttagcctggggtctgataataaatacaacgaatacagaaatgtttataatcagtgtggggagggttgctttgatgtgaatgagaatagactttggagtcaggcaggccttggtatcctttctggctctgcgcttaactttgggtaaattacttaatctctctggcctcagtttcctaatctgaaaaaaatggagaaaataaaagttaccccctggagtcattgtgagaattaatgcatgcaacacaccaaccatttttgcagtacctgatacacagtaaagtgttcaggaagggttagttttcctccctcctccactgggattcttgaaggaccacacgcagtttcagttcacgttgaatttcagaaatatggagctactgtcttagtttcttgttgctgctgtaacaagtcaccacagatttgtggcttaacacaatataaatttatcatctcataattctggaggtcagaaatgggtttcactgggctaaaatcaaggtgtctgcaagatgtctttatggaggcttcagggaaggatccatttcccgtcttttccagcttctagataccacctgcattctttggcttctcagctcatggcgccttcctccgtcttcaagcccagaagcatagagacttcaaattctctctctctctttctctcttcctctctctctctctctgtccttggctcctatcatcacatttccatctctcactccaactctcccctctttcccttgtaaggacccttgcaattaccttgggctcacctgggtaatccaagataatctccccatctcaaaatccttatcttgatcacatgtgtaaagttctttttgccatgtgaggaaacacagtcacaggtcccgggaattaggacatggacatctttgggggagcaggtgcattagtctgcctactaccactattatcactctaaagttttgttcatttaagttactctggtacttttgacatgaaattcaaggtattgagtgtaaaaaataattgtcaagggaattagtaaatttctgctgtgtttaggcttaaacttcttttgcttttagcactttgtcaaacattctcctccacatgacacaaggtctatttcaggggttattaaatgtaacaaaaaacaaaaaattgaattgagtagggttatgctgaatctctgcaaatacagatcccttatggtattatttaagtgtattttaaaagtcacaaagtacacattgataagaaagatggaaggatggatggatggatggatggatggaaggaaaaagagagagagacagacagacagatttaagtttgatcaatgttctcaattttctgaccccaggggacatttggaaatatctggagacatttttggctgtcacatcttgggaagacgctactggcacctagtaggtagggacaaaggactctgctgaacatcctataatgtatgggacagctccccaaacagttacctagcccaaaatgccaatagagcagagactgaaaaacactgaattagataattcgttgtaactcaaaatattgtttggtacagagtaagcttttaatgaatgtttacagaactaaatgtaaaaacacagggaaaaaaatgtgttgtggttaatagagtaggccacctggactcaaatcttgctcttattcatcgtgccatgctgagaagtgatttacctcctatattgcctcagttgcctcatcacttaagaggggataagaatagaatcataatgagtaacaaattatgtaatctttgtgaccagttcaggtcatgtcccggcccatgatatgggcttaacaaatgtctgctattatcatttttccaaatcccagccagaccaattgccagatgatgaatcacaaaagagaagactttgaagataaaatatttacaccattataaaaatcaattaaatcatttctactatataggaaaatacaaatatggggggtcataagagccaacatggtgtaatagaaaaagaacaggagatatgaaggcagcctgatcccaggttttgtcagaaaaatagattttctagattctctcttttttttattttttttaagatggagtctcactctgtctcccaggcttgagtacagtggcacgatctcagttcactgcaacctccgcctcctgggttcaagcgattctcctgcctcagcctccttagtagctgggcctacaggcaggcaccaccacgcccagctaatttttgtgttttgggtagagacagggttttgccatgttgcccaggctggtctcaaactcctgagctcaagcaattcacccacgttgtcctcccaaagtgctgagattacaggaatgagccaccgtgcccagccctattttctagatccttttcaagcccattttgtagatcaagaaataagctgaccaaccaaaataaaactcactaattccatgtataaatgtagtcaccaagcattacttgcagcatgctctggcatgtaggtcatttttccaccccagctatctcaatggggtttgtactaggaattggcccttccatctactgaagtttgtatggtaggacattcccaaaaccaaggaacttcacattcctggatgtcaaataacacatacaaagacttatttctactgccctgagacacatgaatctgaatccacagggtggaacagtggcaaggtttgggtaaaggtgaaagcagagtgggtttttcccacttgccctggggcgatcacgtggtgagggagaagccctgtttcattcccatgagccttcctgggcttctccagaacaagaagggggtggattgatccaatagatggtccagtagaaggacaaagcaatcctgtagctaggactacatgtgctaagggtgacaaagaagacatagccagacctcgagggcagtatgtgatgccagtgagggacgtgagatgtagctattcaccttgatcactggagagcaaaggtcatgatctgccagaaccacagatgccactgaggaaagtaatacataagagatattctctagagaccagaggatcagagggcagcatgaggactatccttggctccaaaagcccccaaattcctcactggcaaaggccatgtggcttcctctccttcatacatgcagatgtcatctcggactggatcaggagcaaagcaggaggagaaagaaaccagaaagactgggatttatcctaaagagaccgtattactgaatcaggaagattttattgggattgcactaaattactgagttgatattcaacctgtattgagcttctaatcctcaatggcactagagcttgagggaaaagctataaacaaaaataattataaggaagctgcatctttccttgcacatttgagtgcagtgtgagaaaatatgtgaccctgcaacttacgggaaggagtgtttctatttttgctgactttatggcttttcttaccccaggcacatactcaagacctcttctgattttctcccacactgagccttgaaaccatgccatgtgctcatatcggttgctaaatcatttttctcccatcagtagtctaagcttctccaagaagtcttcctaaaccatcaaagagctttcacattccctgattcagtcttctccaacttacaagttccttctatgctattctccagctttttacttaccttgtgaatcctaatacctaataacagtaaagtgtctaatttctgcttttttctgtatattttattccaacgtaaatggcaagtttatagaaggcagagtttagatgcttttattcattgctttatgcaactggtcagaccaattagtgtttttaaatggttgtggttgacagaattaaattattttattatgaaataatgtttccatgaaatagagcatttctctttagttgctgcaacgggaggatacttgaaatatagttcggtaaaatcttgcagctttttcaccattaacagatgacttctgacccagcatccaatgtatttatgatggtcaatgaattcaatgtacttacaattggtccatttttgtcaacaaatccaatacaagttggctttactattgtgttgaagttgaatttgttattaaagaaatgctttcaggtctgaggcaataacttgaattacctcctcagattgttcagattagaccatgtgtctaatgtttagtagtaattgataaattatctggcaatttcaggaacgtatatttttgatctacagaattatcctaaagtcaagaaagagtatagaggacactaagatttattgagtgtctgctatgtgccagaaaccttcactgatcattgatatcttatccaatttaatttttacaagattcatttatttattctttcattcattccttgctatcattgactattagtgtctataaagtgcctgtatatcaggctctgaggatacagaagtgacctagacaggtttggtgccttcctttatgaacctgcaatctagcttggaaaacagctgtgaaacacatcatcagcaacaatagaatgtgctgatggctaagtggggaatgaattgattgcatataggaggagactgtaacttagaccagcagcttaaggaaggcttctctgaggtgataaagattaagcagacctggcacaagagttggcttaactaggtgaggatattaaaagggattgatgtcaagggaaccacatgcaggaaggcgtagctacgaaagagctagttagtgatgttatcttcaagaaactgcaagaagtagggtatggctggaaccaggagagttaaggggagaacgatggctgatgaagccaaagagaggaggagcagaggccgtgccgggctttggaggccatgcgaaggggtggggatgagggctttatcccaagagtaaagaggacactgcaggatttaattagaggagactggcatcttcagagttggtgttgttcttaagttgatctagttacagaaaggaaaatctaaagaaagcaagcctgggtgtgtgtttggagggcctccttgcaatagaccaatgagaaaaggcagtagcatggaccagggtgacagcagtgaaaatgggaaaaggaaaaaagtaggtgaatcaagatatacataagaggtagaattgactagagttggtggcttaatgaatgtggggatagtggcagagggtatggcctaggatgactccctggtggcttttacagagatgagaggaggaaaatgatttggagagaaggtgatgaggtcaatattggatgtgctgagtgtaagttgtctaagagaaagaggtgactatattcttgactccagatctcaagaaaatgttcttccctggggtaacagatagatttaggcactgatggtacagagatagcaattgaatccatgaaaagagatagaggatctcatgtggggagagcatgtgaaaggagggagacaaggaccaaagacacaggcctacaggataccagcatataaggggcagatagaggaggcaaagttaatcatttccagttctatattaggactgaatggagactaagatcagttaatttatttcactgattgataggaaagtcagaattcagatccaaatcccaccactttcccaaaatccacctttggatatttggtgtttatgaattcaagagtaatttattgaaggttttctctgaggtaggccctctactaagcatcttacatacattattttatttattgtctgagaaacctacttgtaaattaagtattattattattcccatcacatggatgaggaaataaaggcctggagaggttaactaagttccccaaggttatgtgacaagtacagagcgtaaatttacactcacctctttcccttgcctgtgtccatgctagtaagtactatgattgtactagttaaggcagtggctctcaaacttgagcactcatcagaactacctaaggagtttcttaaaacacagcactggtgggcatcccctgagtttctgattctggaggtaggtggggccagaaatttgcatttctaactagttcccaggtaatgccaatgtggctggtccagggaccgcactttgagaaccaccgacttagggtcaacgcagaactacaataacaacaacaaaacttcaaaaacataatggttgtagtgcaatgtctttttttcctctttcacattacaggctggtcggatatgaggttattctagaacctgggttccttccactttgtggcttgccatccccttgggcactgttctcatcagcctggtggaaaccaggtcactgcctcatttacattgcaacctgtggaaaaaagaaaaaataggactagagcaagccaattcctgctaaaccagggacactgaagttgcaccctttacattcacacatattacaatgtgaaaactgaatcacagggctgaacagccacacacccagctgacccacagctgggaacctgccacaatcatatgctgccatcagctttctaattggtaaaataatcatcacatataaattagttaactcatgccaaattattaacattcaaatacagcagaataaaatgtgtcatatggaattttattaaaatgcacttttgatttacctaatcctataatctctaaaacagaagcaactctaatccctgccatgtacttcaagcaagttcaatttcttcctgatataaactctacccaacaagcttttcccagccttcacaacactgtctatttattagcattacgtatacatgcattatatataaagatgtatgtatacatgcagacatctatacgtatacatagatattgatgcagttaagcctcaatttgtcataatttgattgattgtgctaatttaaagtaacattccacctatttaacacaaagatgttctctctctctgctgtaattcctgtttctttcctcaatcccagacagcatcttttcaacaccactgttctctaattgtcttataatagctcagattagcaaccataacatttcttaaagagcaacattacatttgcactacaccgtacaagtccttagccataattcaatatttcattttagccaaacatcacttcataccttttctaagcccacgtaaggctgctgtaggtacttttctatgtgtgtcatctaggtaagcttttgtttggattgtttttgttggggggagagggggttcttttatttaatttttattttagattcagagggtacatgcacttgttacgtgagtattacacgtgtaatggtgggggttgggcctctagtgtacctatcaccccagtattggacattgtacccagtaggtgatttttcagccatcactccccttcttccccactttggagtcccagagtctattttccccatgttatgtccatgtgtactttttgtttagctcccacttataagtaagaacatgtggtatttgattttctgtgtctgtgttagttcatttaggataatggcctccagctccatccatgttactgcaaaggacatgatttcattcttttttacagctttgtagtattctggggtgtatatgtaccacattttctttatccagtcaactgttggtgaacacataggttggttccatgcctttgctgttgtgaatggtgttatgataaacatatgaatgcaggtgtcattctgatagaatgatttcttttcctttggatagattacagaatgatctactgaattgctgggtcaaatggtaattctacttttagttctctgagaaatctccatactgttttccatagagattgaattaatttaccttcccaccaacagtgtatgagagttcccgtttctccacaccctcaccaacattgtttggactgttttctgtcttaacaatgcatatgctgcggagattgcatttggtcactgactcagatggtgacttggggacacacaggaaatgggagcaataaggcagcattagctggcttcatagacgactaaaaatctttgttatgcctttgaatttgatttaaagtcaagttggaattcagcacatttagcatgtaaaaacatgctgtgtccccaggaaaccacaacacccagcaggcaaagatgctgccatggttttggtcccacccaccatggagctacatctacaaccaaaatccctgtgtttatttgccaagatgctgtattaaaaaaaaaaatgggcacagtggctcacacctgtaatcccggcactttgggaggcccaaggcggacagatcacttgaggtcaggagtttgagaccagcctggccaacatggtaaaactctgtctctactaaaaatacacaaaaaattagccaggtgtggtggtggatgcctgtaatcccagctacacggcaggctgagccaagagaattgcttgaacctggaaggcagtggttgcagtgagccgagatcgcaccactgcactccagcctgggcaacagagtgagactccatctcttaataagtaaacacattttaaaaatcaacagaggaaacagacaaagaccaagagctccctctggcacgaaatgctacaggtacagtagtaaaaagtcttaccagcgacaggtgagatgtgactttctgtggcaagtggatagtttttacttgatggtgaatcgttaaaagtgaaccagatgattaaacttaatggaacagccacattaaactgaaattagtaaaaacatgccttgggcagcctacagccttttatttgttgttgtttaacttctgtcttttacagtggccatgatggatgacatcacaaaagaaaaaatccaattaaaatctaagtgctcaataaacccctaatgtctgattttcaccaccactttcacaggcactgatgtcttatgtttcctttttttcccaagaaaagaactggccccaggggagtttgatggcagaggaggagagtggggagaaaaagcagaggctttgggaggtttctgctccgtgtactcggtcagacccagaaaatgcactttggagggaggaagggggaggaagtgaaattgctttactatcagacgatgcaaagagaagagatacattttcccactagttttcaaatattgataaatcagaattgtgatctgcaaagcaacccttgctcacactcttctcactcttctttaacgtctcctctgccctttaacattgtttcgggtgtttgttctataagtcatcgaaatggtctcacctgacagctaaaaatacatttctgattacttttacctgaataaatcttgtgaccagatgtggaattcacctattaagtgtgcaacaattacatactgaaaccgatgaaagaactagtggaggagagtgtataatccagtggaatgcagagtataataaatcatatgtaaagatagcaattgccccccgccgcccagttaaagaatactggcttttgatcacagattttaccttagagataccatgtgtctgtaaaattgggttttcaaagtcttcaaaacaaagttctcaaaagtcaaaataggagaaaaagcatgctgattataaactaagagttaataacggtagcactctcttaaatttgggaggcactttgtaatctataagacccatattatgcttttgttgcatgtttacatggtggttaatgtactatttgcatgtggtcttcaattagatcttcacaacagcctggccatgtagctcttattatcctcattttgcagataagaatcctggctgagggaggttaattgactctgctgtgttcttacacttgctgagtgaaaaagaatgaacatggctcatgcctaggaacgtgccccccgcactgtgccaggctgctgaccacagctgccctagagcaaggatccgccaggtggtgacattgctttccttactcatgggttaatgaaatagctttttaagagcctcttcagtcattcgaatttgacgatggagagttaaactttccccagtggctctttgtgtgtcatgatggtttcagcgtttccttagcatatcccatcactcaaatcatgggatgctcttgttttacatttctgattgcatttatctcacttctaagcaatttcctccccattcgaatttatcttccattatttctgccaaattgctttcaagactactaattatatgaataatattctcttccccaaacaccacgattaactagcttttgctgtgttacattaaacacggtttctctacctctaaatatgaggaagttgcaccaaataatctataaagcctcttcctgcgctcaagagttaatcttcagactcttttcccatgagctgtgtgattttggaaacatagcacgcaccggattctcagttttcttgactctacaatgatggattttaaattagttcatgtttcccaaagtatcttttttggaaaactggtatgggggatatcgatataagttacacccaaaaaggattctttaaacaagacagggaaaactaaattacacagaatcaaatgtagtttcaaactgcagacactcagagcctttgacatgtcaacagtgactctaagaaagaggccgtatataaagtatttctttccctcagcacttcctgtaaatgatattacatggaatacacttttagactaggttggattatttttaaagtctctttttgccctaagagtctattttcaaatgtgtaatgcttctccgagcattttgtgcagtattaaccaacaagagaaagacttggcataactgttgttgctgttgttgtagcatagcccatattctgtttagacagaattgaaacaaggtagagagtagcagccttcccactaacactaacttctctatataccatggatgcttaaaactctgggggtttataaatagtcctcctcaataaaaagcacttttcgaaaatttgcaaatagggttaaattatctgaaaacctgcagactgaatatatatatatatatgtgcgtgtgtgtgtgtgtatgtgtgtatatgtatatatatgtgtgtgcatatatatatatgtgtgcatatatatatatatatatgtgtgcatatatatatatatatatatgtgtgcatatatatatatatatatatatatatatatatatgtatgtgtttgtgtatatatgtcctatagacctatagttaggtctaggtaccatctaaaggtatcatctaaccttttgctgggtgggaaaaagggaatttaggaaactataggaaatcaacactgtggatataatctctgggaaaggaaacatggactacttatccaagttaggattctcatcttctatttccacggtatccttagtattcatttaattccaacttttacccaaacccatttcactgacagttagtcatcagagtctctgcttgattacctttaggagcagggaactcaccactcataagacagactatttcaattttaggttggctctaattattagaaggtcctttcctatcttatacttaagtataaatatgaaatgctattgttccaagtgacctgtaaattatctagtcaggtgattttcaaggtattgcccttggcagcacttaggatatttctcaaatgctttgagttgaatttcataaataaataaatatcacatcttcccagaaaaaaatgattataatctctatcactaaagactcaaggaggttgccaagcttccctaaattcaccaagataataaatgtaaggtagaaatagaatatacccaagtctctctgattcaaaaatcaaagtccttttctaaataggatattgcttccctaatatgtttgtgtacatgcaagtgagggcgagagtgtattagtggaatgtgaaagctgtagtgaaaaataggaaaatcgtgaaaagagtctcattccagccaccctaatacgtccttggccaccttgctattgctcttgccttttgttttcccttcttcaaaataaagattactaaattttctcccaaactctgttccagttctgaaaaattccatgattataaggaaacatgttcattaatgaatggtatttaccattaagaggttacgtaaatagtaaaaaaaaaaaaacttgtattccttagaaagaatttaataaaagttaatgtagcatgcaccaaaaagacaaaaacagtttagaaccacatgcttgacttttactttctttaattttttttttctacactagttacattcagaccaggatagaggagatggatcacttaaatatatcctttcaggagatggagcaggagatctcttcattattaatgaaaacacaggcgacatacaggccaccaagaggctggacagggaagaaaaacccgtttacatccttcgagctcaagctataaacagaaggacagggagacccgtggagcccgagtctgaattcatcatcaagatccatgacatcaatgacaatgaaccaatattcaccaaggaggtttacacagccactgtccctgaaatgtctgatgtcggtgagtgagacgtgacttcagccaaaagctggctttcccctagtgcatccactgagtaaggaatcccacgagctcaaagtactgaactgcatgaatttagatgctaacttcttcaatccatgtatgtcctttctgtaagtgcatatgtttcctaatattactctagtctcattttgtgattattttaaaaaccacatttcctctaaagagggtctgaaaagtggcagggtgggagtgggaggttgaaagagagaccatctcctttctctcccaccctaaatgcccattctctttcttgggctgaaagatagcaaccttctccacttctcttagcctatgtgggtgttagggtccaagtaacaatctcccaaatagaaaataaaagcttacatttacaatccagtctaaaaagtagtgatagttgctttaagtaactagtaactgtatatttgggaaggagatcaaagaactttttttaatccataaacaataggcacgttatgtctagggagtggatcctttactacatggtggaaatgaaaagactttcataacatacatagagtgaattaatattttttacacaatacctctacttttttaaataactagtggatttaatttgtttaaattgagagaagtaaacaggatttaaattaagaaaaagaattctactgacatcactcttagccacattgaaatacttcatgggagacactgacaaattttaaactacttatataaaggattatttttattttcactctgtcagattcaaaagggctgaaattacatattaactttattatgattctgtcagttagatatcagagacattgtagttcacagatccaagacatagaaaataacaaatccatggaaatcgttgtaaaacatctacatttttcttatgaagaaattgcttttctcattatttaaagccactttgttttgttacaaaaattgcaagcctcacaaagcaaagagggagatgactggaattttgttttttcttcttcttcttcttcactgcttatagcagcaatagaatggcattctttaaatttgttaggaaaaaaatttctcctctacgtggtaaaaggcagaagaattcatgaagaatagtctcttcatcagcaccactcagggcaactgtaaccagctatgcaggtattgcactgcacaactctagggagtgccattcacttttgaagccattatagaattaaatttgtattacaaacatttaggggtagttgacagtaacatgtcttgagaaaaataaaaaggcttttttcagtttgcacacagacacagttatggtgacattgatcatccttaattgatatctcattattgtgattatagaaaggcatcttcgagaaattacataaaggcagtgggacaacagcatgggagcaaaaatggactttggtatcaaacagaactgaatttgaaactatctccactaagaaccagcagtgtagccctgggcaaattatttgatttctctgatcctctagttttgtatcttgaaaaaataaataataaatgtcaactccaaagggctatcatgaggattagatgataaaacaggtacagagtccctagtacaatatctggcaacgaatagacatttaaaatgtccagatatcatattctaaagcaatcaaattttgtgttaatgttaaataagaacttgagtgtttgttgacttgactcaccctaaaatcataagatgttctcagtctccccacctcccttgccaaattacaacggtgggtggtctgttttgtgcatcagcactatacattcagggcatccaaccctaacatactacaatctatttcttcaataagtgaaattggctatataatacaaaagcaatgtagaattcctaatattccctggatgtaacttacctacccctttcatggaaaggggaactccagcagtatgcttactggttatctgatacaaataacaaaaaacagccattaagtgatcttaatccgagactcttatcctttcgggaagtcacagagccctttgaggatcatataaaatctacagaatttctcctcagtgaaatagacatgtaggcatacacatgaaaatttatgtggaatttcagggggttaggaatactttgaagattattaggcaactgtggtgtctaaaataagaatgctgatctgaaatgtaatagccttctttgtatatttaagtataatgaccttttggaattgcagattccagatgtttgtgctttgctgttccaattcattgattctttatgtaatccataactacattctttaagtttcaaggtctttcaaccgtttagaactatcagatagatttatcatttaggatgcttttattggtaagtaacaagaaatccaactcgaactagtttaaacaacaacaaataagtatttatttgtcacattacttaagtccaaaagtaaagcgggctttggacaggatttgatctgagttctagctgtttttctgtgattttctattctatccagctttgtcctcaggctggcatttctaagatcacaaaatagctgctgcaaatgtatatcagcacattacggtccaagaaaaagagtatctatgacagaatttccagcaaaatcatgagtggcccctgattggacaattcctaaactaattcctgtggacaaaggaagcaagatgctgattgactttgtcctggataactcgaaagaatcactaaagcaagagtccagtcaaatcccgccattggagatgggttggaatcagttccaccccaagtcatgatcattcccatgcttttctgtaacctaatccttaaaatatttctaaatgttgattgtatttctttaaagaatccaatcctttttcacccagcatcctaccaaagttctcgacttcctcagcatgatatttccatacaaaattaagatcgtgctggttttggtgtgtgtcaaagattgatatgaactcttgatgtgttttcagtttatatttctgtcattacaggtacatttgttgtccaagtcactgcgacggatgcagatgatccaacatatgggaacagtgctaaagttgtctacagtattctacagggacagccctatttttcagttgaatcagaaacaggttagactttttgatcttcctttttataatctataattttaattgacatgctcagctgagctagcatatttttaataaaaataatcaatgtgattggattttcttgcatacatccaccaaacactaatgatatatttgtaaacatgacatctgaatcattttaatcaaaaaatctggcaatgaatctttcacccaccctttctatggagtagattgagaaaaattatgtattgccttagttttcttccagtttggggtgaagctaaaaggtaaacccctttttgatagtattggcctgtttacagatattcagaatcttctttttctaattatttagtaggattgtgtctctctattctgctctgaaattagatgtagccatgtgatttatttgggtgaataaaatgtgataatgatacaagtcgcttctaattaaaattttcaaagctggtacacaatctgccacattgctgtcccttgccacagtgatcatggaaaccaatgttgagatgtagtctgtagcctgaatgtctgagtggtatggtgaacaaagctacctgcttacctgctcagagcatgagtgaaaaataaactttagttgtgtgaagccactaagattttgcattgtttgttatcaaatcattgtctagcccatcctaactgatggagtcctaatcaaagtgaaatgccatctggaatcctcttttcaacatctcatttttctgttttctgtattttctccacaaagtagcaacctatcttataatgatttgtttttagcaaatatcatttgtattgtacagtaaattgcacacatatttttatcataatgagtcaatttccttttatacattttttaaacatccattattcttagtagaaatcaaaacttccctaggttcccacatccagttggaaatctctgtgttaagtgctgcaatgaacttggaaagaatcccaaggagaaagaaaatgttgagttgaaaaacaatgaggatgaaaaattagaattattcaacttaaaggacaaaaggctgaggtgatctcctgtatttaaatagagaagtactattatttggagaacagaaagcagccgcactttcactgaaggcaggactataggaataaaattgacctgttgtctgaagtattcttgttaaaaattttaaaaaagatattttcgcttcattagttgttaagcactagaatgtgtttctgcagaaggttataaaggcttctccagtgaaatttgaaagaaagttaatttaagcataaaccttacatagaaattgggcaaacttttagaagttctttaactattttataacaacctaacaacagagataaatttaacctaacttaaaaattttggttgtcattggggccagttgaactaaagttcacggtcagctttaggaattctaaaaggctgaaagaccttgaaccttaattccaaaattctctagaatcatacaagatgatcattatgagagaattgatgttctattttctaaagaccatagttttacaatttagaaaatcctcagagcattcgttatggtaggtgtatctgagggataattagctaatccataatgggaaactcaacagtcagttcaagtatgtggctttcctaacaatttcctcataattcacctaaatgtcttttatcaagcatattatagtatacctttataccacaagccattttagattctgctgtgtcatcttataacacctaatgtttatacatccataatgtaattataatattgagtgtcttataacccttaatagtctatactattgcagaatctgacttgtacttatttttattctccttgtattacaggctttttttaatgtatctatctcccctgtgtggttgtaatatccttcagtataaaggctgcatataattatttttatatcaccatgacatctgcatagcattttgcatattgtgggtgacagtttatgttgtttgcataaatcaatgattccataaagtattcttaatgcatccctttgcactcttaaatttcacatccacaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtaggaacatttgattgaatgaatttcttcaatgtgcttttataaaactcgaactttaagaatttttattttccattgtcatcattattgtcaaagttagtggacttaagaagaactggtacttttattaaaaatgagttgacaacatggcatacactcaggaaatgtgaacatttatgttcctctattggtaattacctgagtgatttctgctgttgttgtaaaggcaacatcattgtttcatttctccttattaagaaaactaccacagacataaatctgctcatgcagaacatatgtatacaagcatgctgcaatttgttggaaaaaatttgactttatgttttgtgaatttaatcaggcatgtaatctcttttaaatcctcacaaagctttataaggggaggatttattattttactgtttctaaaaatacaactgtggaagtaactaggtacttaatccatttgtaatcataagtcgttttctacattatggttagttgagataccgaaagttgtctccaaaatcattaactctagtgattagataaaaggaagaagaaggaaaaacaacctccatgaataccaacttggtatcaggagtatgctaaaaattctcacatagagctacccaagagggaactagttttaacgtaacttttcatccaggaacaaaatccctttgggaccatgatctcctacgaaagctatctcaattattcaatagaaaacccactcattctatcatggcattttaaaaaaactaatcagctgatacgggcttcctttagggtagagctatacatggatcaataggaagtagttttattttctttattttttcaagtttttaatcagagttagctaaatgcaaaaagatcagagctaattaaagaatatctcatataacaagtagaagaaaggttctatgaggcctaccatttcccttccagaggcctgaaatgaaaactattaggatcaccaacagtttgcccaaaacctactttttaatatggagattccctggggaagaataacataaggattcccccgcaccctggtaccacaggaatttgtaactcactctgctctgcttagatagcctgtgacttgttaatgagcaatatgccaaggcaagggagggagaagttagaaaggggcaggaggccctaaaaatggaagttgaaaacactagagaatacttaacctggggcacaccaactcatgcctgtaatcccagagctttgggaggctgagggaggaagactgtgtgaggccaagagttcaagagcagccgaggcaacatagtgagaccctgtgtctacaacaagtaaaaagaaattagtcaggcacgatggtgtgcacctgtagtcccagctactcagaaggctgaggtgggaggattgcttgagcccagaagtttgaggctgcagtgagccatgatcacgccactgcactccagcctgagcaacaggaggaaatcctgtccaaaaaaaatgctctttttgagttacgtacttgagtcaaaaaaagtttaaaaatttttttaacctgctttatcattttaccaagtatgaactcaagggattactattactgaacgcctacattttagtagtgccatagactgtttaaattcttttcaaatcatttgtatgaatggttaacaaaatgtaattgaaaagggtagaataagccttggttttactattttatatttttggtgctaagtatatcatggcctggccaatctaaactgaaactcatatgtagtctctctaaactaagtttgcaacaggagcatattttttttaaaaagtgtctatataggaaacataggtttcaaattagaattacaaatataagtatgggagaaatctatgcataaaataataaaatttaagagtcaaaagaaaaaaattaggagttttatcacttaatgtatttacctatatctctaactctacaactaggtccagctccatgtatgaataaaagaatatctacctggatacagcctccaagttgctataatttctttccacctccagctattattagcaacggtagaaagaactcttttaaagaatacctagtaattaactaaaagtcgcagttcagattaaattcttctctactctttctgttagatgaagttaacaaagggctttgaaaccttctatgcctcctgtagccattcagttgttctcacaatcacaccataaactttggagcctgtttacagacaagaaaagtgttctccatttgcaaggaaacaggtcatgaaatagaagaaacattcttaacaaccacgaaagtagacataagaagaacaggccaccattagttattttgaggaaagcacacatctacctgatggtaatgtcttaaagaactgttagagaataggttttgtttttatgatgataagagtgtggttagtctatgtttgacttatatctgtctggtgattaataggtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaaggtaatgccgcttcttaaacaccatacagagtgaacccatttacttttctccagttcctaagttaccaggggcaattatatctcacataaacattcctttagatttttattttacttattattttcagaaaaatgccagttctggccgggcatggtggctcccgcctgtaatcccagcacttttgggggccaaggcaggaggatctcttgagtcctggagtttgagaccaacatggcaaaacctatctctgttaaaaatacaaaaattagccaggcgtggtggtgggtgcctgtaatcccagctactctggagactgaggcaagaggatcgcttgagcctgggcagcagaggttgcagtgagccaagatcacaccactgcactccagcctaggtgacagagtgagactctgaaaaaaaaaaaaagaagaaagaaggaaggaaggaaggaaggagaaagaaagaaagaaagaaagaagaaagagagagagagagaaagaaaggaagaaagaaagaaagaaagaaagaaagaaagaaagaaagaaagaaagaaagaaagagaaagaaaggaagaaaggagggaaggaaggaaggaaggaaagaaagaaagaaagaaagaaagaaagaaagaaagaaagaaagaaagaaggaaagaaaagaaagaaagaaagaaagaaaaccaattctaatgacactgagatctcttgggttggctttcaggaacctaaaatgatatgcattcatgttaattctatacatccaatgaatttttattaagaacctcctaagtaaataagtaatataaacaaatgatattcgtaaaaatatataaagtaaatactttaaatgaacagtaaataaacagtgccagacattgctctaggtgctggaggtgcactggtacatacaacagatgttctctgccctcatgatacttccagtctagggggaaagagacaaggagccaagtaaacaaacaaacaaacaaatatacaactacaaattgtgatgcatactgtgaaggaagagagtacagcaagcagtgatcaagatgacttgcatcacaaaaagaggatgtataaagaccacaagtttaaattaaataccataacaaatttaaattaaataccataaatttcctggtacctctttagctactttttggaacacaacaataaatcttttgtgttctgatttctatttttttccaaagtactggttcattattttatcccccaaattgtgtagcaccacagagcagcatacaaaaatacggcaaaaattaaaaaccaatgaattgtatgcttcaagactaaaaatattaattttggctaacttcttatgatttcacttttatcatgtatggtgtaatattttctctctcctttagcatactataatcttttctggtaaataaaagcatcggtggatgtaaataacaagagatttttttttcctcccaagctttggattacgtgtcttaatatctggaaacacaataaaacatgtttaagtgacactcagactaatgttttaaactataatataattaggaagcccattagtgtgcattaacctttttaattttcttggtgccttatcagattcgaactgaaattttgcctagacgactaaatcacattcaccaacgtctagattaattgtgtttctagtgagccttgtcatattatcatctaaaactaaaagtcagcaataagcatttgggttcaccatgtctccaaaagcagacctacttttcctaaagacccttgacaacaatgatcactactttctttgacaaataattagcccaatgcccttttcaggataccatttggaatatttcattacctcatgcaaaaaacaacaacaacaaaaaaaaaaaactttaatctgtgttgtctgaatgatgatgagggattcacaatgcaaacctgtggctctcaattctggctgcaccacagaatcaccgggggaagtgtttaataatgtagatattaatctgcacgcccagatatgttggtttaatggtccacgctggggccaagacattggccagttttaaacactcatcagtgcaattaaagccagatatggccaggcaccgtggctcacgcttgtaatcccagcactttgggaggccgaggcaggtggatcacgagttcaagagatcgagaccatcctggccaacatgatgaagccccgtttctactaaaaatacaaaaattagctgggcctggtggtgagtgcctgtagtcccagctactcgggaggctgaggcaggagaatcacttgaatccgggaggcagtggttgcagtgagccgagatcatgccaatgcactccagcctggcgacagagcgagactccgtctcaaaaaaaaaaaaaaaaaaaaaagccagatgtgagaacatctgacatggaataacccactgtgtatttgccaacttgcccctgatggccccctctagtgaaacatgagtattttttaagtggggacagtgtgggctctaccagactcctgcttccaagtgcccttcctgcctggtatgatgccttgtacctcactacccacttttaagtcaacagcaggcatggtctcagcccatacatttttcagggctgtgtggcttctgaactccttcacaaactttataatcgtttcctgcctaacagcctagatataagaaaaaaaattacatcttatcttttctccctttgcccaatatcacacaaatgtgtttctctaagcaatatgatcgcattcatttatcagtggtttacaccaaaaatgtttcgtgtcttggctttctgtgtcttggctgctttaaatatgtcacttcttcccccacccccaacctcaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtaagcacacttctgcgacatgtctctttcataagcttcagtcaatttatattcaaatatctgcctgcacttgagaaaagatgaatcccttttgttccaattagacaactgtgttttcctgaaaaaactattctaaacagcacctttaactctctttgctcactgcataaatattattttggcagaagtacagtagtccctttttatccctgggggattggttccaggcccacccccatattaaaattcacaaatccggaagttccttataggaaatgacacagatttgcaaataaccaaagctcatcctcccccatactttaagtcatttctagattacttatagtaccaattcaatgtaaattctatgtaaatagttattatcttgatgtttttatttgtagtttttttattgtttgctttttgttttttccaaacattttttatttccagttggttgaatccacatttgcagaacctgtggatacacagggctgactgaataaaccttaaaaaaacacaaatttgggaaggaaaacaagctataaggagtttactgcttaagtagaagtagtataaggtgatgcagctgaataacctgggattatttttcaagatttgagatttttttaagtgtaagatttgtcaaagagtggcatagaaaaagtatgatttttaacaaatcaagcactgagcttgacagcctgtttttcaagtgtagaaaaacctatcatgtaacacttaaaagacagaattatcctccattcggatggtttttccttttgtagatgtagataaaaacaagaatcatttcatgatatacgtctgtgaaatcctagggaaattaatacaacagagtccaaatgtatgctacgtaaactaattctgttttccctgtgctttccttacaccttagttgtaaatcatgttgcagtaaggccttattgctctttgggaccactgatgcttcagtattctcggatcttaacaggaaaatgctggagtcaaccaacctccagccttcagccagtagcttagttgactaaatgagaaaagtgctagctgggcacggtggctcacgcctgtaatcccagcactttgggaggccaaggtgggcagatcacttgaggtcaggagttcaagaaaagtgctagaccagaatagcattgtgtcaattactccccataaacaaagtaagcagactgaaaaactagagaaactcttgccaatgagttcacaaatagattctggtcaaggtgccagccaagtgccaggtacattctaggcactagggaatacagccctcatcccatgaagcttacattctaattggggcaagcagaaatagacaaacagtaaatatgtaatacgtcaggcaaaagtaaattttaagtggaaaataaggcagaataaggaaataaagagcacctggagtactattttagataatggggtcagatttgacattcttggtaggggaccatttagtaaagatttgaatgaaattaaagggcgaaccatgttgatgctgggggaagaacattccaagaagagagaaaagcaagggtaagtctgataccagagcttgcttgacagttgaaagaacagcgaggaggcctccgcagctggaagagagtgagagagggaggcgaggtcagatatgaggccccagagaggtttgatagctgatgaggagtgtagcaggtcctgtagggctttgtagttgatggtaaagactggattttattctgattgagatgagaagccactggaaacctttgagtataagagttaactaatctaaaactccgttttaaaaggataacactagctgctacgtgaagaatattattgcagataaaagaatgtggggctctaaggcagcagtcattttcttactttttcccagttgagcctttgttcaaatgaaaccttatgacaagccccacatctcaaacacaaaaattcctggcttactttcagggaacaattttaaatcactgggcaaataaactcttgttttagcatcctactggaatatctacaagacactttgaattgggctgtggtcagccatgtgagctccatggaccaagtgtttctccacatacatttaatattgttaataaggaaatgaatgtggttttcactaatatagctttcactagtatagttttcactaatatatgtgtaagtattttcacaactactctctcttggagtttgttgtaactgcataaggaaaaaaatcttagcaagtaagtatcaaattcaatttgaaagtgttaatgctagaagtttacaaatatgagctttggttatctccttgatagatcaacttttttttaattaaaagagagaatgttttgcgaattcaggcaatatatttccatatctatattacttttcataccaaataccatttttacccactgcattattttctgttttatgaaagaaagtagttagcttgtcagattatgttggctgtcagctaatttttaagttttttgctgccagcctttccttggtacatatggatttgatacgtagatatagatttaagactagaaatacttatagatatattggtatataaatggtattccagtgcccttttataggataaaattcattcttatattagaaaaatccattcatacataatttttgattattcaagacataaatgttgaacaactaagtgctagacaatatggtaggtgcaaaattaacactagaaaattcttccccagagcactgatttatcattacacaagcacaaatctttaattctttaatcacataaaattattttcttctaataacttcatctcaaattccctttggtttctgtgaaagaatcttataatatgtcactatacatacaaattatgaaaaatttatgcaaacatacatccttttcaggaagaaccacaaatcttcctgacttgaggatacattagaaggcaaattatttaatcacagaatacaatgaagtcctgaaaaaaaaaaaaagagctacctagcagaaggatctgctataatcatgatgggattttatcttgtttcttatcagtgataattacaattaatgtgactggacaataaatatccttgatataaatttaaattaccttggaaggaaaaaacaacaaacaagcaaggcttgtgtacaagcaactttcctgaatgatgtgggcattttagattttctattaatttttaaatgtcccaataaaaggaaaaaatacaattttcctatttcctaaatagttactatctctttcaaattgaaagctgccttcaactaaaaattctcacctcttaccctttatgtcaaggtttgataggaaaatataattacttgtaaaatttaaaactacaatgggggaaaagacacaaagaataaaacaagattattgctgtatattattgtaacagcttacagaagcagcacatcttaagcttagcattttccatgagaaaaaatatatatctagataattattaaatttcttatgaagtctatgaatattgagatttcctttttgtaattaacgatgtgctataaatatttatcattctcaaatttaaaataagaaatgatcaagtaagtacaatgctgttgcctgaattcttaataaatattgattcatgacataaatggcaaaacaatagctgtttcatttgtttcaacccttttgataataaaaacataagtttatgtacattgaaactgaaactccaattcaacttgatattatacccattgtgaacttcattaattctctttaaaatcaggtttaaatggcctgtgataattgaatatctatttcatttagacactcactagataacaaaaataaattttatgaagataaaatatattgttcattataattcactacttgtgttttaaaccaaaataatacattcaagtagaatcttgggtgcagtaaactatggcaagttagttacaagggtttatttttcttagagcacccataataattccacgtatatctgcctagtcaggtcatttacttatattgaatttctactgaggcaatgtttttaacctcataaagttttaaaaatccagctgaaatgggcagtttttttttctaatggccttaacatatcaactttcttcagttttctctgtaataccccacccccaccctgctcataaacatagtgtattagtccatttttaaactgctataaagaactacctgagacttagtcattcatgaaaaggtttaattgactcccatttccacaggctgtacaggaagcatggccgagaggcctcaggaaacttacaatcatagcagaaggagaagagggaaaggaaggggaaagtgccacacacttttgaaccatcagatctcatgagaactcactcactatcacaataacagcaagggggaagtctgccccatgattcagtcacctcccaccaggtgcctcctctgacacatggggattacaatttgagatcagatttgggtggggacacagagccaaaccatatcattcttcccttggcccctcccaaatctcatgtccttttcacatttcaaaaccaatcatgcattcccaacagtcccccaaagtcttaactcatcccagcattaactcaaaagtccaagtccaaagtttcatccaagacaagacagatcctttcagtctatgagcctgtaaaataaaaaacaagttagttacttccatacaatggggttacaggtattgggtaaatgtttccactcaaaaagggagatattggccaaaaccaaggggccacaggccccatgcaagactgaaatccagcagcgcagtcgttaaatcctaaggttccaaaataatctcctttgactccatgtctcacccctagggcacactgataaaggagtgggctcccatggccttgggcagctccattcctgtggctctgaaagatacagcccccgaggctgctttcatgggctggcattaagtgcctgcagctttcccaggctcatggtgcaagctattggtggatccaccattctggggtctggaagagagtggcccccttctcacagctccactaagcagtgccccagtgtggactctgtgtgggggctccaacccctcattttccctccacactgctccagtagaggtactccatgatgtctccaccactgcagcagatttctgcctaaacattcaggcatttccataaatcctctgaaatctaggtgggggttcccaaacctcaacttcttgccttctgcacagcttcaggcccaacaccatgtagatgccaccaagccttgggtcttgcaccctctgaagccacagcctgagctgtaccccagaatggtggatccaccaatagccacagctcgggctggagtggctggaacacaggatgccatgtcccaaggctgcacagagcagctaggccctaggccttgcccataaaaccattttttttcctcctatgcctctgggcctgtgagggaaggggctgccatcaaggtccccgaaatgccctggagacattttcccccttgtcctggctattaacattcggctcctctttagttagggaaatttctgcagcaggcttgaattcctccccagaaaatggatctttcttttctaccacatggtcaccattttaaatataagttccagtttcacatcatctctttgttcacacatatgagcatacactttaagaaacagccagatcacttcttgaatgctttgctgcttagaaacttcttctgccaaatatcctaaatcatctctctcgagttcaaagttccacagattctagcgtagaggcaaaacaccaccagtctctttgctagagcaaagcaagagtgacctttaatccagttcccaataagttcctcatgtccctctgagacctcctcagcctggacttcactgtccatatcattgtcagcattttggtcaaaacctttcaacaagtctctaggaagttccagactttcccacatctttctttcttcttctgaaccctccaatctgttccaacctctgcctgttacccagttccaaagttgcttccacattttcagctatctttatagcagtcccccactttcctggtaccaattttctgtattagttcattctcacactgctataaagaactacctgagactgcgtaatttgtgaagaaaagaggcttaattgactcacagttctacaggctgtacaggaagcgtggctaggaggctgcagaaaacttgtaatcatggcgaaatgtaaaggggaagcactacacttttaaaccatcagatctcatgagaattcactcactatcacaagatcagcaagggagaagtctgcccccatgatacaatcacctcccatcacgcccctcctttgacacatggggattacaattcgagattagatttgggtggggacacagagccaaaccatatcacatagctattctaaaaactagtaatacatttacaaataagacaacatttctcaaaatccactagtcttccatcagtattagggttggaatgtttggtttccaaatgcttctcttggtttccctcaaatttattcaaactctccttcttaaatatttatcaagttcctagtctgttccaggcaccactgtggtctcccactgatttaagtgatgtaagtgattctgtctttagtgtttttcttcctccactggacattgttttcttagacagctgaataggaaatctgggatcagtccagatcttaatctagagcttcagactagatatctcttcctgaacttttctcaggcacctcagcttcagcatagcaaaaatggaacttacccatcttccccgaatcctgtttttcactccttttttctctgtttgtggcagcaccgttcaaccattctcctcaattcaaccagtgatctttattaacaatgatttagattgtggcattcccctgcttaaaaccttttgtagccagtcgtggtggttcatgactgttatcccagcacttcgggaggccgaggtaggtggatcacttgagctcaggagttcaagaccagcccgggcaaaatggccaaatcctgtctctacaaaaaattagcagggcatggtgacacgcacctgtggtcccagctactctggaggctaaggtgggaggatcgctcaagcctgggaggtcgaagttgcagtaaaccaagatcatgccactgcactccagcctgggtgacagagtgagagagtgagaccccatctcaaaacaaacaaacaaacaaaaaaacccttgggtagattcgcattgcatctagaataaattccaactccttatcacagccttcttctgcagtctagactctggctctctcaccaatgtcatctcctatctccttcttctgcctcactaaccttggccacactagccatcttttgcttatttcaacagatgatttttaaaattaaatggaaagtagaaaaataaccaaaaccctacatatgcatacaagcacacacacacacacacacacacacacacacattaaagttctcaggttgtaaaaacttgagttaaaaatgaaacaattactatataaacttgatccaaatttatacatattagaaaagaaaatttaatggtgatcttcaaagtcatgcaacttgtctagtgagtttactattaagacctccattgtgaagaactaatttctcaaaatattttacttaatgtcaggttgtagatattcaaatatgcactagagatggaaaaaaatttatgccacagatactctgggatatgatgtgtaccagatgttttatgatgttctatgatgtgagaataggaaatagaaagaaaagcctttcttaattccactctgcattttcaggtactctgtagatcgacacacagatatggacagaatattcaacattgattctggaaatggttcgatttttacatcgaaacttcttgaccgagaaacactgctatggcacaacattacagtgatagcaacagagatcagtaagtcctacctaataccgctgctgtcccctattaatagactgagtgtcccagcaagggctggtggagcgtagcttgtcaccatgtattgacaatcccacttgatatatattgagggaaaaagccctggagtggtttgcagtaatgtttcttctagatatacattggctcacacataaatggagaggcaaccatggaagttctgtggtttggaaacaataaaatgggaatgtatctcacaaatgagattgaattggtactcggtggatttaattccaaaaaagcttataaattagaacattacataaacagctgaaaaaaacagactctcagtcagacactgtgtgtgggggcaaaagatgagaggggtcaagtatattgtaaaatgtgggcattgtttagaaaattttagatatcaattctctagcttactatagaatttttatttcaaagtctttacagaattaagagagataaattatcacttttctatggtataccaaagtgagtaatacaaaccatcaagtaatcagtaaaatgattagaatgaattttatggtagcccccatgaaattgaaggcaaagaacaatagtgccaaaagaatgcttcaaataaaatgattacacacaatgaaaactaatgtagatggtcaaaacaatgtgcaggctgaagaacataagtgaaaaatgatctttttttaatttttttattatacttaagttctagggtacatgtgcacaatgtgcaggtttgttacatatgtatacctgtgccatgttggtgtgctgcacccattaactcgtcatttacattaggtatatctcctaatgctatccctcccccctccccccaccccacaacaggccccggttaaaatagaatttcaatgtttaaaactaggcttctaaattacagctcactttttagtgtttgtgtttaattttaaaagttctaaacatttttagctcactttgggtatctagtgtgaaatagtccatatcgaatagtttattacatttgtattctctgtcaatataactcatgagatttgaagtgactaaaggatatttggtagaatagtaaccagtatgggcaaaatgaagcattgcttttagatagtgataaggacagcacattagaaattagttaggtaggaatttgctcttcagaatttttcaagatttatcttgaagttcatgttaatttatgttatgggactgatgtagataccaaagacagagcatctttaaagttttaaaattataaatttatttcccactgaaaatgaccatttttcctaagacaatgaaattttattttttaccaaagcagtcatttcataagtattttaatctttgtgccttaaaaaaagtttttaagagttaatgtttctatgacacatttgaaagtattggtgactatctcttgaaagttaatattcagctgctctaactttcaaagaataatatgagtaaaattttagacattttaaagaatcttactgtctaatcttcttaacaacctttgatataacagaaaccaaaagcttgtgtaaaaccagctcccactcacctcggggcctttgcatatactgattcctcgacctgaagagccagaaatattcacatggcttaaaccttctcttcattcatgtctctgggcaaatgatatctcatcagagaagcagtccttggtcatcattctaagtaacacctctatttctctcaatcctttttccctacttaatttctctatagcacttaccatctgacacattatatatttatgagtttatggtttgtccatccccattataataaagctccaggaaacaggatctttgttatgtttcctacgtgccccaacatcgcaaatagaggctgctatatattaggtattagatgctcactaaataattacaaagtgaaaaaacaaatagacatacaagtgaagtaaatgaagagaggtgaggtgatagattctaactcctgatccttacactagaaatctgtcttccatactgtgctagaagattatcacagaaggcaaccaaaatacttcatttatctcaggtctgcaaacattgattccgctttatcattaattccaaatgaacagcctgggctttcagcctgggcttggagtcagacagatccaagtttgaacctggacttcactctttaccgtctctgtaaacacagataaattacttaacttctccatgtctcagtttcctcatctataaaatgggggcagtacctctgtctacctcagaagtttgtgaaaattaaataacgtaatacagcaaagtgtttagcatgacatcttgctctcgttcagcattcaaactaaaccactaagactaataactatcctttggtcttctggtggttcattcattttccctctccttccttttgtccatatgctccccatctgcctgcttccttgaaaatctacctctaaaatgcctttcttggttttgtgttatcttaaggtttattatacagttgaactatatcaacacaagtggctttgtcacccatgtatctctaacaggtgcatccaactccagatgtaccaaacaatctaattgtactttttgtgaccacactggtacttaatgcccagtagtacagcagcttggggaatctgtgcatgaatgagaatgaaggagttgagcggatgttgtctaaagggaatcggcaatcaacatgtaaatgcctttttctttctttttggtttgtgacagataatccaaagcaaagtagtcgagtacctctatatattaaagttctagatgtcaatgacaacgccccagaatttgctgagttctatgaaacttttgtctgtgaaaaagcaaaggcagatcaggtgagtttcattaaaaagtatattcaagttgaacatcagattaatttagatcttcttatcattcagatgattcacagagctgaaggagagttgtgaattatctatgaagtgaatgctacggaaattaatactataaataagaaccaggacttacatatgagaactaacagtttcgaagaactggaagttcatcaaagactgaggctgattccaaatcgatcttaagtttttattaaatagattagtctcacctttattggaaaaatctttattggtgaacagatagtttaattaccatatgtacttgaagtaataactacaacatactttataattgcctataattcatgatttcacttatttacattgaccatctgtgtaagtaatacaaattcatgaatgttttattgttttacacatttgtccccacatgaaatagttctttgctgccagtgatataaaaattatgtttcagtttgtgaaaatagaagtacactgttaaagtacatgtgcaagtagaaagctgaagttactgtgttctatatacttctttttcattttttgcaagttgataggttatgtaatgctaagagtgcatttctagacagactgtccaaagagcacttctactttgtgaagttgcaatgttgtcaccgactattgggatattttatagctttgcatcactcaaggctaaatgtttctcaatcagggtgatttcctccctggggatatttacagtatcttgagagagtttgattgtcacactagaaggtgctactgatatctcgtgggtagaggccagggtggctgctaaacatcctacaatgcacaggacatcctacagtgtccccacaacaaagaatcattccctgccctttggctttctaacccataatagagcagattcactgtatattacttaaaggctatcatttttataattaaatttttaaatcattttgtcaagcaatttattgcaaaacggtaagaaacacttttgagttatcaaaattttatggcagcgttttggtttttctcttagttgattcagaccctgcatgctgttgacaaggatgacccttatagtggacaccaattttcgttttccttggcccctgaagcagccagtggctcaaactttaccattcaagacaacaaaggtaaatgagttcaagttaccttctctatctatctccatctatatccgtaactgtttctgtatgtatatgtgtatatgtatatgtacatatctgtatctatatctatcttttcttatcacagttgatttaatacatgacgcagtatccacatacattcaccactttgctttccggttccagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccatgcggaggcgctcatccaccccacgggactgagcacgggggctctggttgccatccttctgtgcatcgtgatcctactaggtaaactggttctccctgcctcctatctccccatggtgaggggctcacactgttactgtgacactctagatttatctgcctcccccattaaggcatacagcctgatctaggtgagtcgagttacatactgagaatctgtgctgtacgatgtgaactcatttttgcttgcaaatggctttggaaaatgaacagatgtgaaacttgctcgtgtctttgcttgcccaggaagcaaagaatctcttgtctatcagactgggaatgaatctcgggggatttcagggcaacataaatgtgcccttttcatttcattcgttgtgtaatttttttacttggaaaacgttgttaagtgtctggcatggagtgtatgatgaggtccctttctataaaggtaaagtttaaagatctatgggaaagtgggaagaggagtatgatgacttttctctcatcctagaaaaataaaaactatgaaatttttttaacccagcaaactaatgttgatttaccatttaaatgattaccttcttagcattactctctgattgccacatgcataaggtctatttctcacactcaacaataaataacttctgtgattgaggaaatcagtatgggggcccaaaagaaatgaatgtaataaaaatggaaatcagggtctaacaatgattcaaatgaaatttttacccctaaccaactaattaagcctacaagtcgagctcagatttctcaacaggtccttgactgtgaactaagaaatcaaatatttgttaatgcagcccttccaaaaatgaaagcaagatttgtaaagcttgcctatatagtgaaaagaaaaggtaagaagttaagagtcaacctgaattatacagggggaaatactcttttttaaaaaatgaagacagagtgactttgagaagagtgaaagagaacccgcatttcaccaagaacagaatgcccagggatccctgctctagcgctccttcacgctccacatcaaccctgctaactataacagaagccttgaaactcaactacagaactgcgatcctctttgtcaactaagacttggggaaagtattttaagatatgcacataaataaaaactgacagtgtgcaaagacaaatcagtgtttctaatggtgtgagtctgtaaacattgttttggaagagaaagatatgaatgttctttttgatcaaaagggtgattttttagaagccttggattggtagggctgtacccaaggagtattccatggactctttttgtcatctgtggaaggagagataactctcatctgacagtggtgattcttcctttctgtcatcatctacctccgcctttcatttccttcctcccatgaattcactgtctcctcatgacttgtaattggcctcagtgcctcccacatcttgtttaatctctttggaattctgtacctaataaaaaaggagaaaaatgggatttagcctttgttaggtatacaccataggtcagatgctgtgcaagatgctttacaaaggtttttctcacctaatcctcagcaccatttggtgtataattatctgtaccttaaatatgaaaactgcagctccaagatgtgaagtaatgtagccaagtcacgtgtctaacacgtggtaaaactaaagttcccaacctaaattttcttccccaggcttggtgcctgaagactgcactctactttcttttcaaacttatgaaatgcagggcgatttccaggccaaaagacagcccaaacttaaaatgtgacgattgaagaaagtggaggaaaatgaagcaaagccacattgatataggaagaaatctggagtccagaaagtggatcatatggtaatggatattttacaaaaataaaacaacagtaaaaacaactagacaactactacatctcatgtcttatggtgccttagaacttgcaaaactttcacatttattaactcattcgtgacaataagactgggcactgtgctattaattttcttttacaaataagaaaataggcttagaacggtcaaatcatttaatttaacccagatctctttaccctctagttttacgatgaaatttgaacacaaatttgcccaattgtccctctatcccgccaaaaatcttactgctgtcctctggcttcaaaagggtaagggaaagggggagactcagttcctgctgagggcacctcatagggcatcactttctaagaatgtgtttgccccatgtgcttagcaatcacattttcactttataaaagttagctctgagagctctccttctagacagcgacactctcaagaaatcctgttcagatgtgcattgggctaatgagaaaagatataagcagttttagctgtagaagaattagaccttgaataaatgcctttgattttttgaaagtgccctctcccttctagacagttgcgctttcagacgtgcataagactaaaataaaagctatagataccttaagccagggaagaattaggaggtgataaatgcctgccccttgccttacgtgactgaatgagcccatgtacataagagcttaattcttggagagacagttggcttgattctgttctctaatcccaatggatgtccttacttccaaccctctgttttgcaaatccgtgtcattgttcacactggcaaccagtatgaaaggtagatcatgagcatccctctgcccaaagccctgcagtgctcttcatgtctttgctcaaattatgcaacctccctccgataacatatacaaaactgtgctggctgggcatggtggttcacgcctgtaatcccaacactttgcgaggccgaggcaggtggatcacttgaggtcaggagttcgagacgagcctaatccaacatggtgaaacctcgtctctactaaaaatacaaaaattaactgtgcatggtggtgggtgcctgtactcccagctactcaggaggctgaggcaggagaattgcttgaacctgggaagcagaggttgtagtgatctgagatcgtgccactgcactccagcctgggtgacagagtgagattctgtcttaaaaaaaaaaaaaaaactgtgctgtatgttcatatgggctcctcaaacatatacagaagtatttttctccaccttgttctgctctgctctttcatgttcatattgcacttatcaccttctaacaatttccttatttactacacacattgtttattttgtctccatccaactgtcccccaccccacccacccactcagtgcctagaactgtacctggtacagggtaggcactacataaatattatcaaatgcgtgaatgaataaataccctgaatggttgcatcaaacaaggcatcaggatactttctggcagcaaaagagggtgcatacaactacaaaaccacacacttgaaagtggcaaagttacatttcctttggaaatagtctatactccaaatctgcttcaaaacatggcaattatgaatgcaggctttttagtctgaccaacctgaatttgaattgcatgtacctgtaacatctttaaacttcaacttcctcttatgtaaaatggggttttaatgatggtatctacttgtagggctattatgataattaaatgagattcagtatgttaagcacttagtacagggcttaacacatggaaagctctcaacgggtaaccaattattattattaatactaatgaaattttaatatatagatacatgggtgtgcctacatctattattatataggtagttttgtgtactcactaaaaaggcattattctgtaattcttattgcagtaattcagttttcatgtctcataaaaattgggccttgttatggataaaatagtaaagagacattactgtgacttcctgtaatacactcctctgcacaaacccagtttaacaattcactttttggcctagatggctgttttctctctaagcttttactgtgtttttattttttcacccatatgtccattcatagatagatgtgtctctctacaagtagccagctgtgttccacccagccagctgtgaagaaagatcaggagctatttaaacgcaattcttgttttacctctaatttgagttaggagggaaaaaatcaaaagaatgaacattctcagtaacaaacttatagaacatgaacctttgaaaaataaaaaataaaaaatctcacttacatgtatttatttcatttagctcaaacagaaataatatggcatgtggattcttacctgcccccttcaaattagccaatctcaaaatccaaaatggctttctgaattatatctgggtctctccaggtattttctggaataatattgctttatatgtaggaaaggtatgcaaatattcagtgtctactttggattttaaactaattttacacttttctcaggtaaaaaaaaaaaaggcatagcgcaaaagttattttacatgtggagttgtgcaaacccttcaacacattcccaaaggtgccagtcttgtccttgtaaccagtttcagagcattttaggtgttcagcataatttgcaccctgattgcagtactttcactgaggccgagcttcttttctttattatttttttccttaccttgaaactagtttgccatttcaaagtaaaaaggaactactgccaaaatatgatggtgttttatcctctacttaaattataaccttctttcaaatatttactccattttatgggtcccggtttgatcatggatggaggcaagtgcatccttaaagaaataaaagttgagtctgcattttctagagaacttttaaaacttcacatttgagcacggtgtttcttcctgacattaattgggcagcaaattaacttttccttccctttctgttttgttttctgcttccagtgacagtggtgctgtttgcagctctgaggcggcagcgaaaaaaagagcctttgatcatttccaaagaggacatcagagataacattgtcagttacaacgacgaaggtggtggagaggaggacacccaggcttttgatatcggcaccctgaggaatcctgaagccatagaggacaacaaattacgaagggacattgtgcccgaagcccttttcctaccccgacggactccaacagctcgcgacaacaccgatgtcagagatttcattaaccaaaggttaaaggaaaatgacacggaccccactgccccgccatacgactccttggccacttacgcctatgaaggcactggctccgtggcggattccctgagctcgctggagtcagtgaccacggatgcagatcaagactatgattaccttagtgactggggacctcgattcaaaaagcttgcagatatgtatggaggagtggacagtgacaaagactcctaatctgttgcctttttcattttccaatacgacactgaaatatgtgaagtggctatttctttatatttatccactactccgtgaaggcttctctgttctacccgttccaaaagccaatggctgcagtccgtgtggatccaatgttagagacttttttctagtacacttttatgagcttccaaggggcaaatttttattttttagtgcatccagttaaccaagtcagcccaacaggcaggtgccggaggggaggacagggaacagtatttccacttgttctcagggcagcgtgcccgcttccgctgtcctggtgttttactacactccatgtcaggtcagccaactgccctaactgtacatttcacaggctaatgggataaaggactgtgctttaaagataaaaatatcatcatagtaaaagaaatgagggcatatcggctcacaaagagataaactacataggggtgtttatttgtgtcacaaagaatttaaaataacacttgcccatgctatttgttcttcaagaactttctctgccatcaactactattcaaaacctcaaatccacccatatgttaaaattctcattactcttaaggaatagaagcaaattaaacggtaacatccaaaagcaaccacaaacctagtacgacttcattccttccactaactcatagtttgttatatcctagactagacatgcgaaagttgcctttgtaccatataaagggggagggaaatagctaataatgttaaccaaggaaatatattttaccatacatttaaagttttggccaccacatgtatcacgggtcacttgaaattctttcagctatcagtaggctaatgtcaaaattgtttaaaaattcttgaaagaattttcctgagacaaattttaacttcttgtctatagttgtcagtattattctactatactgtacatgaaagtagcagtgtgaagtacaataattcatattcttcatatccttcttacacgactaagttgaattagtaaagttagattaaataaaacttaaatctcactctaggagttcagtggagaggttagagccagccacacttgaacctaataccctgcccttgacatctggaaacctctacatatttatataacgtgatacatttggataaacaacattgagattatgatgaaaacctacatattccatgtttggaagacccttggaagaggaaaattggattcccttaaacaaaagtgtttaagattgtaattaaaatgatagttgattttcaaaagcattaattttttttcattgtttttaactttgctttcatgaccatcctgccatccttgactttgaactaatgataaagtaatgatctcaaactatgacagaaaagtaatgtaaaatccatccaatctattatttctctaattatgcaattagcctcatagttattatccagaggacccaactgaactgaactaatccttctggcagattcaaatcgtttatttcacacgctgttctaatggcacttatcattagaatcttaccttgtgcagtcatcagaaattccagcgtactataatgaaaacatccttgttttgaaaacctaaaagacaggctctgtatatatatatacttaagaatatgctgacttcacttattagtcttagggatttattttcaattaatattaattttctacaaataattttagtgtcatttccatttggggatattgtcatatcagcacatattttctgtttggaaacacactgttgtttagttaagttttaaataggtgtattacccaagaagtaaagatggaaacgttaaaagaagagaaatgtagtattttgggttacctgattagagtgaaaattttttacaatcatattattccttgtgtcttctgaatggtttccgattttataatggactgccctatatagtaacaagtatttcatgcttgagctatttcctgctttcagggtttcttttttctagttcttcatacacacacatacacacacacacacacacacacacacacacgaatgcaaacaaaaggctatatgaggtcttcactctaatgaattgatatgtatcatagtcacaggtaagtgttgaaaaaagcttagtaaagttagaagctacttactcatagcaatagaacagcaccttaatcacacgatttactgtaaaattaaagaggtctctatctgtatgtttcatgtcacgtaacaaattgaatcaaggaagatagtcctgtaaaaagaaaggtatcatctgaagttgaggattgacactagcaatttccaatgtttaaaggtaagatctgagttctcctaataagtaaaagtaagtagttctatagcagaatatctgagatgtaattggcaaggtattttatccctccctgcagatgacacagcataccaagaacaggttaatatgattacttatggaaataactttaatctcttatcataaaagctgatgatgaagtaaatttataggaaattggataatttgagactggggctaaatatttagtaccagggtactgtaagtatcaagttggagtgacgttttcctataattcagactctttgacatcgtggaaccaataagagtcatagttccatcattctccagcttcgtctcacttccttcccaccccacctgagtatcaggtcaaacatcattgcatgcgcaggttttttttttaattgctaggtcccaggcaacatgaaagattattggagaaaaaaataattttcagcccagttttttcattgtctgtttcctaattttagatgttggtgatgggaaagatggaaggagagtgggaagaagtaaaattttaatatttgtttcaatcactttgaaactaaaattcattaagcataaccagattgcttttgtgggttgtttcaaggacattgagagctttctgatgatatgtttttgccctctattcaaaagcaagagttcctttaaactactaagatattccctagaataagctgaatttaaaaaaacattaagccattgtttaaagccccttcacttcctggccacttacttctgaaaggcctaaaaaacatttgtgcccaaataagtaaataaaccaaatgggaaagaagcaaagattattccatagaaccacaagagagggaatgtgggcacagtaaatagatgtttctttcagaactttcctgcctttacagtttgtgtccataaagggatgttcagcaatgaaattactcccttttcagatggaacaaaacctgcccatttaattttaacgcagtataaaaaacgtgtggtttagtttttattttcagctcccaaagagttgtgcagaaaatcttaaatttttttttttttttttttttttttttttgagacagaatctcgctctgtcgcccaggctggaatgcagtggcgcgatctctgctcactacaagctccgcctcccgggttcacgccattctcctgcctcagcgcccccagtagctgggactacaggcacacaccaccacgcccggctaatttttgttgtattttttagtggagacagggtttcaccatgttagccaggatgatctccatctcctgacctcgtggtccgcccgcctcggcctcccaaagtgctgggattacaggcgtgagccaccgcgcccggccttaaaaattgaatctgtagcttaggccatccaaattttataaatccaaattaactttagaatgtttctattactttcacttttacatatataaattttaagtgtcctgattggctgaacaatatctcacatcaaatgctttg

SEQ ID NO: 13309 - DNA, 18026 bp, Human
ggttatatactaacagtctattatacaatctgctaaaaattcataaaaatatctatccctttacattttccacaaaagggcttgaccatttttcctgaattatttttagttttctgctctatagagataagaaaagttattcctttaatagaaacttctattcaaagcagaaaatatgagcagatcttatttatagcccctaggccccattcttaacaaaacatttatctcagtaagaaggaaagcacagaataaactttgtttaatcgtacctactcttctatgctgtctaaaagcatttccgtgacttttaccaaagggctggataaaaataaaacaaatcctttatttggcaggattgggcctggggaagggagaatatgaatgtcctaagaaggcatctgagatcacatcctgtatttgttgttattattgtttttttttttttttttttttttgagacggagtttcgctctgtcgcccagcctggagcgcaatggtgtgatctcagctcactgcagcctctgcctcctgggttccagcgattctcctgcctcagcctcccgagtagctgggattacaggcgcccaccaccacgaccagctactttttgtgtttttggtagagatggggggttccactatgttggccaggctggtcttgaactcctgacctcaggtgatctgcctgcctcggcctcccaaagtgctaggattacaggcatgagccactgcacctggcctgttagcattgtttttaaactcattgttgttatttgctgctaacaaaaatgtaagttacatcttctccttattacaacacagatgatctttatcaccaatcctggactcttccccttccctggcatcttcctccaaagcagggggtggggagggaggaaaaagaaggaggagaaggagtaggaggagaaggagaagtagggggaggatggggagggaagggtgaaagagagaaagaaggaaagaagcggagtatcctgaggcctggggcccctgagctgagattcctcctctggcctaggtgcctcggggtattgttgctgtaggcactaactatacagcagtgaacaaaccagacacaaaatcctgcttttctggagcacatgttttcagtccttaatagcaataagtaagtcagagtgtagatttgggtaaattttgttatcaatattgtcctgtgttacattttcttagtagtaagtatttaatattttcccccccgtctaaaaataaacacaatgtaagtgactcaacagaaccaaaaaaattgttgtcaatttttaaatttaataaatgagatatttgttgggatgtgatttttttacacgagagttagttatgagtttctattaacaaaagctggaattgttctatatttgaattcgggtgtcttttggaaattcaatattaaatcttagtactaatagtacatgctgttcaatccctgtaatactttctgattgtcttaaatggactgcaacttttctttctttaaaagtggtcagatatattgcgttcttaagattataaagtaggccaagtgcagtggctcacgcctgtaatcccagcactttgagaggctgaggtggatggatcacaagatcaggagtttgagaccagcctggccaatattgtgaaaccccatctctactaaaaatacaaaaattagctggacgtggtggcgcgcacctgtagtcctagctgtttcagaggctgaagaaggacaatcgcttgaacctgggaggtggaagttgtagtgagctgagcttgcgccactgcattccagcctgggtgacagagcaaactccgcctcaaaaaaaaaaaaaaaaaaaaaagaagaagaagaagaagaagaagaagaagaagaagaagaaaaaagatgataaagtaaaaggccagtaactggcagccacatgttatgcaaacattctcccctctgtaaatactacatgaatgttatttttgctttcagaaatcactaaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcaggtattctcttatttctgttaatcataatgtacacgaggggcatgggagctggtggaagacgagagagctgaattgtctgtgttgtacatggaaaaatcatttttattttgcttgttttgaacagggtgctcgaatcattgtgactccagaagatgcactttatggatggaaatttaccagggaaactgttttcccttatctggaggatatcccagaccctcaggtgaactggattccgtgtcaagacccccacaggtattttaactatcttagtcttttgtgcaaaagtaactctctaaaatgcgcacgttcaccaaagcaaaatgattgctcttgaattaccatatatgtggtatatgttatggttatatttatctcaacatttgtcagattttaaaaaattgtacttagatactatttaacaatcttttgtgattgaaaatctttattaaattttgagaaaatgtgtaaatagggtattcctgcaagaaaaactaagggaagagatctcatagatacaagtagtaacttaatttctgaagtagacagtggattgtgttaggaatacattccaaagcctctgctgaagggacaccctttcaatgttatagagtctctccattccagagttgcttcttaggcagaaagacttcaccatgtattttcaagtgaatcataagaccttatgctttgaaactgcattttcctaggctcacaaatctaattttcctgggaaaaggttatctagaaaccttctaatatatattaaaaatctgggtcctactgtcatcctggaggtgtcaacgtggcagttgcatggacaagtctggcatgaaaagacaaaattatatctggagatagaaaatcaaatgtcagcatatagatggtgttaaacaccatgatgagttcacctgtggagtgagttagagaagagtttaggtataaggcttgagcactaggaaattctagtgtttagactcggaagaaaacgaggaatcagcagaagagtcgaagaagagcaaccaataaataggaaaatgagagggtgggtccaatagagaagtgaggtgtttccagaaggaggtgtaattaactgtgccaactgctgttgaaaagttaagatgagatcaggtaaaatgtgggggtcactgctggcattagtaagagtttgggtgatagagatacaagttggagtgctctgaaagggaatgggagaggaggaactggcaacagcaagagggactgatcttttgaggagttttgctttaagagagagatgaggattaaagcaatatttggaagggcatgtttggaaaggtcaaaagaggttttaattttattttttaaagatgggaggtactagaggatatttcattgctgatgggatgtttcagtagagaggagacccttgatgaggcaggagaccgaataatgaatttctggagcaatagataccgtgtgggaagcattcatcaagtgtataatcatctgtggcttttaaagtatgatatttttaggcatagtttttgtattaacttaagttccacttaagtggttacagttgctatcgtttccatataaagtgactaaaatatttttttaaaattgaaatttcttaattataatttggtttagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataaggtaagagagagtgacggacgtgtaaaatggagcgtgttgtgagtggtcaatgctgggtttaggagtttgaatttcattccctatatgatacaatattactagagggtttttttgttttgttttgttttttgttttttgaaagtgggcaataaagaaaatgacacttttggctgggcgtggaggcttatgcctgtaagcccagcactttgggaggctgaggcaggtggatcacttgaggccaggaatttgagaccagtctggccaacattgtgaaaccccgtctctactaaaaaatacaaaaattagcggggcgtgatggcacatgcctgtagtcccagctatgtgggagctgaagcaggagacttgcttgaacccaggaggtggaggctgcagtgagccgagattgtgtcactgcactccagcctgggtgacagagggagactctcaaaaaaaaaaaaagaaaaaaaagaaaaagaaaaaagaaaatgacacgttgtaaaaaactactcagaaaaacatgtaggcagagaactgttaaaaaaaaaaaaaagtagcatgatggtccaggattgagataaactttttgcacatataaaacaaataattttaacataaaaaaagatactaaggtgactataatctgggcactgtttcaataattttatatttttttagagacagggtctcactgttgcccaggctggagtgcagtggagccatcatggctcactgttaacctcaaactcctgggctctagtgatcctcctgcctcagcctcccaagtagctgagactgtaggcatgtgccaccatgctaatttttaaatatttttttggaaacagagtctcactacattgcccaggctgtctttgaactcttcacctcaagcagtcctcccaccttggcctcccaaaatgctgagattagaggcatgagccactgagcacagccataatctaaatactatttaatattgaaatggtagaaagatgtttcaaaattgtatgaatcagctttgcataagttaatttgctatcaaaccacaaaataccttattttctacaccagctaatttaattaccatcttatagatttaagatcaaaccataaaatgtttactttaaattctgaattgaaaaaaggaatcaaataacctttaagtcataattttatactaaactaggtagagaaagaagcctggccttttaaatggatatgtgtgatgtacaggcagtatgaatgtcccttctccacacccagatattttgtaagcatcttaaactgtagcctcagaatctttggagtggagaaattatctcctggcagtctcagttaaaatataaatattaattaagaggagggatgttaaaccaatggttttcaaatgatttcgatcatggacccctattggaaaaaatcgttaacataagtcctcaatatatgtatttttgtgtgtgtatttataaagtgcaacaatttcaaaatgctttcttcataattttgtggattttgacagcttcttttcatatatatcactgcatttcactttcttcttaaaatgtgtctcatagtaaaaatagaaaggtcagtgcttccattttcttgcttgggagattgtttgcattatttgtattatctttcaatgcagtttatttgcagtaatcatttgaagctattctgccattctgtaaatgtgcaggatggcacagtgcactgaatgtggacaaactagcaaggaacctgcagtcaccctgtctaagttgaaaggctctcactcttccctgagggtacctcagggaccgtttgtaacccatgacctctgacatatgtgaacctaatgagaatacctttgtcgatcaattcctttttttttttttttttttttttttttaggcagagtctggctctgtcatcccggctggagtgcaatggcacgatctcagctcactgcaacctctgactcccaggttcaacccattctcctgcctcagcctcctgagtagctgggattacaggtgcataccaccacacccggctaatttttggattttttagtagagatggggtttctccatgttggccaggctggtcttgagctcctggcctcaagttatctgcctgccttggcctcccaaagtgcttggattacaggcatgagccaccttgcctggcctgtcaattcttaaaatagtagtaaagcccaatttcttttctattttttagatattttttctacactgcagaccattttattaactgttgattccatttattatattagactaagtttttttttagtttacctagaaggaatcgggaaattaaatacatttctatggtaattttgaaaggtgggcaagagtcactgagattactttggatgggacactaaagagagagatgacatctctcacctgacttacaggtatttattatgcatctattaatattacgtttctaggcaccaaggattcaaagaagaataatgcatgttttttaacttttaagaagcttatagggccaggtgctgtggttcattcctgtaatcccagcactttgggaggcccaggtgggtggatcatgaggtcaggagattgagatcatcctggctgacacggtgaaaccccgactctactaaaaatacgaaaaaattagccgggcatagtggcacgtgcctgtaatcccagctactcgcttgaactcaggaggtggagattgcagtgagccgaaatcatgccactgcactccagcctgggtgatagagcgaggctccgtctcagaaaaataaaattaaattaaatttaaaaaaagcttacggactttggggtttatgggggggtatttggctcttaactgagagagagggaaagagagagaagggagagagaggagatgagagatgctatggacgtatgttacatattcctccacattttccttagaaatttacttccaattgccagatttatccgcttcctaggagattccctgcagttgaccatagccaaatctgttaccaacttagagggtttttatgagtcatttcttcaacaaataaggttttactggttttctcctatccatttgttgtagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggtaattcatgaccaggttaggtttcatcttatatttttaagtgcagagaaatgaatgcctcagttatgacttgtattaattttttgcttattggaaattcttactgtgtttgtcatagtttcacaatagaaaaaaaaagctagcacttgattataagctatggttatactaagacctttatgtgtattattcatttaattattacaataattatatgagatagatagtgtcatcccaattttgcagatgagaaaattgacatacagagagtgcaagtaatttgccaaatgctacccagctactactttcctcagtggccatggaagcctctatatcttgccctttgtctccacctatggctgcatggcatatcctcgtgacatggctgctgtcttcctctagagcaattaatgagaggggacaagagagaaaaggaaagaagccacattgctatttatgactagttacccaccatcacttctgccatgttctattcattggaagtgagtcactaagtccagcccctcttcaaggggaaaggaattagatcctcccaccagaaagaagaattttaaggaatttttggatatatttgaaaaccaccacaatgaggaataggggagaatttttattccctttccccacctttcaggaactcctgactacaaagatttttgtagttggtttaattttccataatgctaataaataatgctattatatttaaggtttaattgaaatgagaccaaggaatgtttattttaatctcttccattagagaatagaagtagttaggtgttcagtgcaattagaagcatgtatcctctctcatcgtgactaatatggtggcgtgatcacatgcccaattctgatggggaaattggcagttttggtttttttgtgtgtggtgttgtttttagaagacttgtctttcattcacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtaatttcagttcaaatgaaagggcattcaagtgaaaggtaaattccaggttaactttttatatttgttccagaaaaccaggtgcttttccttggcttgactccatgcattgatggcaacacacacacacacaacacacacacacacacgtgcatttatgcacgtacatacactgggataaaatatttacaatgggaattaagtataatcttattgcttgctttaagcatatttaaaaaattattaacctaaccatgatgagtttcgatttgactaataaaccagcctactgtggagaacatcaagaagacttccttaagtgggtttgccaacatatctaaattataaacagtcttattttcacttgcaaaactaacagtaaatagagatactacttttattttagtttctcttctaatcagatgtcccgggttttgtatagctttctttttcttttcttttctttttcttttttttttttttgagacaatttcactctgtcaccctggctagagtgcagtagcatgatctcggctcactacaacctctgcctcccaggttcaagcgattctcatgcctcagcctcctgagtagctgggactacaggcatgtgccaccacacctggaaaaatatatatatatatatacacatatacaaaatatttttagtagagacagggtttcaccatgttggccaggctggtctccaactcctcacctctgctgatccgactgcctcggcctcccaaattgctgggataacatgtgtgaaccaccacacctggccttgtattgctttcaaatgacaaattttaaagatgaaactttttatagaatgttggctctgaatttgtattttcctattatactccatgtcccactgccttcttctaaagaaaaggattgggaagagaggtgagattaaagggtggaaaaaattttaatatcctttcagcttcagtactcttcagtactattgttgcccaaagatctccacttcattgagctcgatgccatcatctgacataccaaactaatggtttaactctaattctaaactgacttctttctcttaatccgcttgttatttaggaagtgggttgattctcaagtcactggccatttttaataaagcagttaattataagacacatgatccaaatcccttttcagagaaagataatgtttgcttcgctgtagttaaaaactaaggcaacatttctggtatgagtaacttcaatgtaaggcattgcgttttatctgcgtttgttccacataggtctgcacaatgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtaagaggacttttataagagtattttcattttatatgttctctgaagtcaagtaaaacaagctatagccactctgccagttaacttctgctgtgtaacaaatttcctcaaaaccatttctttagccctggttctgtgggttggcaatttgaacttggggtaggtaggctgtttttctggtctgagataggctcagttgacgttggctgggctcattgtgtctgccattggctagtgggttgattaggactgaccagtttgtgattgccttgtcctggacagctgggattattaaggccatctctccccgtggtctctcatctttcagcaaacctgagcttgttcacatgttagctgaatgagtccaggagcatcaagagaaaaacaaatctttgcaagttctttgcaaatctctgcttgcaccgtgtttgcaaatgttgcatcaacacaggaagttacatgagcagtggtgattcaaatggtagagaaatgaagaactcagacctctcaatgggaagagctataaaatcacacggcaaaaggacatgggtcaaggaggggaaaatattgtgatcattttttcaatttataacaactaattataaaatgatgatacttcattggaagaacataataaagaacatacctagaactgtgagtctgagataccattcattgaagaatgtttgtttatagatttttaatttccttttgtcactagtgaagacaaacagaaaatcagatgtttatttcacatttttttttaaacagagtcttgctctgtcacccaggttagagtgcagtggcatgatcatagctcactgaagcctcaaactcctgggctcaagcaatcctcctgcctcagcctcctgagtagctaggatttaaaggcatgtgccactgcacccagcatttgttcataaattacagtggctgtagctaattaattcacaaattaagctggcttcaaattagaattatgactctgcaggcttatatctgctaatatacaacacttgcacacatgcacatacacgcatacatacacatattccagtggtttgaatattaatgtcttctctgaattgtggcaaacagtggcagggtttcagtaactagggtgaaatcattgcatattctataaaatagggtccaagttaattcaatcaaggcatcaagtaaggaagtctttaaaattgcagattgcttatggtcatgtatctgtatctgctgtgttatcagagtggaatatatcatacttataaaaatgcttaattctatgaaaccaacaatttaacatacagtgtaaccttaaggccataaaatccaaagatcaggaatgctttgctgccatagaacctgtttaggtagaatctcatgagcaaattgaggctggaataaaagctgaagtgccaactacagaaaatcatgattaaatctacagcaaggagtctggggctaaaatccagtagctaaaaggtggctggactgacataaatatctatctgagatcacttcaaggaagtgagagagagaaatcagggtcaccaaggtaaacttaggaggacatagggtctagccatattgatgcattatattctgtaagcctgaagatttaaactgagcacacaatctaattttctcgtactactttgccactttttccatgtcttgtactcatagaaatctatctctttgaggaattgtcccatagtaggactgaacatttacctgatgaaactacttcatccatgggagaaggacaaaaaaatgctagagttttccaaactaggttaaaggtccaaagccagaaataccatttcactcttactctgaaccacataagtgtttgaaggtggatggtgatagtgcatgaagagttggagaacgtaaataatttattccattactacttcctttctttgttttaaaaatttcatcccaaatgtcttcaggcagttaagaagagttagagaatgatacaagagaatacatgtttaaatgcttaactccatagtatttgtacatctcaactcttaaacatttttttaaattatttttaattattattattatttgagatggcgtctcgctgtgttgcccagactggagtgcagtggtgcaatctcagctcactgcaaactctgcctcttgggttcaagcgattctcctgcctcagcctcataagtagctgggactacaggtgcatgccaccacgcccagctactttttgtatttttggtggagatggggtttcaccatattggccaggctggtctcgaactcctaacatctagtgatctgccacctcgacctcccaaagttctggaattacaggcatgagccaccatgcctggccttgtttttaatttttgtgggtacatagtaggtgtatatatttatgggttacaggagatattttgatacagacatgcaatgtgtaataatcacattagggtaaatatggtatcagtaggtctcaacttttaatgattctgtgaacttgtcatgctgtatcccatctctggttccttcttagatggaaggaaggagggaagggggcatagcacctaccgtttaaattgggcacctgtaatcattatttggatcttgtcttacctgctccagaccatttgcagaagaaggaaatgagatatagattgtattacaccaaaaaagatatgaaagagccatgtgacagctggcagggagggtctttggaattgtagtcccttggagggagcatcatgatgagggtgaggcaggtctttattttgtaagtgtagattctctgtggcatgactttcactgaagttcatcaggttctaaggaacagatactaatcaaatttgcaagatagataagcgagaacaccaacttgttattttaaaaaataggttcccttagctgggaacaatgaactgtatgtcaaggagactcttcattggcaaatcctctcaaaagtacaaatgatagatcagtttgttttgtgagtgcagaattaaaacaaaaggagttgggcattcttggaaaagatttccaagaacccacagaagcctgaggcaatgtgattcttctctttagggctggtgatctgaagaccatgtaggatcaaggtgcccactttcctcaaaaagagccaaaaaaaagtccaataacccattcttggtttttttagtgcttcttttctctagagaccttgcagggcatggcccttctgtgaatatgttgtttctagaaacagcagtcataatattgaagatgacaaatgttttacatcagtcatgctcattatggcttcttgagtagcttctcagttctgttgatggatgcacactctctccatagatatttacacgttatcttagaggatcactattgcagagatttcaacacacttgttgtgtatcctcaacccccaccaccactttagttttatgttaaaagggtggtgttactcaccatgcccacaaatgtggaaacatcttgctttagcaccttaggcaactctggtgtattgtcagaagcactggcagagtctgttctctgtaactaactagttagataaccttgggaaagtcacttaacctctgaatttcctactcatagaagagaatattttcctcactgatttggtgaggatcaaatatgataatgcatgtgaagacactttgtgaatggtgaagtacaatcattatcttctaggatatttagtcattttctcctcccagttgtaaagcatctgttttcctaattttcaatttcttctccactccaactaatttcccaattttcaatttcttctccattccaactccatttccacaactaatgggttcattttcttttattcttgttctgtttattgactgtctatgcatgtttccttctgttcttgttcaattgctttgtacatattcctctcttatgaaaactccactgtggcttcaggctagatctagtcattaatgcctttcacagtctgatctccaccttcctctgatcatattccttcttctcttcttcactaatcttcagcgctagccagtggtgtgatgtaactttaaacaattccttctctgaggtagaaaacaaaaagccctgacttatggaatttgccagttttcattgtgtcaatattcccgccatgatcccaccagcttcaagaatggatctgttggcagagtttgatagctcacgcctgtaatcccagcactttgggaggctgagttgggaggaccatttgaggccaggagttcgagaacagcctgggcaacatggtgaagccctgtctctactaaaaatacaaaaattagctgggcttggtggcacgcccctgtaatcccagctactggggagcttgaggcaggagaatcacttgaacccagcaggcggaggttgcagtgagccaagatcatgccactgcactccagcctgggtgacagagcgagactccatctcaaaaaagggggaaaaaaagaatggctgtgtttaacagccagctgtccaatttcctggaaatttaacaatctgttctcatgagcctgtgcaccactagctccagcacaccactggttttaaccaatctagaatgagaactcacattgccttgatctgtcacacacacttctgtctcagaatgagcctttgctggttcaatgtccacttcccacaatgtcttccaccatacagcccttgaaagaaattcctaacagcttgagtttttggcagcttgtgtcccactccgtgaaacagaccagttcagttttttttttctcagacctcctagcacttacctgttctcttctctgatacactgataaactgatttctctctttatgtttagaatccgctccatttcaccattagctctttagcttcttgagggaaggatgtgatgtataactctctggttcctgattgtcttgcacataatcgaactcaatgaattgctgctgctgattttgactttccattaatggttacatttgattgttgaaactaaaatcttgggccctcttgaattgctctagtcttcattatgtagtaaatggctgtcccctgcctggcctacttgctgcatcctcctaaatcagaaatgatttgactatacattatatctaggatggtttcaaaatgattaatttgcttttaacttctatgttaagaaagctgactgtacttttcccaccttttctttaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttgcttgagactttgtgtgtatgggggacttgtatgtatgggagtgaggagtttcagggccattgcaaacatagctgtgcccttgaagagaatagtaatgatgggaatttagaggtttatgactgaattccctttgacattaaagactatttgaattcacctagttttctgtgctaatgtttatcaggagatttactttccaatcaaaggcaatgtcgacatttatttctacagtgaacgtagttttgagtgctagaagaattgatggctattccaagttcatatcaaaggagacctgacccagggcactcatagccccagctgtcccaccttaaggctatggcgtaatttaacaggcagaaatctcataacacaaagaccatgacagttaaaagttacactattttcagcatttggttgactttttacaaaatacacatattccatgctacttgaagtaaactagtatatttgttattgatcatttaattcagatactcttaaaattaaagaactgattttgaattttcagatttattttctgatttttatctcccaaagtatttttaaattcaatacttttacataaaaaaacacaattgaagcatttatcttttgtttttacatattgtcataaacctacttatggatttgattttaaaattctactaaaatacactagaaaagtaagattccttttataatctcgtggttagtattaagagaagaaatatggaagttaagccacactttgtatttaattttgagaagagcatacatattccctatgttcagcattgggacatcaaagatggcaattttaaagctgtaatgaacgtgcatttgtgtatatagtccaaatcatataatcatcaaagttttatgctcttttttctttttctttttctttttttttttttgagacagagtctcactctgtcacccaagctggagtgcaatggtgggagttcagctcattgcaacctccgcctcctgggttcaagtgcttctcctgcctcaacctcccaagtagctggaattacaggcacccaccaccatgcccggctaatttttgtatttttagtagagatggagtttcgccatgttggccaggctggtctcgaactcctgaccaggtgatccacccactttggcctcccgatgtgctgggattacaggcatgagccaccatgcctggcttctttttccttttcataaagtatgggacatttaaaatttgccaagttttgcttgaggaagttagatgttgtgcagtggttttgcagcatgtattttggctcttgggcaatgacgtttcatttgcagaagtttagatgttgattgaaaatcaacagctgacgttaaacaaactggtttgagtaagatacaagcaaggagctcctttcacagaaagggacagttctgattcaagcttggagctctcagctgtacctcagtttgttaaaaataaaaacaaaaaacgaaagcaccaagtgccaaggaaattaaagagcacttaatgctctactgtaaaattgcctgcaccacattttaacccatctccaccgtggtttctcacatacattttattttatcaaacaacccaagcatagtttcatttggcctttatatttctttgataactatctttcatcccattttattttatttttacttatttatttatttattttttgagatagagtctcgctctgttgcccaggccggagtgcagtggtgcgatctcggctcacttcaagctccgcctcccaggttcacgccattctcctgcctcagcctcctgagtagctgggactacaggcgcccgccaccacgcctggctaatttttgtatttttagtagagacggggtttcaccatgttagccaggatggtctcgaactcctgacctcatgatccgcccacctcggcctcccaaagtgctggaattacaggcgtgagccaccgcgcccggcctcatcccattctaaaatttcatgttagttcttgagtcccttgtggttctggagatagtaaacaaagctcttattttctcctatttggctttcattaggcttttttcctgaaatgctcttttacaacttcctggttacagccccctgtattacaaagtcacatgctcagcagcagccttctctca

SEQ ID NO: 13310 - DNA, 31385 bp, Human
taaacacattgtaatatactactcagcattaaaaagtaatgagctatggttgcacgtaacaacatggataaatcctgaaaacatagtaagtgaaagaatttggacacgaatctatactgtatgattccattcatgtgcacctgtctaatctgtagtgatgaaggcagataagtggttgcctgaggctgatggtattgtgggggttgggggagagtaataggcaagagacattttggagcattagaaatgcctcttgattgtggtggtagttatgcaggtgtgtttgttgttaaaacttaccaaactataccctcaggactacgagaatctaatgaagtaaaattttcgttataaaagttataactagtttttttcatattctcatccccactttcattagtggatgtagatggactttaaggccactacttatttggaaaattgctatttttaatagcatatacttacattttataataaaaagtacaagaaataaaaaaacctctccgttatatcacatttttagcatgcgaaatgggaagttgaaatctcttctctagtcttccaatcttgtagccttaatgactgtcaattttgatgtatacttctgcaacttgcagtctggtggaagcatatatattgattaaataaaaacacaaacatagtatctttaaatcataacaagtgttattgaaaacaagtgtattagtctgttttcatgctgctgctgctgataaagttatacctgagactgggcaatttacaaaagaaagaggtttaatggacttacagttccacatggctggggaggcctcacagtcacggcagaaggcaaggaggagcaagtcacatctcatgtggatggtggcaggcaaagagagcttgtgcagggaaactccttataaaaccatcaggtctcataagacttattcactatcaggagaaaagcatgggaaagacctgcccccatgattcaattacctcccactgagtccctctcacaacgcatgagaattcaagatgagatttgggtgtgaacacaaccaaaccatatcaacaagtatagaatgtttacacagtaaaaatcaaaaccttttctgacccttcatcctagttcagagccatactttgaaaagtttgcttttctgaaagcattaagtactgcctagatagtatgattgttcatgtggataaaacatcttgcacataaacagacatcctcttattaaagtattttctcattggtagttagcattttggtattattttgaaacatcaagaaatcttaagtatttaacttcagtgacagaaaaattgaaatatcattcagtcagcaagtatttataagcatctccctgagccttagtctgtaatctttattcacttatgtgctaaatgacattttgttacaacaacaacttgaaaatgacagtttgttcaagtagtattttttgtgatagtgaaggggttattaatgttggtatgtgtcaaacacaagtttttcttaaaatatattacacacaatactccataatcgtgtttaatttaatggagagtatttatcatgggagttttgtgctcatataactttaggaaatgcagggttgaaaaagttaaacattttaaattctagatttctcagaagttttaatacgttaccttctgaatctttaagacagagctgtagtatacagtgactctgaccatggaactcttttccccgtggcctgtacttccatgaatagacatctaagcagataaataaatctctaacagcatctaaaaattataatggaatattttaaagatgctcaataatcttaatgtaaaaacattatttatatagatataattttatcacttatagttactagatctgtattttgtatttatatgttgaacttttggaaattaatttatacataatgaaagaacaaactctccattcttccattcttaactgttagagaaaagtgaaatttatatttcttttgtatttcagaacaaagtagaagagacgatttagaagctttaggtcatatgttcatgtattttctgagaggcagtcttccttggcaaggcttaaaggtaattgtttttgtgtttctttattgaatttcataaaatattaagatattaaggtcctgtcttccaactaaacagttttcatattttaaaattttattttgtaagtaggcatcagggctccctgtgttgcccaggctggtctcaaactcctgggctcaagcattccttctgccttggccttccaaagctctgtgattacaggctaccgtgtgcagtcccagctaaataatttttaaattaccacattctcaagattttttttttctgttttaggctgacacattaaaggagaggtatcagaaaattggagatacaaaacgggctacaccaatagaagtgttatgtgaaaattttccaggtaatgaataatgtgaggttgatacattatatacagaaaactagaaatgctaatttttattgcttaagtttatacatatttttttctatgcttaaaaaaaaaagagctaaaaatatgatttaaaggttgtcagcatttgatgccgaacccacagggacactttgtgtatttgctttgcaaatggtattaatagaagaaaatcctgtctgttaatagtgttgatcattaccagctgaagtaatattttctttagtgatatacttttaatgagttaaaatttttgctaagaaatgccagttacaaagttttggtatacagtgttagtcatttgggtctcaatgtcaagttcaaaggaggtatgtgaagtatgatttggtttagttttcaaattaaacttaaattaagtaaggccagtaaaaccttactgacctcactagtttggggctaattttatattggggagctgtatgcatttatgaaaataattttgctttcaagtagatttatggcaactcaaattaagccaaaaaaaatttacttaagatttctacatcaattaaggaataagaataacttgttagtatattaagataatgactgtgatttatttgtgcagccacattaagtgaaaagagagctaaatttgaagataaaatacggaattcctatctcactttagtattccgtagttctcctgtataatgctggcgttattaatgtaataataatattatcaacataacaaaagtagctctttctcaagcttgtttatattattcattgacagcaaactttaattatatattttcctttcttgctataatatctagaagtagattttttaaaatgtcggttaatagtactagcagtttagtgtaggcagatagggtagttgtcattaaggaagcctatataaaggtgggaaaaatggggttgccaaatcaaattagccaggtatttagctagaaagtggaatagtgggagagtcaccacctaaagaaggtcactgcacaccacttttgttgcctcattgtgctgggtgtgatctttttcctgttggctggggctgcctgtgaatgctaggtgtaacttaccatctcttactgtagtgattttctgtgccctgatggtgaaatgccctgctttactaattgctcaccattttgcccattgttttatatttatatatttgtttgtctgtttgtttgtttttgcatgtattagatacatgtatctaatacattttggaattataatagcatgcagagatttgtatatcgccaaataattgttaaatatatgaccagaaattaagagaagacttacactgtcctcttgtgttatgtttttgagatttgttttagctttcctttgttagcttaattggttagaatactgctcaaagccaaggttaggaatttgaattctctattagttagttggtttatgtcactgattctaaaggaaatccagcaagccaatacagatgctttcatataaatcagttctcaccggtattttaaataaaattttaaatttataaactgaatatgatgctttgtgattaatcatgcattattaaactgcttattcaacttctcatactaccaaatattaaaaataatcttataaaaatgaaaattttagcttttcctaatgaaatgaagcaaaaatagtggttgttaaactaaacctcccatttttcttgtgtctctattcccttccttcttttcctcttttttattttgttgtaattaaactcagaaaaatttaaattgcaatgtaattttgttacttttcaagtgtttttatataatacaatgtgcttttagatacttaattttattactgagtattaaagaaaagtatagtccaaataatttttatattatttctagaagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttggtgagtattctatataataatatattacttacagtatctgttgcctttttaatagtacaatatcttcaattgaaaagagttgagaacaaatagttgttttaaaggattcattttattgttttttaagggacatttctgcaggtagtgccgtactagtgttctttgagtttttcagaagccctacatctggattctttgccttttagcatgaagagttacttttaacttttcatcctgatttagttcttaatgtcaaatatactcttttttgtgtaatattctcatgattaatttaatacttcaatcccttgatgaaaattaaaatttgtatgagtctcttcaagtcaaaatattggaaataagtaattttattagtttttttattcttttaattttcttaaaagtttattctatgtatacatttgctttggaaatgagaggcataaacatatacatttttatcatgttgatatgaaaatgtagcctaaaagtaatggcagcattaagtgttctgtagatgtaaaaataagtactttataaagaatttgaatattttaaaaacactttaaaaagtaggtatattctttttgctttaccttcttagctttaacaacatattttgataatgatgcctttacttaaagccttagtttatttaacagtcttttgtttttttccttaattcttttaagcagctaaatgattttaaataagaattttaaaatggaatgtattgataccaattgttattgtattgtagcctactccagtgggtgcagttcagcaagatcctgctctgtcatcaaacagagaagcacatcaacacagagataagatgcaacaatccaaaaaccaggtttgctgccctttagatatgaaataccttcctttcatgattgaaacatacacttttttcttcaatagataaaacagactgaaggattgaaaatacatatttttaatagataatctattttctcttaatttcactgtttattagtttaataatagcattaaaatgtttaatcataaatccttaattaatggtacaaattagtgtaaacttttaggaatatgtgatattctgttagaatggaagtatttggataccctattagaatgaattgtaataacacttggactttctaactgtagtttagttcaataaattatttattgaatttctgctattgtaaagctactgttctacacattatagaaattcagaagtaaagaagactgtataacctttaagaatgattttgtcaccagtgtctaaaagcagtgttgtagctaagagttcactcaattctttagaatcaggcatacatggatatggcttgaccctgggcaaataagttaatctgtcaaagcctcagtttcctcatctataaaatggaaataatgcatgttaatttagagcatacagtaagctttgaatcaaaacttcttgtgtctgctgttactgttattattattacaataaatacagaaatagctatatttaaaaagagaataagctatattacatgaaacactaataaagtagcatggagatcatatgtggggctctatgaagattttatggaaaaggtagcttttgacatgaacctaaagaatgaatggagtttttaaagggaaatgaagataagggcattttggggagagtgaataatataaaatatgaagcagaagtttaaaaatagagaatttgaggaatagcaagcggttcaaatttgtttggagcaggaggtaggtagagatggattagagagggagtagagagtcagtctgagataaggcatagaagttgatcaagtagcgagttcatgtttcctggccaggtaaaggaatagaaagctgttgaaatttttgggcaatgttttaatttttctctctctctttctcttttttttggtaaaaaagttttattgaagacatctttgacttaaaaatttcactatcacactgagttaaggagtgtctagaaattttctcttacaatccattttggagaaggatagtatgccgtcctttttgacttttatattgtttatcccatcaaagtttaagtgaagattaaagattaaaacaggatgacaatcaaaagaaagaacaccacttgttaaaaatcatagcaaaataaaatgctacattttagggagtgtttaacaatattatgctatatatatatatatagcatggccagttttaaaagattaatattaaatttttgacttagaaaaattggtactataaagcatctcatacataaattacttcatatataaattaaaattagttgatagctggagtgctgtgaaaagattctgtataaagaaagaaatggctcagaagttgagacttagtttgtgttttataaaccagagttaattccttggaatgtacttggaagaagattaatacggtattctttgaaattctccacttgagctgttaggtattataataagtgaaattcctctattgttgaattaaattataaatctaatgttttagacttttagttttctacatctttcagacatgtcttgctaactagagtataagctcactgagggtaggaaccatgtttcatttgtccagtccttgcactaaatgtagggtgggtgtgtgtgtatatatacacacacacacacacacacacacacatatatataatatttaggcaattctttaggataggcttatatattgaatttgggatgtgaatatacacactttcatcatgatagaaaagttgtatatttaaaaaaaacttcttaaatatctctagaccactaagcagcttaagttctacaagaaacccacagttcacaatcccagaggaagatagattatgtcacgtgacttaaacctttgtaatgcccctagataaatgagttaagttgaggggatcctgaaattgttgggtacatgtaattgtttattttcaggagagggcgtgtagctcttactatattcttagagagttccatgaccccaaaatattgcgcattgccctagatgtttgtctcaattttagcatcatttttattctttgatcttgtctagacttgacttcatctgatttgatttcaacttaagctacaaatctgcttaattctggttatggatttggagggtttaacgaaaagacattatagaactgtcatagttttgatgacatactttatgccacagagtatgtaattttgcattgtacaatttaggaagcttagtgccagaacatgtattcatgtgtctacttgaattttacatctctccccttaaggttgttctggccaacaatatgcttgaggctccccatactccaatatgcttggcactttgtggcaagattttcatgactttgtttgaaaaagaaagaaaagagtactgaaggctttagaatatatttaattttcgtaaggagctaggtagtattattggaagagcattatgctctgagttggaattcctgttgtactccttggtaggtctgtaactgtggggaagtggttaatgtctcactgtcttcatcagtaaaagtggatgataatatctacctcaaaatatggtaatatataaagcagctaattcagaaccaaacatgtaataaagtttaaatagtatattcttctccctactttttattagtgttgtccacattttcctgaaacagaagttgtcccctattaagaaacttctcttaattttactggtagattatgatgtttgttattgccatgcatatttgccaagggatctaaaaacatcaagaattttcagattatttcatagacatgggttccttaatttgaaccagataaaaggagatcaaggaagcagagagattcatatatgtaggattatcacttagaaaaaaaattgttttgtcatattctcatagtattctgtatagtgcttctcccttttcaaagaacttttctgttttctcatattatccttagaatcagaaatgggggactaagcaagagagaaaatatttttagaatctcaggtacagttatttaagggccatcatttgtaccttgctaaaaatagctcctcatcagaaaaccagtgatgacatctactgtgtaaaaatatagtgggtggacttctagtgtgcccaggatttatttggagttctttcttggtcatggcatttttacctttctggttctttattagttcatttataaagctagagggtagagtctgtgatttctaaagtatttttacttctaaaattttatggttctattttatttttattgttgatcattacacaatttggcaacttaattaaaatcactccacattctgtatacaaagataactgcaccatgattcagaatagtaagggtattttaaatttccttttatacgtttgttttatatattatgaggataaaatgtttaacatattgggtttttcttcttccatgcatgccatatgcattaaataaatggcagtcggcagaccacagggcagcttgggactcccagcaggcaaatccccaccatttgagagctcaccttgcagcagacagacatggtggctcggtacaggtattttctgatttttgcatgagtgattattacccagatttatacaactaacccttttttttggaactcatggcatgatttcatatcttaatggaaaatttgttgctgaactactctatccataattctattcctttgttatttaaccagaaaaaccaaaattaacgtggtctagaaagaccatcaggaataccaagatttttcctttgttcatttttgcaactatatgctacaatatttaagtcatatagcagattagaaaaacaaacggtattatgcttgaaataggtattaaacttgactttccaataataagatcagtctttttaatgcttaaattaatagaacatttttgtattttttcccattcattgactttgcctccttcaaacataatcagttaaatatcttttttcatccttagtactcagaatgtactttctgattaattgttcaaacgaacatgaccctaatttttataatacatgttttgtttgtacttatagaaaatatcagatggaaattttaataagaagtgtttattaaatactcccctcaataaattgtatggctttttagataaattcaaagcagtcccttatttatgatttgtttcttttcaccttttttatacacttagagaccgctactatatatattctgccctccgttgccccataaattttaatcatttatgtatattgtagaaatagggaaagattgctgagtctcgtattgtcttttaaaatatcggtttaaggtaatctaaaagccagcttaaagtaagtgagataacaaatgttatcccagtacatttcaatttagaattttttttacattttcatttttttctttacatattttcacttgaataatttgccattttatcaaatttgcatttttcttagtgtatatatttaatcaactgattctgtactctgggtgctattctttcttgatttgagttctaaaaattaaattatgattaaatcttatgagccctcacgtttttctcatcattaaattttagaggtaatttaaattatataatggagtacttttgtagaattttgcagtttatggaattttcagtaatgtgtggtagacttatttgagtagatctataaaagtctagggtgaagaacttagaggcaagagtgtctaaattgtaaaaatttttatgacttcaattcatatagttagaaaagctaattcagcaaatatattctatttgcataacacaaactatattttgtatgtatctgtatatgtttacatgtttttaagtttgtgtgtatgtgtgcaagtgtttttgctcagtgtaacaattaaggcactattagaaaattttcctaccatttctgtaccattaccagatttattttcttagcctcttcttactcttatgtgattccttgaggtggctcgtgggattcctttggactgtcaaagggtgaatgaatttcattattcattcattatttcactacttcacgtttattgtttcacatgttttcacagagatgtttgaacattgctcgtttctcattatttctaagagttttcagcgtactgagactacatctgacttcatcctaatattcaataagtgattaacttaataggtttctagtaatatggaaatacataggtaaaacaaagaatagtattttcattgacttcatgtattttgtaatattaactgacacatgatatgatggactaatatgacagcctaagtaggatcatgcctgaatccttcccactccaaaataaagactgaattcatttataatttatgtcctatacactttcaaaattatttgaaaatttgtaatgtgacccttgtgtaattggactaatgaaattataaattaaaacgtaataagagcaaagaaaagtacctaaaatttgaactgatattataattgaatactatatttgattctgaatgaaggcagaaagggaaacaatatgttctattaatattattctcattgtttgataaagggaggagagaaagagaaaaaaacttttcagtaatacaaaaatatgagaagaatttgccttgggcttatttgtgcaatggtcattaaatcacctgttgaacaaactttcaagcattggctttacaggagatgcaaagactttatatggcaattaaaaaattattcttaataaacatactaagagtatgtcatcaaatagtttttttaggagagacatttccctaattaataagtcactgtctggtattgaaatgtgacgcaggtttaggatatccagaaacagaatcaagttacttaaaatgagcctcggtaagactatggctttcactcctcactatcattgcagtcttttccttggaactgatcattgctgtcagtgaagcactgaaaatcattccaggctgtttagagttgacatgtaagatgaaacctcttgccatttttgacctatagaaagatcctcaggtatttatttcacatgtacttttagtagaagttatcagcagagtctaaatttgaactccctgcctttccagaattattatatagcagaccagacagagttaccaagttgagagttaccaggttgatgatgttgcaattaagagcttaagctctgcagtcagatttgagttcaaactctgtgccaagattatttattagtaaatgaggattttaacaattcctctaccttatggttttgttatgaaaatttaatttaaaaagtatttagcatagatgttgaggcttaggaagtgttagataagtagaatctattgtttttgcaaattaagaaacttgagtagtattttcattttattgatctctgggaagtgaagtattagaggtacagtcaaaagaaagcattgatgaatgggatttttcttattttatctctttagttcagtcatgttaagtcactagctaaaaagatacagctgtacgtttgataaactttttccattcacgagactaagaataatattcagatatctactacctttattttgtatcagcctgtgttctggaaaacccctaggggaatcaagtgtgcccctctcggttccctcttagaatcattggtagtaataaatatggctgagaaactcagacctaccacattcagtttcttggccattcattactcagcaaattgctaagtgttcattatgtgctaggctcttgtaggttttcttgaatgaaaagaagtgtgtaaagacatggtggctgtgtccatgaagaagtcagtcaaggaggctgatgaacaggcagggtgataagtggagatagcacagggtactaggagaattgatacgaaaagcacctaacctggatgagtcaagactttctggggaaagtgacatctaaactgagacgtaaagaatcagtgggagttaatcaactgaagatagaaggggtcaagagaggagtataccaggcagagaagacaatatgaataaggttgtggagagagagacatattgaggaagctgatttagtcaagctggtgtgtgttgagaaatgagactgagaaggtaggctggaggtaaatcatgaaggatctaacgggtcttgttactaaatttggctttattctgaggataatgggtagccataagggggattaggagaccaaatttgactagtgttttctaaagattgcgtttgctggacactagattgaaaggagacaagtctaaatgagggatacagctgtcaaaagtctgtagttgaggaaaaatgttgggtagtggggataaacaagaaatgaaaggctttgaaaagaattagaaggtagagtttagttgggtatggggctgacgggaaaggaaaagttcagttgttacccctttttgacatgtttctacatggcaaatcaagatccccaaaattaggttttaaaatataccactgacaacagatagtagtaatctctaattccattttagctatgcttttcactgtagcacaaatccatcgagctcagtgcaaactgaaaatctgatcctatatagaggcaactgtaagcaaagggaaaaagacaaacattaaggacactgctggaaaactattttacatggttgtactatgtacatgtactatgtatacctcctgattgtttggaaatctcttatagttgtacagtctttggtttgaatctaatgaataatgtgactctgagcacttgggagaaaaaggggcagaattacaaatggtgcagatatgttgtgcaaccaggcattgttgaggaaaacgaaagaataacattcattgttgtaataagcagtctgatcttttagccagtgaagcatcagaacaaataaatacagttggtgataactgaaaaggattatcttgagatgataataaatgtatcttgagatgataataaaacgtgattaaaagtctagaggaatagtagatactattgtctcaattacattaatcgtgaatactgacctttctaaaacatttctaatactagtttcagtctacaaaatatttgaaaatgcagttattaacaaggaacaaaatctagtgactattacaatcacatctttctattcatagttttctggggtactgaaatctgcaaaagagagattgtggagggagtatggttatgtgcctttattacataaataatttatagttcatctagtttaggaaattccttatctagtatcattggggtaaatcagcattatgaatttattttttttttacaataacatttacagtaacatctctgaagactgggatgatcaaggaaaataattatcctaagtgaaagttaattgaaaatccattttggcttatctttgttgaaagttggtgagcatgtcactatctgtgctttagggtcatcttttggaataccaagagtatcaattatacctttagtctttaggatatgtaaataagttggtttcatatagtatatgtatactttagcacaggttcaggaaattatttggaagtcactcttttaactgttaatatatctcattagtgtgctttcttatagatgcctttttaaaaagctgaatacataaataaaatatataatgttttagtatttctaatacattattagatgagaatttggctaattaaaatatttggttaattcatacattgtatcaaggttctacttagtaatcttgcttacaaggtatcaaatagaaattaggaagacaggaggggcgtggtggctcatgcctgtaatcccagcactttgggaggctgaggcgggtgatcacttgaggtcaggagttcgagaccagcctggccaacacggtgaaaccccatctctactaaaaatacaaaaattagccaggcatggtggtgcacacctgtaatcccagctacttggaaggctgaggcaggagaatcgcttgaacccgggaggtggaggttgcaatgagccaagatcatgccactgcacttcagcctgggtgaccgaataagatgccatttcaaaaaaaaaaaaaagaaagaaagaaattaggaagacagtagtataactaatttgtatgaattcattatatttggaaagtacattaattgattttaaaaatcattgacaataaaaatactatatgttatgtctgtactctaaaatctataagaataacatcttttggaattggatttgtcaggcatctgttaagtttacaattatgtctcacacttgcttgtgggctgtttttccaacatccctcttaaattctgacagtaaaactggagtctagttgccttttttttttttttatcttcttaaaataagaaccgtattaagtttcctgtcaaattgggaatgtcagagggaatttttttttaagaacaacaacaatcctgtataatacctgaattattttttgaaatgtcaaacctcagaatatctgtcatttttatgtgctttcaagaaatcagcctgatgtacactagtatttcagagactcatcttctagttcaagttataattctagaaatgtcactttaatagaattattctttagaatttggcttataaaaatatttgtgcatatttgattgttttagccttccaggaatataatgatatattatttacagtagtatatcttcatttcttctttgtaaaacccttttgcaaaaagacacaaattttaagtgaaaataattttaatgccatgatacactctcaagtcaccggtgttaaataggccagtttatgaaagtcaacagcagtatcctatcttaactctgttaccacagtgattctattctgaacttgggatactagcctttactgagaggattggggaatctgggaaaccctggaaaaattacattaaaggaagatgttgcttccttctggtctggttctggtcaaccaggtaaaatggggtttgaaacatttcaataaaataaagtttaccaaagtcaggtataaaaagtcttcctctgtgaactgaagtaaatccgattatataattacagtgtatatatagtcactgttgctagaaaatatgtaatgttgctagaatttagactacctgagtttttcattttcaattatgctgcttaaaataagggaagacatgttagaggagctgcctgtaagttgaggtggcatcccgctagctgtctagggccattgaactaaagggagaataggaaacctgttgaatagtatgttgagaaaagagcagtggaaattgttcagtgaactgtttgattatgtactggatacaggcactctgttcaaggtagtggagaatatgtgagataagaatactactttgtgtctcctttccaatttagtgcagaggcaatgacattttcaaaattaagaataaagaacaaaattatgttcaataattagaaaaaataattatttttaaatgttttcagagagagagagagaaaaataaagagaaaaaatttacagttcaatagaatgacagaaagggggaagcaagtgccccagaaaaggagaggcatgcttagatgtaagaatattcttttctttagattgcctttgaagattatcaaggcagttttgtatgttttcagctgtaggcacaactgcagtgttcatttctaagtacttattccatataggatataggaaactgaatttctacaattcctaagttaaatatgttggttgatttgtagatattaatactttccttggagttggagagggtcctgtttctctacactaaagtgtcagatctagaaggacagggatgtttatcttgcttactttggtattccaaatacctagaacagtgcctaagcatgttgtagactaaagtaagaacttagaaatatgaggtactataaatactacttttaagtctaatagtcagttgtcaactctgtagcccatgacagggttgctaaccttttatttcatttaaagagattaggtagtgggtaggaggggcatcaaagagaattcttagatttttgagcctggaagtctggaagatgggagggctttaactgaaatgggagccttgggaagagaatacatttcagagggagtaggataaatttgcctttagaaatgcagagtttaaggtgccaaacttggcttagcaaactgaggatatgggtgagtggttaggcccagggagtcctttacctagaggtgagagttgaagccatcattatagataaaacatagtgataatgatggccaccatttattgacctcttcccatatgccaggcactgtgctttatatattaacatttatgtattgatctcatctcaccctcatatcaaccttgttagttagatgctactgttcaccatttcatacttgagaacactgaggtttagcaaggtaaggtatctttcccagagtctcatagctggtaagtggtagagctaggctttgagtctagacccatcttactccagaatgatcagctagcgccaagtgatttgatgtacaagaaaatgaggcaccgagcaaagtgtcctgaatacattttctaggaatcattagtaacctttaagataactcttattagagttcttatgtagggttggagaactgattgcaaggagtaaaggaataaacacatggaaaattttataaaaatggaagtggtgagttatatattttttttttccaaaaagtttagtgataagggaaaaggaagaaataataaggtaaatttgcagaaacaagagaatttgggagaatttgggaatttcctcatttttatcttgtttcaggatttcattcatgcatacatgcattcatttatttcaacgtatatttattgagttcctattctctgcgagacatagcaggaaacaatacaaggtctctcttatcctggagcttaattttaatggaggtagggatggatgtcaagaaacacaacaaataaatgagcaagcaaataagaaaaacatgaatactgataaatactgtacaaataatttaaaatagggtgtaacataatttctgtgctgtgtcagcatagaaatttttagctgtgtgatagaaaaggcctgtctcagagatgctgtttgagaatctgaaagatgagaagtcagctaataagtaggaagagaattctaggcagtgacaataggtaatgccaaggcctttaagtgggaagaatctcgacatattggatggaggctagtgagcttcagagaagatggtgtaagctcagagaggtaggcaggcatcacatcatgtgggactttgtcaatttgtgtaaggaatatagattttttattctaagtgaaacgggaagccaacagttggagagttttaagcagagagctatacatgatgtgatttgcatcttaaaaggagcaccctgattgctgtgtggataatacatttgagtgggggacaaagctgaagactagataataggtttttgctcttaatcacataagagatcatagtggcttggactggagtccttgtagtaatagagatggtgagaattgattagatatgggatatgtttggagaaggatttaacaggatctgccatttatggattagatgtgggttttaagttaaagaggaatcacagtgacccctacgtttgaacaactgggtgaatgaatggtgttgtctctatttaaatgggcagtttgaaatggagacttgagcataattgcagattgaagtgaaggatccattagaaggagtaatattgaagtttttcaatattcaaggaaagtaattcatgatatagcaaggtgccagaggacatagacacacaagaggaaactgattgagacatacatgcaggagttagccttaaaaaccagagggaaggagacagaagacacagatttcaataaggaaaggaagtaagttgaaaagcgcatattagatgactttaatctttaataaaatgctagaccaattactgtatttagttatgaacagctacatattgttttgtgttcctcacattaactttctaattgaaatactttaacaattatgtttatccttgtataacctatttaatatgtatgtatatttatgagcatgtgtgtgtacatatacatatataaaaaatttttttttcaaacaggttgtaagttctacaaatggagagttaaacacagatgaccccaccgcaggacgttcaaatgcacccatcacagcccctactgaagtagaagtgatggatgaaaccaagtatgtgtttgttttacttgttttagtaactttttgttcttaaattatgcatgcttgagatttatagttacatacaattatttcaggaaatttttttcagggaataggtgcatgcaaaacaagtggtatgcttaattattttaatcactagaatgagtttaaaatagtgctattccagtaaacattttaataatacaaaatatttaagaactgtgttcaaattcttatttggaattaacaacatatttttagcttttgagttttaggagtgttgatgcatgaaagttattgatgtactatcaatcttttttctgtaagcataagaaattaattttataaaatgcatgttttaatattttgaattagttttttcaaaacataaattataacaacattgcttggaaaaaattaagcatgaaaaacaatgtgataatttcaatgtgagctgtttctgattctctctctctcttttttttccttgtatttttttttttgtgtgtgcgtatagctgccagaaagtgttgaacatgtggtgagtctcaagtgtaggcaggcagaaatagctccattgactgtaatttcaaagatttagcatcattttgtgtcttttgaaaacaaaactctcaacacagtgattataattggtaaaagttattcaaaagtatttgatatcattaagatagctctgaaaagcaagaaataattgtttgaggagctcttttgcctgctgcaacttttttactttaagtgacatagatttggggccactttttaattgcatagatgatacaccaaccctgcttgtgcttgtgcatttgttttataatagtttttatttgctatttaaatagaaagatagatttttgcattaagctttcttttttctctttgcaattgttaaatacatgtagcagatctcatcccccacagtagtatcactaaaacagtatttcatttactaaccaattatcattgcccttgagtacaatattgataaatttcatgataaccttgtagtgagaaagccattttaaaaatcctcatctaaatggttgctaataattgcagatattatggaaagtaacattaatagaaataattttagatttaaattattttctgacatttgcctttaattgtaatactgtgcttaaaatgcttctctcagtttcaggacaaattttgagtcagactgggagtgaataaaggaagttgcttagtttagtaaattttgaaatattttactcatatctaaaggcaccttatataattttcaaaattatgctcatttgttggctgcaaaattaggaaacttttgtggatttttttttgttaaagagcagtgattaagaatccattttaatcacttttgactatagaatttattgacataagattaagactagtgtatgtcaggatataattagctatatacttgtatatttttatgaactacagaaataaatccgtgaaagtatagtcttacttgtgtgtttttaaatcaaatataaaaacaacagcttatgtttgggaattttaggtacaatcctaagacaggaaagtagggtggtggtgtggcagattcgactgcacatgtcctttgcagttagacataggttatagaatcctgtttctgccacttatttgttaccttcaagaaagcttgtttctttttctgtaaaatgaagctaataatacctacttcataggttgagaaaattaaatgtgataaagccctggtattttgtctggcacacggcaggtactcaatagctattatcacccctatttatttcttctcttccaactgctggtgacgtttctcatctctgttcttgggcttgtgcctcttttatctgtgtcctatatttttacttccatacacacactcttcactgaaactggctgttctgtgtttacatcctcctggagacttgcttttaataaaatctattacatttatccatttattcattcagcagttacactgctgaggtttctgacatacctgatgctgtccttgttcttaagtagattacaagccagcaggaagattgcagttgtactagtatatgtcagtatgtgattaatacgataaaaaaggtattttaaaaaatggttagagcttgtaaagataaagattacttcctgacctggatgatcagagaatacttgatggaggtggctctgaagaatggcacagttatttagttgggatgagtgtgggtgtgtgtttgggtccctatctgtagacactggaggatgtgaaagaagaaagtggtgggaaggctattgctataggaagggttctccattgcctgccacatcatgtccagatttcttggcatggcaccaaggcttctcatacctgtcatagtctggcccatctatttttgcagctccgttttccattctgaactttatatagcattggttccttaaatctgcatttgctatgttatcctctgtatgtacttcccacttcttgaaacttactgaatttcttgaaaacaggtattttttcatcctcagattcctagtggctatatgtcctaataaatcattactaaataattaacaatgtggtatacccatacaatggactgccatttgacaatataaagaaatgaaattgaaaacattgtgctaaatgaaagaagccaaacacaaaaggccacatgttatgtgattccatttaaatgaaatgtccagaataggcaaatacatagacatcaaaagattagtgattgcccagggcagggaagaggaggatgggatttctttatggagtgatggaaatgttctaaaattagatagtggtgatagctgctcaattctgaatactaaaagacactgaattatatattttgaaaggataaagtttataacgtgaaaaatatcttaataaaatggttgttttaaaaaaagtatagcaactcataatatcagtgaagccttacttcaggtgggttaggtaggttacagaaatcctcagaactttcctacctctttgctgattaaacattctatttaaacaagattttttctttaggtttattctgacatttctacacgtttgttattgtgttcctcataccctcttaatctgtgactaagaaatttgagcatgattttttttcttttttaagagatggaatcttgctgtgttgccaaggctggccctgaactattgggctcaagtgattttcctgccccagcccccccagtaggtgggactataggtgcacaccatcatacccagctccttttctaaattgcatcttatacttctcttctctgtgccaccatttgacacgtaactagggacctgcttagaattttctttcagaatttctttttcatctttcttcttacctataattagcagagatccttctcaccccaccccatttactagaatgtattctataatgcacattttagcatcctcatgtttcctgagaatagtatctcattggggtaaatacttgatttccaaatgatggaaaatactctattctcccatatggaaaatgatggaaaagctgattagcttcattagtaatgaggttttgtctttcttgtttactgtagctgagaattttaagacaggtaatacaaatgatagcaccttcatcattccttccaggaacttaggaaaacaaaataatttagtttaattatttactttttaagtagtatgaaaccatcctttattctttctctttccttcttccaacatttaccgaacagattatcatgttttgtaatgtgatgattattaaggtatgtcaaagtttgcataccattaagttggttggaaagtatactaacaacttttatacaatggttctcaaccttgatttcacattatagtcacctagggagttttaaagatgtactaatacttaggctgtattttcaaggtttctgattttactagttggtctgtggtggggcctggttatcagtatttttaaaaaacttctaaggtgactctaaggagcagccagggttaaggatcattggtctaatacaaagtattacatgattagcactataggaaagggataatttttactggagttcagaaaatggagtatgtcctcctagttgggaagatcggagaagtcctcatgggtaaggatgcatttacactagttctcaaagatgagaatgatttggcaagggaaatggatagaaggagtcagagagaagaggttgacgcaaggaaagaattgaaccagttggaggagtaactcatgcaggcagagaatatatgaacacgttaatgaaaactgagataggctaatttcccaatctcagagggccttggtagccagtaaccaaatttggacattatctttctcagcacaagaaaggaagccaagaaatgacatgtggttttaagccaagaaacaatatgatcaggttgatccttaggaaaattaatttggcagcagttatgaggcttatgtcacttcctggggttcagcagattgcagaaaatggtttaaaaatataaattaagttttcctatgaaactagatggataatttctattttgggttagtattctctagtaaacaaactattccttaaaaaatgttttaagattatagtattggaccatttgtttagtttctataatactaagtgttcaggactttgatagtctctagaactgtaaagataagtaaagaataatttatttcctcaagagatcagttcagtgaggaagagagaggtataaaaattataatacaaagtgacagagactgtataactcttttgggagagagcaaatggattttaagtggaaagaagagcatgtgcaaagatactgaggtaagaaatcccacgtggtgtgttctgggaatgacaaggagatttttgctttttcttacttttcccttccttccattcatagtataggccacctgggaaggaagcctaatggagaatgagactaagaggagggtggaaataggttgggaacaaaattcttgaagagctctgtgaacttaatgctttagtcaatggagaatcattgatgagatttgagaggaaaagggcatggccatatttatgatgggggcaatttggatggcagattggagagaggagagacttagactgggaagtcctttaaaaggtgcttagcagtggtggaggcaagttgaaaagttcagaactcagccaacatgagaaaatgggaaaattttgaaagtcatttcagacttaagggactagttgcaagtggatagggaggaagaaattggagatgaagatgggcctgcaggcttttggttggagtaattttgtagatgatcttgttctctgatctaaactcttcttgcttagctaaatggttcctcgttttttctttaaatcaagagatccagagatatgaaattacacttcaggtttaaaccttaaggggaaatattctttgtcaaagaattaaagattagatgccataaaatatactttctgtacactcatcaacccaggtcaggagaaactaggttctggagtcctacgtggttagttctaggaggtaccaacagtctctcaaccaaaggatgagcaatgagtcatcttagaagggataaataagaacatcatatccagatagggaaacatgcttcagtttctgggtggatttgagagaaggaagtatatacaaatatatgaagaaaaaggcaatgaacaaaggagaaatggtggtgcggtgtcaatagcacaagcctgtatgtgttttaggactttgatccattttgattgcctgtttgttgcctaattgtatttaaagaaactaaggttgtttctaaagttcatcataagtaggacttaacatatattcccaaagaattttagagtagagatgtagcttcacattttgagaggctgaggtggaaggattgcttgagctcaggagtttgagaccagcctgggcaacatagtgagatgttgtctccactaaaaataatgaaaaaaaaatttaccagctcggcgcctgtagtcccagctactcaggaggctgaagtgggaggaccactattaaataagtactaactttgtgccagtttgttgggctataactgtgagcagtcctttatgaagcttaaattctagtgcaaaggcagataataaataaataaaataatttcaaagtaggagtaagttattacagaaaaataaaacaatagtgtgctcaagtggctacatgggagcagcactgtttcagattaagtgctggggaagaggaagcaattgagatgagacctgatttcttaatctctaagactataaattagctgtttcggtaattacttttatcttaagaaataagccataaggttaaaacatcaatttacttcctaacttctgtaagtatatcgtattttgagaacctctctcttgtctatttggatgcatttgtatcacataaggcaatgctgtcctctggtggtagtaactttaatagcatgccagctttacttttgcaaatctttataaggacgttctttatttagtgggaattatttaaaatagatgtcctttttagattgtgtttgaatttaagggccattagaatttatttgaaaatcttatttagtctcaaataaatgcttggcgtagttcagtaaaacactgttgaaggaaagattacttaagtgtaaagaactcaactctcagaactcaactctcagaactctcagtactggaaatacaaactaagcaaagtaaattgctgatacaagtgtagaaaatttgggactttgtcttgttcatcaaaatgtgtattacattaaattgcccatttcaaagggctaatacaactttagaaaattttgaaagaatctactttggaatttgaaaggatagtgtttaagaatagtgaacattattaaaggaattttatatcaaacaataaatttccattgaaatatggccatattcttaaatttaatattctaagtatttggtctgtcacttctaaatacctatttttatgtcttgctttctgctatttggatatttttctgctcttttctaagtcttaaatttaaaggttcatttggagtaaaggattttatcttttagaaagtaattgagatttgagaaatattaggtagctgacagttaaaaataaatttgacttatttttttaaatccagatcaaatctcttacatgtgtagtcttgttgtactgtggcagctcttctctaggctcttgactgggtaatccatttcagttctttctgctagtcacctccatgagagtaaagttgataaacattcatcattacatatatttctagttgaatctttatcagctggtccacaattttaaattatttacattccacggtctagtcggtgtttactgtttggtttacttaaaaaaatgcagttgtgtaatttggtttgcagtaccctcatagtagtttcataattatggcagaaatcacaataaataatttaaaattatttttgactaaagataatgtgggtagagagattatgtaatttaactggacagtgtagatttctgtttacatttatttcacagaagtatataaaacatacctagtagttattttatattctgtaatcttttgccgggtgggacacttgaagctattttttttttttttttgaaacagagtctcactctgtcgcccaggctggagtgcaatggcgcgaccttggctcactgcaacctccgcctcctgggttcaagtgattctcctgcctcagcctcctgagtagctgggattacaggcgcctgtcaccacgcctggctaatttttgtatttttagtagagacagggttttaccatgttggtcaggctggtcttgaactcctgaccttgtgatctgcccaccttggcctcccaaagtgctgggattacacgcatgagccacccctcctggccaaaactattcttctatgaatatagattagtaagaattatagaaacatctttataagggcatattatacacagtctgaattggcagctctcgatgatgaaatcaccatgtatataaatatactttgcttttattacaaaatatgatttataaacatgcccacatacccacagaggacttcagtggaaaccagggatactcaaccatgcttgcctgcgccaaaagtaaattcaaccttaggaaggggttgactgtttaaaggttaaaagaaaaggtgcctaactatatgtagtgtctgtcatgttgtatattttaatagactcttttatgtctggaaggggaaaatgccataccttcatgcctttatttgaaggattgtgaggcatttaagatagatgtgtatttaatttttttcttttttttttttggtgggagcagatcagtgattttttcagttcataccagaccacagcattttcccacagcagccttgatgtgttcatctcctcttttagagacagggtcttgccctgtcacacagactggggttcagtggcacaatcatagatcaaacattcctcctgcctcagcctctcaaggagatggggtaacaggcgggtgccaccatgtccagtgcatgtgtgtgtgtgtgtgtgtgtgcgtatgtatgtataatataatatatgtgtgtacatttatatatgtatgtgtgtatatatatatttagagatatttgtgtatgtgtatatgtagttagagagagagagatatttagagatggggtcttgctgtattgtccaggctggtcttgaattcttaaactcctgagctcaagcaatcctcctgcctcggcctctcaaagtgctgggattacaggcatgagccactgtgcccagccaagattttttttcacctagaaataaaagtcagtattatatttttttgcatatacagttttgacttgtaaaatggaatcacctcaattgtgctactttaaatattaagcatagtttttaccttaactaaactttcaataagcttgaccttctttaacccttaaagaattcaaaattgccagtcttggtattctatataatgtattttctgtctttcacttttttaatatgatggaaaatgttgactagtgtatattggagtgtctttttatttttggagtctaaactgattattggtgagaataaactccccaatgttaggatcattattgccttcctaatggcttcaacagtcacatataaatatcagggagaaagggtgagaatgcatagaatgaaattcttaattactcttagtgaaaaaccttttgaatttaatggctcctttttatgttgcatagaatgtcttgctattcttaaaaggcatgtgaatgaaacataatagtaatagctctgccatattttcactaatacgtatgcttcattggtgtaatcactgtttatcttgcactagcctgttgctttttatgatcatttaagttaaagtgatacagtcaactttgtgatattttagtgcttttaaaataaaaagagtgtttccctcatctgcaggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttttaaacttgctctttcccatttcctctaaagatgggtaaaataatgtcactccctaatttaagataggaattataaaaatttggtttatttagtctgttatatatgagaagcagagctaaaggaatatgcttttgttattttatgttttgttttgctttcttgaaatccagtggtaaaaagcacacactaggaaggatctaagctttctttaatataaaaaaaattatacttctctgaactgtttaatagagcaataattaaatacatcttctgataaattaagggaaatagcatcatttttcctttttgagaatggaatcatactattatgttcacagaaattaagcattattccagttttaagtgaatgactttaaaatcattgtagatggggagcccatatttctaacagtatctcatagttcatcattgtgctaggtgctttaagggattttacaaaatggcattaatggtacgctacttactgagggatgctacaggtaagaaaaggcaaagcagccctctctcaccctgtgaatattgtgtccattaagcagcagagaccttcagaagcaggagaaagatctggagatgacacaaaactgttaaaggctctatttagaaaaattcgactttaagattgggatttcagtctgaatgaatgtatagttgcattagtc

SEQ ID NO: 13311 - DNA, 38240 bp, Human
aaacgcaacacgttttagattgaacacattatctctgtctgctaaatcagctctctctctgcctcccctaattagtggaagagcttctccaatgatcttatcccctatggtagaaaattcaaaatcatcctagactgtgcctcacccttatgtcctcttttttttatcacataccaagatctgacaattctattccatgaaaaaaatcttttgagtctgacctcttctccaatcccattgcagctgtctcctaagttttggaatagtttcctaaatggtctcttggcctctgtattagtctgttttcacactgctgtgaagaaatacctaagactgggtaatttataaaggaaaaaggtttaattaactcacagttctgcatgcctagagaggcctcaggaaacttacagtcatggcataaagggaagcaaacacgtccttcataaggcggcaggagagagaagtatgaggaaccaagtgggaagagccccttataaaaccatcagctctcacgagaactcactcactatcatgagaacagcatgaatgaaactgtccctatgatccaatctcctcccaccagctctctccctaaacgcatggggattatggggattacaattagagatgagatttatgcggggacacaaagcaaaaccatatcaacccccaacctcttttgcccctccaacactgctcttggcattccagttcctgcctggtccatagcctactccttcttcatctgtggaagggagggtagtgggagtcattagcctgggcagggaggagtgttttatcactacactgtttagaatggtgccaatacaaagcacatcaactttcagcaagtttattattgggtttaaattctctacacacgatgcactgcttttgcctacacctggacagtgttcccactcactctccttagtatgatgctggagataatatgatctgccatgaaggttaaataaagcaatgttcactgagaacttagcccaggcccctgcacatgctgagcattttgttaatgtaacaatgattagtaatagcattgctattggttccccatctctggcaaagcctttcatgcttggcctccctcactctctttcaccttcctaaaccctacactccagctatgccaaactgtttactctgccttggacacaccaagttcctcaagcctttgcaaatactccttacgctcctagaacaatggatgtcaattcatcatttaggatccagcttacagtcatgctttccatgaagccttcctcaaattagccacacaaaaggagtgactcctccctgtattcccatgaccctctgctcatgcctcctctttaaagcctgccttcactggagttcctggaagggagagtctgttcagcactcatctctgtatccacagtcaccaaaattgtaactgccccataataaattcccaatacttgcagggattttgcttcttggcttgttttgttttgctggaatgaatgaataagtaaatgggaacgattttgacttcaccctaagcctagctaaaagtttgggtagtgacagttttggttattttgtgtaacctgatagtggatcccctttctatgccaaaaaaaaaaaaaatcccccaatactagagtacctgttttcctagggaattgacctcagcaactgaaggagaggcgattcaaagcagggagtgtgatgaataggtcaactctgtcctcgcagccgtccctgagagggcgctgttcccaaatcgaagccccagaggcggagactgagacaccggcactctcccactggactgggtcagcatccctctccccgcgcggccgcaggtctagagctgagcgcctgcccacaaacatggcggcgccctgcgcggcttcccgtcgccgcaaccgtggggccggccctgccttgccagtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcatctggcagtttccttgcaggttcaactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtgagccggcccagggtcctggcagcccaccccggagcccagcgcctagtccctccggtcactcctggtgctccatcccagacaggggaccaatgggaagccttcagttgagggctctgaagagatctgtgtttgtgcaggcgtcaaaatcttaccccacaatttttgctggtcccccttcccatcctacccaatacctgtccactctacttggcccttggctgtggtggtcaacctgaagtattcaagtgtaaagccattcccagcctccccatcttatggatgatgaaaccgaggcccaggaggcacaatggaagagctcctggtctctggagcgccttatgttggtggggatgtcttacgtcttcactttttagcaacacatcattcacgggcaaaacctcttcccttgtttttcaaggggcttggcactcacatgggggcctcacagttgcagctgagttctgatgggtgcaggcctgggaacggaggtggcctggggatgctacttgtcctccttttatcatttccttctctaaagcagagctcctgtgtatatatcttggagactcaacagaagctgagtccagaagcagaatgctttttttttcccctttctcttatttgatcttaatggcttaataataatattaaagacgcttagagatggaagggatattggcattgtctcatccagttgctgagtttgcaggtgagataaccgaggcgcagagaagttaaatgaattgtgcagagccatctaaagagtgggcagcagacctgggatgttaagtcctagatgcatgtgaggagatgcttggctaaacgcctgtaactctgagaatgagtcatccattcccttcaattacagaatccttgggctggagggaggctcaagaagtcaatttgttcaccctgcattcagagaagtccaccagaggcccttcttatctttagagaacaggcttcactccagtcctcaatcttcccaacttcaaggccagccattttcttggccccttttatagccattccaaattgttgagaatgctgtggccctctgtcttaagactcaggctcccacagcttgagaatggagtttggtggccccccaaagtcaagtgtgctcatctcctgcagagggtttggaaagcaggggtacccttattcctattccttggctgtttgagcatccacagcatgtgaaatgctgtgctttgtttggtgaggagtgcagaaaagttaacagtctagttactaattttctaggtactaattttctctaacatccaccttgtaacgccagccttctggaagtagcaccatgctaataggtcatgtctaaacacaacaccacattgagtttgtccttgtggagtgcacagcctagggctcagcagctttaagaggccaagtgatttctgaaggagtttgggaggtgatgggcctgttggctcttgtatgttttatattgatagaactgcaagaggccttagagattaaactaatccattgcttcttaactttctatctttagaaaaatgtacgtacatcccaaatttgcatataatgttgggggtccaagggccttctttggactttagggtgggaacccctgatctaagccatgcttcttgttttattaagcacccattgctgccaaaggcacttcagagctgcctgggttgcctgcagagtttcctttgtgagccctggcctccacttggcccattcatgcctcaggggaagttcaggccatttgcagatggcccttgccctctcagccttccctggctctctacacatatggtatttataacctttcatacattatctgtagcttctccttcctggtgtacaatcattgacaagacaacatccatgccttagcatctctggggccttgcccagcgtctcggctataggaggttcccagtagacattttgcagaatgggagggaagatggggagaggtgaggatccccaagcagcagacaggtttgagcgccttttgtctgagacactctcccggctttgcctaagtcatcactggctgttaactgggtctaagaaagtggcagagtcaaattgccacagatgattcctcatctgagggagacagtaagaccgggagaggcagatcgctcttctttcttatcctccatgtgcagtagttccctctccccactcatgtcagcaactgaatttagctcatgcgtcaaaagctgtctccccttgagggagtgtcagccagcgctgtaggaggggtcataccacagggaaccctccagaaccaaatcatgtacttttcttctttctcataaaatccagtaaacagttgtttttaattggaaaatatagaaaagaataaatttaaagaagaaaaaaagtcacccataatcccatgacttaggagaagctattttaatttacatataaaatatatttatatataaagcatataatttatatataaatatatttccagtatttgtagctattttatagcacagttgagatcatgctatacatataattttgtatgctggcttgtttatttttgtttttgtttttgagatggagtctcactgtgtcacccaggctggagtacaatggcacaatctcggctcagtgcaacctccgcctcctgtgttcaagcagttctcctgcctcagcctcccaagtagctggggttacaggcacccgccaacacgcctggccaatttttgtattttaagtagagatggggttttgccatgttaggcagactggtcttgaactcctgacctcaggggatccacccacctcagcctcccaaagtgctggggattacagacgtgaaccactgcgtctggccagtttttcttacttatagcatgaacatttcctatgttataagcgttatttgtcagcattatttttaacaactgcatactatttcactatttgtatatacaattattcattcaactaatgaatagcattgtttttaacagctgcatactattccattgtgtgtatatacgattcttcacttaatctacttctcttggatgttttaggctatttctaattttttgttattgtagaataattctgaatatctctgtgtataatattttttcctatattgtgtgtgtgtgttttttttgtttgtttttgtttttgtttttttgagattcccagaagtggaattgctaggccaaaggttgggcagagttttgtttaaaatattttttaactttaaaatttttgtactaagagtcatattttgcagttgttttccgagagggtgagttgacactgcatcccttccccattgcgagtaaggctgctctggggtggataagtgcgtccatgcctaggtctcagaaggcctcctcctctcccttctcccatccctgcttcttgccttgattcttgtctccatgccaggcctgaacctgtgaggggccttttcctcagaaacaaagatttgcctctttattcccccagttcttggcgttttgcccctgagggtccatccactttcagtaatatgtgcttgccacagcgtctatttcttgtctgaggaagaacacacagaaaaggacattcttttaataactagttaatgtgctgtgatctctgcctgaaataacttccccggcctaaggcccggcaacacagagtaataaaatgaacagtaaattggcttggcggctgccctctccaacacaggctgcctctttggagtacagtagctctgtgtccctctggccctggcagcctttcctcctgcctctgctattcttctccctttgctatttctctgcccggcatgcagccttgaatccctccttccttggaccatctggcccctggtcactccttctcgctgcctacttctgtggccccttattctgcaggtagtggaggtgagtagctggctgctccaggggctgaggaaggcctgagtacttccatgggccatgagggaggcctccctggaccttggcagagctgagagagaggctctagtggattggctgtggggcctggggctgcagagctaagctgccccgggctccttggggaggctgggctggtctggagggttgcacggaccttctatcgtgtgacttggactcttgaggcatgagcacttggtagggctgctgggatgggagtccatcgtgagggctactgagctggccctttcagcttctcccacttcaggagactctgcaacctcccaccccaaaggtgccttcgcatttgctgtggccgcaccagctctcatcaccaccctgacatccccaccccaggcattacagcgccactgcgccgggaaagatggttctccagaaagccaaagggatagagtgagagggccaccaccccagtagacccactcactgcaaagtccatcctggcaggcatagcccctgcaccaccttcagccctgtccacccaccaaggccaggggatgtcctttgtctgatagggttctgatctgctgggtctctaaaggggcctgggtgaaaatccacctgcttcttacaaggcctaagtgttacacaaggaagcagaaggccttaggccagaggaactgtgtccgcgtgcctcggcctggcttaggggctgccttgaaagtcaggtgcctggcagtcatcaggaaaaacatttactgggaggagaaagacctttggggaaaggtctccctcccattcccattgacagtgggacgaaggccatggaacacagtccaagtcagcagaatccagctccaccacttcctgcccagggacctggttaggaaggtctgacagaggtcaggccacctcccctttctgacccgcagtttccttatccataagatgcgaatagtaataaccgcctcacagcattactgaccggattcggggtggggagggggaggcagaaccagtttagcaccagctgtgctccaggcaccgcgcatggggctttatcatttcctctcctctctcgagctgactctctaacaggagacttagaggcaggctctcaggaaggtgcgggaaggcccttctccagcacgaaggggagggctggagaaggggcacgtcgctgagctctggggacggtgccgggtagtgccctgggcgggctggcctgtcgcaaggaggctggactgtctggccaccagattctccttcgtgctggaatcccttcatcacatggctgagggtgctttcgacagggccaattatagctgctccagggaacacggagctgactcatgcctcaacttggccgtggagagtctcccatccactttctcgcttgtgtctgtgggatgcgttacagtctccctcaaaccccatgaggccgacagggcaagtattatcatcctggactcagtctgtcctgtctcccctcattcttgtgcatccccgtctctgctgttcccaccctggcctgaattaacttttcttttttcacactgctgtgggaatgttttctcctggcaacagaggcaatctgtatcgcttcccataaagaatcagtgcatgagattcctcaatagatttttcctttctggacacagtggtggctttgttacaggggcacctgctgctgtaagccatacccaaatgtccctgagaatttaccccacccgactgtgctgcctggacttgctggtggcctcattagactcagtgtttccccagacccatgtgtggtcagcaagttttgggtcatgtgggtttagcaggacaaactctaggcccttgcctgaccacctcgggctgcagccctgtaacttccccggaagccaccctgctaggctgggaagacttcactcatctgctgagaacaccacgtccctctcaggggtagaatttgagacgcctgtgtgagaaggatccttcattgctgctgtttggccctgttcattctgggcatttttgaggctgcctcagaatggttcttttcagccctctctatttcagctgtccctggagcctttgatgatccctacttcccgcaatccactgttgctgctcccttgcagagccctgcttagggcttctcatccacacactcactaggtcaggtgcctgggcaggcaaagatagatggggtttcccaatcagggtggaatctttctcatgaagggtaatcttgcccgactgtttgtaaatccaaaagtgtccttttagagcccatggagccagggacctgctctgatcatatgatagcagcagctttgggatgccacaccccagtcactgaggccaagcagggaaccccacagctgatatttacagagatgagtacactcctgcgtttgtgggcctcaaagcctcacctctcctccaaggcctggccctgcctgcctcctgccaaaccatatttctttgtggccttcttgtcccattcatcgttctaaaagggagctcaacccttttggcctgtccctaaagatggctgcatttcctggtcaaggcaggaaaggtgagtgtagtggttaggagcgtgaactcaaatccaagggccaggttcaaatcctaaccctgttactgtttactgagtgcatcacctggggcacctttatctcctcctccttcaaatggaatgataatctaggtaatttaaggtactggttaaatgcttaacttctgcaatgaatttaatccccagaacaccctgtgagataggttttcttattaggtccatttgatgaggaagagcatagtgctgatatcatagtatgtgggaaggtgaaacgagataatccatggaaaatttagaacaacgtccggcacatcgcaggtactcagtcagtctgaacgattacccgccatgttatggagtgaggtactgaggttccctgagttaagtaccccctgaagagcatagccctcaatgttagagaaagcaggttggctggccccaggccactgagattcacagcttctcccaggaggccctgaaggagaaggtattctgagaaggcaggaagtgctagccaagggtgcagctgttaggattcactctcatcacaacctcggtgccagctttcaaagtgatcctctgaccaggggaaatcctgccctctcactctgattattgaactgggatctggagggatgaggggcttcccaagacaacctgaaacccatctgtgccctgtgtggcgggtggcctttggacaggagggctccaactctcagcagatcagcagcttcctccagggctggctgccgaggctcctccttggggacggagcccatagcaacctgactttaactaccatggaactgcagagtaaattcacagctcagaacgctgctcaaaggcacaaatgggatgttgatgagtgggaggaagccctggcaagcctccctggccaccacccctctgtgcagaccaggcctgctgctgcagtccacctgtgcacattacaacatccttcatggttacaaagcatgcacacgttgtggggaggggtgtgtgtgtgggtgttgggtacagaaggaaggcattgacagatagaaggtaactttttgacacctgtttaggtagtgcaggtaaaacaccaaacacatttaaaaacatagcacaattataatctttatctgggaatcccaccatatactattacattcgtaatgaaattgcctaatacccaagggcacaagggaggactcatttgctgaacatacctattttgccaggtactatacaaggcattttgaatgtagtctcttctttgaaagttggaattaaatggataatgacaagaaagatagaatgaaaggtgtgcaggttgcttctatgctaaaaaataagatcaggttgctgggtatggtggctcatgcctgtaatcccagcactttgggataggccgaggcaggtggatcacctgaggtcgggagttcgagaccagcctggccaacatggtgaaaccccgtatctactaaaaatacaaaaaattagccgggcgtggtggcggctgcctgtaatcccagctactcgggaggctgaggcagaagaatcacttgaacctgggaggcggaggttgcagtgagctgagatcatgccattgcactctagcctgggcaacaagagtgaaactccgtctcaaataataaataaataaataaataaataaaatcaggtcaggcacaatgcctcacacctgtaatcccagcactttgagaggccaaggcaggcggatcacctgacgtcagcagctcaagaccagattggccaatatggggaagccccgtctttacaaaaatacaaaaaaattagccaggcatggtggcaggcacctgtaattccagctacttcagaggctgaggcaggagtctcacttgaacctgggaggtggaggttgtggtgagctaagaacacgccactacactccagcctgggcgacggaatgacactccatgtcagcaagataaataaataagatcataaatgtgtagatctgcatgaacacttaataacatagtacttgtgtgcatgggacatttctggaagaatacaggatacaaaatacagatactagagggtaggataggatggagattcatttttctttctttctttctttctttctttctttctttctttctttttttttttttgagacagagtttcgttcttgttgcccaggctgtagtgcaatggtgtgatcttggctcactgcgacctctgcctcccgggttcaaatgattctcctgcctcagcctccctagtagctgggattacaggcacctgccaccatgcccagctaatttttgtatttttagtagagacaggtttcaccatgttggccaggctggtcttgaactcctgaccttgtgatctgcccaccttggcctcccaaagtgctgggattataggcgtgagccaccgcgcctggccagagattcatttttcatagtgtaccttttatattgtttgtattttgtatcatatatgagctatttttatattaaagaactaaccggttaaataaagacctatgaaaacccagcagagtctacggaaggtttagttctaaccatgcctttgtgtgggtacttcagcaggttaccttcagttatggagtctgtaatactctgtgtaagaatcatttcaatccatgctttgtttttgagcccaaaccttgctccttctacccccgcccaccagcccccaaccaattgagaaagggaaaaagataaggaccaaaaaacagaatattttaagttcagctgaaattccacctcctctacaaagttctttggacttgttatccagcaggcatttctcccggccatgagatcttgctgcggtggccctgccctcccctctgactcgcatgttgtctgccttatagtagacatgccgtgttgatctttgcgcagaacgcctgcattaggactgtgcttcttcctgctaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggtgagtgtggagggaacacaacactttcaggtgctctcttttcttcttggggtatggggagtgaaagaacagtaggcagggtcttgggatgcttggtgcctagagtctcctgtcaatctttccatacctagattgtcccttgcttgctgagagtgtaactgagtcagttgtgagatgcagcagctgcaaatgctgggttgattcctccttatcagggagcagggaaggatacaacaatgactcaggtcacattcccctaccctgcacctacccctagtaaaagtggaggaggatgctccatatagttcccagtatttgcctaaatattcagtggctgggatttgcatccaactggaaggaggcagacgaaggttcttttctattcacggatattgtttctacctggtgggaagaaccctggaattaagagggaagccttgggtttgagcactaactcttctactaaattgaatgaccttgcacaggtcacctctcttcccccgggacaagttcagccttgcagataccaagatcatcatgatgatgtgaatggagaaagctctaggaatgcttggcaaactaatctgggccttcacattaattattctgtttaaccagaatgcaggctgatcccctgctcacacttattacactgataaatccagtttcacatgtgcatggtaaatactttgaaaataattttaaaactactttttctaattggaggtttttagagtagaggtaatgaatatgggctttgccttcagatagacctgggttcaaatcctgcctaatactgtggctcttgaacaagttacaaaacttacttgtttctaatttttcccatctgtaaataggataataggagttaaaggagaaataagtgggatagtgaacagaaaacacttcgtgcctggcacatagtaaccaacaggttagttagtgatagtgttactatgtcttatttcatttgattacttaattgtttagtgaatggaataggcatctgctgtggccatttttcattgtagaagttgaggctcattgcccaaaggattctcgatgtctcttatcccaaaatatatatatatatatatatatatattttttttttttttttttttttgatgagatggagtttcactcttgttgcccaagctggagtgcaatggcgcgatctcagctcatcgcaaactctgcctcccaggttcaagcaattctcctgcctcagcctcccgagtagctgggattacaggcatgtgccaccacgcccgactaattttgtgtttttttttttttttttttttttttagtagagacagggtttctccatgtttgtcaggctggtctcgaactcccaacctcaggtgattgacctgcctcagcctcccaaagtgctgggattacaggcgtgagccaccgtgcctggccccaaataatattttttataaacctatgaacttgtctctgacctttcttgtagtggcatggagtcaataacagtctaagacagggacagggagaccacgacatgaatgaaatgtggaactgtgagtggccaaggtgtgcgcccagagtagggagcagaggaagggtcacgctgagaaatcttgggaacttggcctggcagagagagaggcccaggcatggggcttggtttatgttgggaatgaagctgaggtccctttaggaagaatgaggaggtcgtggtggtaaggtgcagtggggcaggtgtcctggagtccaggggtgtctcttatacctggaactgagtaaggaggtcctggatgcccaaaatgctaaaatgcataaatggagggggtgggatgagcatgattcaggagaatgagtcgctggagctgaagagaagcagggatatctgagcaagggggtaggcaaggaatttgattttggacacattgagtttgcagtgttagtgagtcagctgaggagcatcgtcctatctgaaggcagagaggaggagctggaccccaggggagaggagggaaaagccagggggagacaagaggaaactgggctcatcacaagagaagagtacaggtttagtggttaatgccattttgggataattgtgcttataatgatatagtgtattgtattatatgtaatagcatatagcctattatgataacagaatttaagtgattgccatcatatgctgggtgcattcctgagagctgagcgcccttatgtcattaatcaaacccagcaagtctcattaactccattgttaaatgtattgaaaccaggtggtgtgggtgaggttgggtgggggtggtttactttgagtaaagacacctctttgaatattattatcttcatctagaaagtgataaaatgtaaataatccattcctgcaaatgttgtgtgttgtgtgaagaagatctgagagagaaaggaaaaaatatataaatctttacagtggttaccttttttttttttttgagacgaggtcttgctctgtcgcccaggctgaagtgcagtggcatgatctcagctcactttagcctccatctcctgggttcaggcaattttcccgcctcagcctcctgaatagctggggttacaggcatgcgccaccacgcctggctaatttttgtatttttagtagagacagggtttcaccatgttggccaggctggtcacaaactcctggcctcaagtgatccgcccaccttggcctcccaaagtgctgggtttacaggtgtgagcctgtaaccggcctacagtggttccatttaggaagtggaattgagcagggcagaaggatagagaagaggaacaccttcctatttcattttatgccttgctggaccatgttttggttttttgttttgttttgttttttgtttgtttgttttttaccatgtgcatatattttacaaaaaaaaaaattataaagaaaatatataggaaggtgttgtgaaacaaataacatgcacataaaaggtgatactattaaggggtcaggaatctctctctaaatctgtgatttcaatgaataaaatgaaggtgactgaggcaagatcctgcatttccagagtgacttggtgtctggcctggagagcagacattgacaaggaaagaaatgtggccacaggaggggctgtgtctcctgcctccttcccaggtatcttactaagggatagaattcgtgttttatttcaacagacaccaggcccctagcggccttgggctctattctgtgggggaatataaggctgatccagtccagtgggcacaggcttggaaagagccagtgataacccaggcaagaggaagagcaggcctgacgaggcctttgtgggaaagttggcatttgaccctgacattaaatgatgagtgaagtggcaccaacagtgtaaaaaaaagaggacattcccagcagaaaatactgaagagagaaagaggagaaaatatgcatcaccagagaagaatgatgaaagaatgtggcttactgcaggcacctatgaaatcgtgaggttctgagattttctccaggagcacgcagccgctgaagtagtggatgtttaggttggctgggagtctgccaggcatgtccattgaaacgacaacagggaatgatgttgcatccctcttgcatgtgccaccagcttcactgcagtccacacaaggtgctgcaccttagatttgtccgcacaaggtgctgcaccttagatttccaggttcctgtctctatgctgctgagtggtcctatttcacaccccttgtctgctccccttccctcgcttctcttaaataacacttgactgctttcctaatagagatatttggcctttaaatgcccaaataaatgttcctgggtggttcccattcctcgaggccagctccagtgcctcctcctccaggaagccctccctctgcctccaggaagccatctctctgccttgaatcttccaaacactacatctgacttctctcagggtgctggtcccattgcactgtgtattctgcttgtccatgtacaggcctcctggcctcctgtcctgcaccaggctgtgctccttggagacagggatcgaggtttggatatcttagtgtccccaacagcaggagttggcaagcatgaaccatggctgcctcacaatcatccagggagcttcctcaaggcatagagcctgagtgagacccacttctggggctggggctgggattctggcctggctcctgggagtctccattttaagccagccaggcttgtgatcctctggccatagcacccagcctgttatcttgcacagagtagggcctcagttactgttgaatgataccccatttacaaatgaggacataaacagagaagcacagccacttggcccacaaggatcaaatcagaaggaggctccccagaccctgactctgcagtgatggtttgggacagacccttgaagtccctcctgccccgctagtccctaggggctcatttgaagaggagccagggggtcttctcattggctatctaaagaagctaaggttcctagagagggccaagctaagtggagtaactcaaggcaaggaggtagctgaccaaggacaaactaaggacttggggccataagaattaaacccaggctttgatcacacatgaagacccaatgtcgctatggagtagccctgcttgctggtcacacagcattttaccaaacacacccgggtgcagggcgctcttaacactggatgtggggagaggcaagaggactggggttcagccccgggtcagctgtcagccacaccctgaactgggcaagtccatggtgaactaaacccttcaggatgcacctgcagctcacctgagagagacaagacaggtggttggagtcatgcggctaggtcatgaaaggtgggcgagtactcacccaggttacctctgcccatgcaggttcgtgtgtgcccagctacctaaccctgtgctggagagcatcagcgtcatcgacacaccagggatcctctctggggagaagcagaggatcagccggggtaagcaacctgcctgaggggtgttggctgtgggctccatggttctggcacgttcagtctcttacataccagaagagaagcacccagggccatgctgtcccttggtgagccggcacttctcctgtgctgtgtgggatcattttacctggggcagtcctaggccggggttggcaggggtcgggagaggggaattcaggtccaccgtagctcaggagatagctggcctcagtcttctcatctgtaaaatgaagacatcaatatcagtcttacctcgttgggtttattcatgctacaaggggcaccttccatggccctgatcctggcttgcttcttaagttcctggggagcttgcagctctgcagggcagccaaatgcatacagagaaattcagctcaatggtatcagtgccctgggtcataagaggagggaaccaggtagtgaaagcacttcaaaaactgttcactacagataaatacaggataattgctcattaaaggaggttgcctggtatggtggttagaagacagaactctggagtcaggctggcagggttctaagcctgcctctgccacttcatagcacagtgaccctcagcaggtttctttatttcagttactttgtctgaaaaatggtgtggggcggtgggggcgggtggggtgggaatagtattatccatcttacagagttgtttgaagattaaaagaaatgcttaagataaaaagccttttctggttggcacatagcaagtacctagtaaccatgagggattatagatgatcatcatcatcatcgttgttttctttttttttttttttttgagacagagtctcagtctgttgccaggctggagtgcagtggcacgatctcagctcaccgcaacctctgcctcccgggttcaagcgattctcctgcctcagcctcccaagtagctgggattacaggcgtgcaccaccacacccagctaattttttgtatttttagtagagacggagttttaccatgttggccagaatggtctcgatctcctgacctcgtaatccacctaccttggcctcccaaagtgttggggattacaggcgggaaccaccgcacccagcctgttttcttttttctaactctaaaatgctaggcagatgctatcaaaagctaaaaacaactgctctgggcccccacccccagcctgtcctggcacagtttgctgagtgtcctgtatagcccactaccctctctgtgccatgtgttgtatctctggcaagaaaatcagatgacgccatgcccaccccaatattggagctagttgccagggctggagccacatcagcactcagaagtcagcctatgggtaaggaagggctttgaactgctggggttctctgggaagcagctagaactcttgcctgaatggacctaggtaggtgactgtctgcatgtgccttcaccctctgtgctctgtggctctggctgggacacagatctgccctgcccatgtctgtgccacaatagtggggcccagaaacctttgctctttctgcaagagcatggcctgcccaggccagcactgctcaccccagacccctcagaggagaggtcacagcctcatggtgtgacaggccagtgctcctgcagttgtgtattgacgaggcccaagtggtgcaggcccttggcccaggtgcaggccactagtgccagacctgggcttctgtccagtgctcctgtgagctgccttggtgtcctctctgcagaaagcagctctcttctgatgagggcaggtgtgtggtgcagggccaggctcggctctttgaggctacactatgcctgtgtgtgagctgccatggctgggagtggaaagggaagacagtgagagaggccctccaggtcagcagcctgctcaagggccaggttaaccccagtcagccctccagggaagacacagcctggagtcctcatcctgtagcaggtgggagggagtggggaggctgaacatcctgagaggaaagccctgcccttcctccttaccacctcttgctttgcttaggaggtgagacctgggaagaagaggggaaatgaagcaactgagtcaggagggacttgggaaactgtgttagcagttcctgtaattggtggcctgtgaattctgggacatcacagtgtcccctgggaagggggtcttggaagacttgatctcctggctccctatctctgggctgtatggtggaggtgatagggagctggaacccctggcctgggaaaatagggatgtctgagcctccctccttccagccagcacgcacgctgtaagcacctggctccctgttaagggccctgtggagggacagcacgggtggtttttctgtcttgctttggtttgtttgccggagcaccccctttctcctaacccacctattcccaaccccaagtggttcatctggggtttaccctgcgtttaagcctgaaggggatttgctgtttcactcaggcagctcaggactcctccaggaaggctggggaaagccaccccttcccagtgtgaactccctgggggacgtcacatgtgcacctgcaaggccagtgtagcctgaccagcgggtccagagaggactccagcctctgcggtttccaaggacactgtactaggaattcagagttctgggctttagaacctgtgtgtgtctcaacaggtcacattttcagtgtccccatgtgtaacaaggggtaatgatatgtaccacacagccgtcttgtgaggtctatagaccatatgaaaacacgggccatagccctgggtctggatcaccatgagctaccttcctccctccctccctgtcagttggcaccacctatcatacaatcccagagtaatctgtgtgaatagtttcccttgtagttgtgcagtgcacagcctgtgcacctgtatgtggcaggctggttcccagggactcctgccttcctcagttcctatcctattctattcttttcctatttctgtttttgttgttgttgttgttgttgctgttgttgttgttttgagacggagtctcgctctgtcaccaagctggactgcaatggcgtaatctcggctcactgcaacctctgcctcctgagttcaagcgattctcctgcctcagcctcctgagtagctgggacgacaggcatgcgccaccacacccagctaatttttgtatttttagtagagacggggtttcactacctctctcctgcctttgtctttggaccccagtgactgccttaagcaaattaggcccttggtgttcttgcctgcacttcctaatgcctcccatcccacattgactaagcaccaggtccccctacctctgggagaaatgatggccccaggagtggctttgcaggccagtttgttttctgctttcctgagtccagactgtaaatgcagctgctggcaaaagcagcctgcgttaaaaacaagagctagaactgggctgctggcgcctggggcggtgctgacctcagcaccctgaggagaccaggacagttgggggaagggcgtcagacaccctcagttatctgtggtaccccaaacgagtaaagtttccagggtgcagagcccaacccctttctttctcacaattggccttagaacacatagctccagtttaaactgacgcacacctcccccaccctcccccacccatacctccttttacgcacacacccactcccacacccacacatgcatacacactcctcacacatatcctgcatatacacaactcccctcttccccacagcaaccccctcccacacacacacacacacacacacacacacacacaaatgtgtgcatagaacaaaacttgctttctcatggcttcttgcctagggctccaagagctctgggtttggccacagagcagactgggtgcttctcgccttactccagccagcccaggcaaggaccggacacccttcctccctgggatagtcctgccaactatgtcctacacgagggcatctagaacctgaaactcagcccaccttctgctcactgagcctcatacctggcgcagggctgtgtctcaccagataaaaaggggcatggttatcaagtcggcacagaggcccctactggccatattagactgcctgttctgcaaagtgagctgcttcccagggctccaagacctcaggcttcacaggaaggagcactcgggccccaggctggactagggcggcaaagggtcgtccttgctcagggtgtggaccctctactgggcctggggcggggtgtgtcttgtgggaagaaggctggggtgcccgggaagctgattctgggaggtcctgggccagcacttgtctctggatgcagatgcattggggtgggcaggggaggaagacagggaggtggttcctggaagtggcaggatgtgccccagcctggctcattactgggaagaagtgaggatgcagcaggagtgggagggctccagaaggctgagtgtcctgagcttaggaaccacatttcctggctgcttcccagctagaaatccccataggcgccaccttaggaaagcagggcggggctttgtgctcacatcacagactgcacagcttgaagctcctccccacaggcccctttctgcacaggtgagctcagtaaggccagagcaggttgaaaatttgcccggatcacacatctagggaactcgggtcttcctattcctggtccacggcttctcagcacattatcatcacctgccccggaagagcacagggggtaggaatgagggcaaacctctcatctccaggtttcctctaggggtctttagggctcagaccttggcaggtctgggctgatccttgcagcctcacattcctagcccatccagggcaccctcattggagcagagcctgcacttaaaggcctctgggtcttcccagactacgtgccggtacaggcacgcctgtgtgggcgctcctgtgcctgggcagagcagccgagtcctgacgcccttcaaaaggccttgccaaccatctgctcgggccgctctttgccgttacttctgggaagcatctaatgtggcatttcttccccgttgtcagccaaactcttcccacattttggaaattgatgccttgttattcctcttttgctcaaatgcctttaaatcttgacggagatttttttggggagggatggggttttgtatgtacccaccgcaagtaagtgcctggtttgagggctcagcctctgagcttcaggctcacatggctgtgagctgttatagaaagagaatgtgggctgcaagtcaaggagctgggttccaggcctgagtttgccaccacctggctgtgtgagcttgggcaagccccttaatctctttgtgtccagattccctgtcctgtaagatgtgtatgccctacttacctcctgggatacagagaattatgaagagcgaatgaggtcacgtggctggaaacccgaagaagtatgctgccctgtgagggcccaggcactgcatgccagaccatgatggaagccggcgggtgaggaaggggtggctttccttactgtgtttgtctgattgatttcctcttgcctggcattacttcaaagtgctttctttccagtcatctggagcctccggttggaggggaccatagatccctgcaggctgcccagtctccaggcccggagctggctgactagacctcttagagccagcagacttgtgctatgaagtccaggaagggcagcttctctgctctgtctcttggggcttgaatctcccccgactcactagtccatatttcatgaacacttgggctgccgcaggtgcccaagagctaccgttgtgggtctcagagccatcgctgggaccagagaggggaagggggcctgtcactggccatagcactcaccgcagctgctgaggcagtctgtgctgtcagatcttgttgccacagctctaccacagagtcctcattcagctctaccacagacccctcattcagtcatttgttatccctattttgcagctgagaaaattgaggttcagatttgccaaataaatgagaaagctaatcctataccataccctttttcttactgggtccagtccatacctttgagataccgccattcctagatctgcacctaagtccaggccaagtgaacaactaaatatccaccctacagatgacacagcctcggggttagccaggagcagggaagtcgagcttcagagcaacccatggagtcattgcttgatggtcatggtcttcacagccacacctggctggaagcttctggcattactgagtctgtaattggatagcagctttccagagcaaataggaggcctctgcttataaaatcacggaaagagttcccagaagcccttggcctgtcctcaggcagaggcagacttcacacaggcatccccgaggcctgtaagacagcagcctgcagcctctctctcttgctgtgcctgcaaagggtcccttgtagctaatctccatccatcctgttgtactccccaccctcacacctctggtctcagatgcagagaattgtgaaccgagaaaggaagctcggaggttgtccagctcaatcccctgatttgacaggcaaagagacagaggactagagaggggagattcttgcccaaggacacacagtaagttagtggctaagcggaaacgagaggtggactcacccaggccagtgctcctctggtgactcctacagagcacatcccatctcatagaaactagggcttaaaaggagtgctttacaaaaaacagcagggcaatgagaacagccaaggtcacagctcagcagtttcacctgcatcctctgatttgtttagatcctcacaataaccctacgactgagtcactgattcctcaaccataaaactaaggcccagagattactcatttactgtctcccagatgccaaacgtggaacaggtttccacgttttccacgtttcacttccgttcagcaaatactgatagtgcacctgctgtgtgccacacaccgtgctgggtgcaggggaagcccagaagggtgaggtgctgcccctgccctgtccagctcccagtgcaccgaggatgatttcagtgagctgaagagcagaacaggagcgtgcatgatgctacaagaccactgagggcagggacagggataggcaggggtctatcctgttctggcagcatggacatattgctgcccctcagcctttgcagacacagccttctcttacatcgctggtgtcatcagggattgcagcaagttgcagggacagagcctcttcccttctctgcagcttctctggtgtctttgttttccccagcctggtggaggcgtggctacagtgcaagagttgagtttggagttcaggtcttggctctgacccccagcattgcatggccttgggcctttctctcaccctctataaacctccattaccttgtcagcataggactcaacactggctgccctggctgccttagcctgttctgagccattgagccaatatattggggctgagatttgctggacaggtgagagggagctgcagctcagtcttggtcctcccagcagcccctcctgtggcctgcactggcacagctaaaatccagattggggaataaggagcagcagaaggccagaggcctggcagggagttgtggaggggccctactgccctcctgctgtgagctgtttgcagaggtgggggttggggattttcttagccctctggcccctccctacccacagctctgagggactgcctttgggaggtgacagccgccttgccatgcgctgtgctgaagggaagataaaaataggctggagccatccctgggaagggaaggatggacagagggatgtaggaaggaggggagtagtgcgggctgcaggcttcacctgaagtgggaatgcttaggcttcccgggctccagtgaggagctggctgtgcctgcgtgccagggagggagggagggaggcagggagcggccaggtgcagaatggctggatggctgacagctgggtcatctggcctcacgacttgccaactgtttgactctctcctctctgaacctcagtttcctcccctggaagtgagaacgatactcctcgcgctgcctgcctcagagcgtgtcgtgagggtgaaatgagataatgacatgaacatcttaccgtctgcagcaagcactgaacttcgagttggaggctaggggtcgtgtctcatgggtggtattggctgagtcacttaactcctagagtttgcgtgaacatctccgagggagggttgatgatgcccctgcccactgggcagagcagcctctgaagcactttcctgggccttgtctctgagccgagacaggacacctgtgttcaaaagagaaggcaaaatctagttcacaccaggccctcgatgacgcacccatcaggaactatcctcaggatggcacctggagatactgggccagctctgccccttcctgagcctcagtttccctatctgtaaatcaggaagttggaccattgatggctaagctcctcgtagcctcataggtctacgccacaggagcagggggagaaggctcaggtgttagttgagctgtatattcattgagcagctaacagatcttggagaaaatcacatggcaatgggaatgcttggaagcacttcatttaccaaagacagaggagctgaaaatggagtagtactggcatccgggtaaccaaaggagggtttgaccttcctttgtttgttagaattctcttacagccaccagggaaacattacaggggtcctccaggaagctttagggcagcaagttttcccgaccgtctgatcccatccccctaccccctgtggcagtgcctccacacgtcctaaatatgtaccccactgggtgttcactagatgccacagggtgggggaaaggctttttaaacctagctccgttggctccattcatcctcatcccccaccccatcgatgcctgctacttagtctgaaatgacagcctttgaaagtgaaagccaactcggtgcagtggttcatagcactgactccagggctaccttcctggacttgagtcccagcccattgcttaccagctgggtgaccttagacaagttcctttatctgtttgtatctctggttactcctcagagaagtggggctgatattagtgtctaatgaccctacacagagtcatcgtgaggattaaaggaatgaatgattataaagtacttaggtcagtgctgaacaccttttgaatgctattgttatttttatgggccagcggtattcaaagtgtggcccttggaccaacagcatcagaatctcctgggagcttgttagaaatgctctgcgccagacctactgaatcagaaactttggggatagagtccaaccatctgggttttaagaagccctgtgggggattctgatggaggctaagtcaggacccctgttaaagacagtcagagcttcttaagtctgactcactcacaaggcagttgcctgatgatcttgcctggtctctagcctccctctgtgaggcagggcaggctttttcctaatgatttggtttcccattcgatggtggcaatgagctttgggtccccagtgtgtgtcaccttggaacccttgtgctatggggagccaggatggttggtcactttagtacccaagaaagggctcctaccttggtgccagaggtatgccacgggggagtggcaggaggagaggctgagaaccctgctcagactcagaatgggaaagcctaacacctccatcttcatgcgactgctgctgctcatgggctgtgtgcccttcgacaaatcacttgacttctctgagccccacttccttatctcttgtcttcctattttatgtaagaggagcctgagacacagaggtaagacctactggggctctgggtgtcagtgaatgtatagactgttggtccaccctcctacttcagctcctactggatccacagctacttgggattgagcagaacaacttctctggggctcctgtaaccagtctgacctaaagcagcttagtgctagataaccaagatgcgggtggccagagttccagtcacatcctaaggaagaaaccccttgtggtttcaagagttgggaattttgtgctgcagctgattacaaaggaaagagcctgagtgagaacaagatgtttttataacaagaattgcagatttcttccagaccagtgacaggcatggtctgaaccatcatcagtatctactttttagtgtttcattgttttcagaccttagaaagaatttctgggtctttgtgtcagattaggtgtccagactttcttttccagcgggctgctaaatacagtaagcacggataggggagctggtatggaaataatgacgttaataagagttactaggccaggcgcagtggctggctgggggcggtggctcacacctataatcccagcactttgggaggccaaggcaggcgcatcacctgaggtcaggagttcaagactcagcctggctaacatggttaaacctgtctctactaaaaacacaaaaattagacgggcatggtggcgcatgcctgtaatcccagctactcgggaggctgaggcaggaaaatcacttgaccccaggaggcagaggttgcagtgagcagaggcagtgccactacactccagcctgggtgagagagcaagactccgtctcaaaaaaaaaagtaactagcatttactgagcacctactaagtgccggattctaagagtatttaatcttcatagttctattaactaggtattcatattattttagtatttaacagtatttttagacgaaaaaaattctatgagacattgagtaatttgctggagtccaaacagttaaaatgtggaggagccaggatttaaacttagatctgactcccaagactgtgttatttctaccacacccgactgcttctccaaacccctaccctataccccaaaggccccagcccctgattgtccctctgccggcagggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtgaggcagccccctgggaggtgggcagcttgggcaggggcccagagtttggggtcagctgcacgagctgagggttgctgcctccaacagccagtgcatcatgtgtgtgacaccaaggggcaggacagtgcgggagccatggttacaagctctcaggtcagatggccagattggaactgactccattgtttactgtctgtgggattcccagccttggcaaggcctttagtctctctgtgcctctgtttgcatctgtaaaatgaaggggttgttggaggataaagtgaaataaagagtctcaaagccctcatcacagtgtctggcaccttcagagatgctcagcaactgtcagctgctggtattgccttcagcagcagcaacatgaccacctcaccctgccttgaccatagctccccacaacctcaccttgcccacataacatagaaaaacagcccagccctgcaagcaacatggagccatgagggtagaggtagaaattatttcaaaagtaggagcaggaggaggcgggagggatgtaggggaagaaatgatgcaagagccatcctagaaggaagggaccgtccagggtcttgatgtgaaggcttctctctggccctgtttgtcaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggtagcgagggctggggtctctaagacaagggacagtgtcccgagagctggctgagcagcctgagtatggaggaggccactcttggagccccccagggagaaccccgcccagaatctgcaggcaaggaggtggccctggatctacactcctagctgggccatcactggcccaacaggggccatgtctgggcctggggagaaacacggagcccaccgccccagtggtgcaggtgtgttagatgatgctggggggctgacacctccagttaatgaccttctctagtcacagccaccacaggcttgacgtccccaccatctctggtgcagtgggatgggtcacctgaccaaggttctccaggctcttaaagtgctcgagtttacatctgaggtcccccttgtgagcaatctgggacacgagcttcggggaggcagaagtgcacacgggaactcgtcatctttgggtcctattgcaggtgcctatcttgggccagtggccatcacacatggtttcttacggttttccccaaagcactcatcagagggaggtatttttcatctgcctttttacagaagaaacagaggtctcagcattttctgagtgtagcattcacataggccacaagaagaaaagccaggagctgggcccaaaggtccaagcaggaaaccacaacattgactggatcctctgagcctccatttcctcatctgtaaactgaagctacaaaatcacgccttatacaggtgttgtgagcaccagtgagataatctttgcaaagcccttagcacaaagccagacagactatgcccttagtacacagtagcaaatcattaggtgggcagagggaggtgggtgctgagcacaaagcacccacccactgtacaatgtttgcaacttcttatgattctagaattaggaaattagaggccaggcacagtggctcacgcctgtaatcccagcagtttgggaagccgaggcgggcagatcacctgaggccaggagttcgagaccagcctggccaacatggcaaaacttgtaataaaactacaaaaaaattaactgggcatggtggcaagcacctgtaatcccagctactcgggaggctgaggcatgagaatcacttgaacccaggagtcagaggttgcagtgagccaagattgtgccactgcactttagcctgggcaacaaagactccatctcaaaaaataaaaaaattagggaattagaaaaatcaaaaaatagcagccacagaagcacttaatagatgctgttgctcttgttttgatctttagcttgggaatcagtttctcagtttaaatctaggtttttcataacatcactatagtcctcaataggcatttttagtttcctatccggcagaagaaaaagaaaaaaatatacattccaagtatttggaatttgttcatgtgtccattcactcatataaccacctaccacgagccattcactaaccagcattgcttttgttttgcgggtttcccggtccttgacttggagcacttcagctcttcgcttctgcttttgttaagaatttaatgatttgtaagcaaacatttgggaagataacatttgaaagggaccctaagaccccagttttaatgtgaggaattctttcaaaacaaagattctcacctcatttgtttgccagttcaatattctgttctgcagttcaatatgctgaatccacaatgtaaacagctgtcctgtgtgggtgtccatcgtagggtaatgggagcacccaccatgccccctagttgatactgggacccctgcatgggagcccaccaaacatacctagatgtgagcaggctgggagggacaggaggaatgagaggtgggaggaccttgggacgtgatgctctgaggggtgggagatagggccctgtctgctcctcctccaggagtccttcagccctaaggccttcctggctcagcctcaccctaggaaggaggtgagaagtacccaggctaacacttgccctagaaagctgtgggtgttttttgcatttttctgcagcagactagctgtgcttcaccctgtgtactggcctcttcccagcttctggagagttaggtggccagagccagggtaggagcagaaagctgtcaccctatcaccctctacaggccatggagaagttggtgttctagactcgaaaactttcaaaattgcagagacctgcaaagtggaagatatttcttttatggtgtggtgtgggttgtcatgtgaaggcaagaggagctctttcaaaatcggcatgcccacctgcctgcctgtgcctgctgtgtcaaaccctcggggacagtcatgccttgctaatgacagggacacatcctcagtaatgcattgttaggtgattttgtcattgtgtgtgaacaccatagaatgtatatacacaaacctgcatggtagggcctaccacacacctggactatatggtatgatgacctattgcttctaggccacagacctagcatgtgactgtactgaaggctgtaggcaattgtaacaccatgtatttgtgtatctaaacatagaaatggtacagtaaaaatacagtatgaaagataaacagtggtatacttgtacagggcacttaccatgaatggagcttgcagaactggaagttgctttgggtgggccagtgagtgagtggtgagtgagtgtgaaggcctaggacatcactgtacactgctgtagacttctttagaaacactgtacacttaggctacactatatttatttttagaaacattttctttcttcaataataaattaacatttctactttacagactttttttttttttttttttttgatacagagtctcactctgttgctaggctagagtgcagtggcgcgatctcggctcactgcaacctccaactctgggttcaagcgattctcctcagcctcccgagtagctgggaccacaggcatgtgccaccatgcccagctaaattttttttgtaattttagtagagacggggttttcaccatgttggccaggatggtctcgatctcttgacctcgtgatccgcctgcctcagcctcccaaagtgctgggattacaggcatgagccaccgcgcctagcctacaaactttttgactcttgttgtaacaattagcttaaaatgtacattgtatatctatacacaaatattttctttatatccttattctataagttttttctatttaaaaaaatttattttttacttttttatttttgtgtgtgctaaaaactaagatgcaaacacccatgctagtctaggcctacacagggtcagcatcatcagtttcgctgtcttcacctccacatcttgtcccactggaaggtcttgagagatagtaatacacatggaggtgtcatctcctgtaataacaatgccttcttctggaattcctcctgaagggcctgcctgaggttgttttactgttaacattttttttaaataagtagaaagaatacactctaaaataacaataaaaagtacagtatagtaaatatttacataaaccagtaacatagccgttatcattatccggtattatgtactctatggaaatgtgtgtgctagatttttataccactggcagcacagtaggtttgtttacaccagcatcaccacaaacacataatgcgttgtgttatgtacagtagctacaatgtcaccaggcaacaggaatttcccagctcccttattgtcttctgggaccctcgtcatacgtgtggtccctcattgactgaaacattgtaatgcagcacatgactgtattttgaaaactctcctcaggtgactccgatgagcatcctgattaagaaccataatttggggatgacctttggcttctgttatgatttggttttagtaccctgtgccctgtttggtttttgtttttgttttcactaagtggggatagaatgtgattttcctacctcagaagggcgctgggggagtgaacgaggtaatgtagtgaaggcacttgcggtgattttcaagtacagtataacccttattaaagtagaggcccacatgacccagtctcagaggtacagcattcaagagacatgattcaatagccaaaactgacttaaagagaaatgtaatgatttcctctctggaatgacattgaaggggattgaaataaatagatcatgccaatacttgttaaatttccctttcttccccagcccctacaacccttctaccccctactgaaaaatcccatcatcagcccagtgggcctttattcccctcctctctcataccttcgattaccacgtgatgtccatcagctgagcctctaggtcacaggtctttcattgtagaaagggatcagctgtgaacattctggtgttcataggaggcacgtgataaatggagggctctcctttcatcgtatcctatcttcatcctctctcctcctcttcccaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccacgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtgggccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggtacctgcctggccacagagcatcattcaatggaggctgagggagaagggctgggttcttacttggagttcctggtgaaatctttggctggaaagggctcactggggccacccaatggccagcatccacaaccagcttcccagtgggctggagtttgtctaggctcagtgaccaacccaggcacagctggtggagccaccgctccctgctcctctggagtgaagatgttccctaagcccctgggcttccttctgcaaatacacatttctctttcacatgaaatgaagggcagacaaaggccaggcaaagaggtctcacctgctctggagaaaacccttgagtgccgagtgcaggttagggaccatttctcagctccacacctttcttcaagctgaaggagaaatgggaaggaaatagcagaggtaggtgaagttcctgtctttttattttataggaaagggagatgtctgttatcccctttcttcactgccactggacacacatgccactttcctgcccttctacatatgctgcctctcttccctctctccatcttgaagtctccacccaggagagacctgtgaggtgtgggaattccatgtttgcacagctcccatctccctggaaagaggaactgatgtttgaggggacagatgtgggtcactttccctggcagtgccctctagccttgctgccttggctttctgaccccttccaggcttcaggggcctgggagatctcatgcctcagcccaggaaacatttaatagggaaagcagagacatgtcatgtcagccccacagacaagaatttctagagcacttgtcctgttgttccttgccccgacattactcagtctgggccatggaatccatccaataaacacagcaacaccctatgctactgaccaagcaaagcttgcccctggtaccaaagagctaaatcatgaccaaagtgtgacatgaatgtaactgaaatgcgggttagttgctcaatgtatgcaaagtcccacggacaagagtaaagtctgataccaataaagtgaatgtattccaaagctagcttggaggaggggcacacaacgtcctgcctttcaatgtgccgcttcccctttggagcagaaagcaggcacttttataaggtaagggagcaagtgagcaagggtccgcctgatagcatggtgccttatctactggacagttgagtcgggccttcctgggcaaaaataaattttaaaagtggccaagtaggcatactttagatataacctcctagtgaatgaaagtcctgaggcagcccctggagggtgggagttccaaggcaacccctggaggtgaaagctcaaggagggcatgttttggtctgcaaattggcagtcaattctggaggactattttggagcagagagatgaacttgccctgtagggaatgtctagtgaaggggagatgaaagcttatatttgcatttccctttttttgagacagtctcactctgtcgcacaggctggagtgcagtggcatgatcccagctcactgccacctctgcctcccaggttcaagccattcttgtgcctcagcctcccaagtagctgggactacaggtactccaccaccacgcctggctaattttttttttttttttttttttttacttttagtgaaaacagggtttcaccatgttggccaggctggtcttgaatttctgacctcaagtgatctgtccacctcagcctcccaaagtgctgggattacaggcataggcgagagccactgcgccaggcctatatttgcatttctaaagggctacctaggaagttgggaatccaggaaatggaaaaaagaagagaggaagaaaaaaacagctcttagaaaactggggtgctcatttacatgaatatttccagatgacaccactgaaccatagcagggcatgggccttggtttgcagagtgatgagtggttgccctgagtcatccccacttccatttggttccaaaacctgta

SEQ ID NO: 13312 - DNA, 60417 bp, Human
agaggaagaaattgagacagaagacatttcatttaaaaaaatattccattgagctgggtttgaaatagtgcactgcctgttctcctaatgctgtatggtatcatgaaatctattgtttactgagtctatgagccagcttcctagggaggctatggcaattgaggacagggaagaggtaacactcaggaacatagaaggagaatttgggtccaagtgggtggagggaaaaataactgggtttagttttgggtagggctggttttgaggtctctgaaggacatgtaagtggagttttccagcagggagaaaacgcagagctaaagctcatatctttgctggcaatctagatttgggcatcttcaacaagcaggttgtagctgaggaagctgggactggacttgtactctaaagccagtgcaaaaaaagcttgaaacggctatgatggctaagacctggcttttccatgaaaaatgcttcggtcagtatgagtgattccaaagtggtgatcaattaaaaactgaagtatgattagcattaattataacccaatgggaatatgataaacgactcttggtcagcaagcagagggtgccctgtagtgctaaagcatcaccatataccatgtgtgccaagaatcaggagacaccccaaacgggagcagatgaggggttgtgtctgtcattggaccagctggcctgatccagcagaagtggatggagatacactgaatggggctcctgggaggcgtgagttgaaggggaaggaagagaagagacctccaaagtaagggaagagtgaaaaatgagaaggactggggtggagccccaagtagggaccagaggagaaaacagggataaagtaatcaagggagatgggacaggaagatgaaagaatgaggtaaacagcaggtgggaagaggaggtcaacctaaaggagaaagccgggtcgaagaaagaaggaagagaagaaaagaagggttgggaaacagaggaggaggcagccaagaaagcctggaagctgaatcatagaacggaagaggtagaagacggaggggctggaggataacataaaggtgggaaacggaagagagaaagaaccgcgtctgcgtgtatgacggctagacaggagttcagagaacagcggggtcgccaggccaccacctgatgggccacggctcattggctctaggagctgggaaagggcatcccaggaaagaagccctagactttagcctgagtctgggccactctaggggaccgggagtggggtggcgggagaggacgcgcagaatctcgacttctggccccaatctgtgcatgatcacccgagctcagcggacgctcctctctgacccaggcaggcggctcagggacgcgtgcggggatgcagagagaaaccgctgaggaattagggccgggagagactggtacctgccgggggcgtgtggtggggcagagctggcactgatgctgagagtggctaaggagcgcggcgccccagagcagaagggctggcagacgctcagagagccaggatggttcagggtccaaggaaggtcctatgttgggtgggagctgtgagggagtgaaagtgcatgaggaaccggaggagatggaaagaccttggcttgggtgttcgagggtgggactgcgtggtgaccgacggcacagagggtgtgtgttggggcggaagaaccaccccagctgaatcgtccccgtggggttttcttcccgtgtcttagttccagaagttgccgcatcagacgctaatagttgaggaacaagtcatggaaggacagcctaagcgggaggtgaatgtaaagccgtggagagggcgggcgaactaagaaggccttcgttctcctccggccaccgcggctgcatccttgagaaaggggtattgctgcgaagccgcgccagggctggacgcggcgaggtgggaggcaggatggaggggcgggagccaaggccgagggggcggacacgggtggcgtctggcgctccataaaggggttgcgggggccgcgctctcttctgggagggcagcggccaccggcgaggaacacggcgcgatgcaggttcagtgccagcagagcccagtgctggcaggcagcgccactttggtcgcccttggggcactggccttgtacgtcgcgaagccctccggctacgggaagcacacggagagcctgaagccggcggctacccgcctgccagcccgcgccgcctggttcctgcaggagctgccttccttcgcggtgcccgcggggatcctcgcccggcagcccctctccctcttcgggccacctgggacggtacttctgggcctcttctgcgtacattacttccacaggtagcgtttttcccttgcgggcgcccagtgcagcgcactgccctgctcccggcgtccaggagcgcagcgtggagcgcgcaccgaggaacgccaaggaggcagcgtggggcgctgtgaggaacgcggaggccagcctgcctggcgcacctggcgggggccggggccggggcttggacgctagagagttgacaagcggctgcggcacagacgccgccttcactcccccaggacctcatccgctctcagcagctccaaatcctctggctgctcgagagaaagaggtcctgcgggcgggaggcgacctggaaagctcaggttggggagacctattggacaggactgttccttaactgcgcgcaggcggcggttacctgtggcatatcgcgccccgccccgcttccctttcttccttcaccttttccttgcagggtggggacagattagttctgggatcttgggagagtcttacgcgtttggcatctcccgagggaaactcagctcagaggttctcattgatttagtctttgcaggtctaaggaggaaggtgggtagagcccaaatccagacttcacagatggggaagagaatatagtgagatcccactgactcaagcgagggtccccgcttcttaggcccctcccaaaagggaccaagcacaccaccaattcatctacctttccaatttccctgggacttgaaatgtgagtgggtaacttacagctcaaatgttcttctagatttaaaaaatccgggttcaggagaactttgctttctgctctgggaaggaaagacaggaaagagaccaagggatgtcagggttcagagaaagactgtccagcctcagtaaagtctcacagggaaagggaagaacgaacacattgttaaattgcctaccatgcccaatcgtttagtatctatggtctcacttaactctgttgtaaccttttgagagatatttattatgtccactttacaaagaaactgaggctgagtaaggttatgggactgaaagaagacaatacagctggtgcccgctaagatgcaaatctgagcttgtgaatctctgaggtttaagaccttttagccgttttaagtaggcagatattctatgcaagaagagaacagagcccataaacagagaaaagttatcaaacgaaatcaaaaccttgaaggttttgccttattttgagtagaagattcctagggtcaaaagatcaaggaagtttggattagaaattaggataaagaatgcctctggcataatctgtctcgtaaagagaaagtgatgcctcatttcgagagaagaaggtgtcagagacggatttcaaactgtctttcttaatttcctcttatcctctgaatcttctttattggtcaagatttaatatttatgcaatcttaactgaattctcactctttttaaaaggcaaatgttgtcaagtaataagaactaaactgtatcctttcaacaaatatttactaaaagcctgctgtgaacaagattctttattttacacagattttattttactcagatttagatggtttaatttgcacagaaagaaggatgttggatacaggagataagagattagttttttatttcactgatttttgaacagacatttgacagaaatgtgatttttgtcaacaattatttttatcttcaaattaactactgtatgttggcaacataagcaatatttttatgaggtcatttcatcttaatgattagtgttttgtgacaatcctattaatgtaatctttaggcttgtttttgaaatcaaaaggcactttgcacaatacattatgaccggtgcatttaaaaaaaaacccaaaggagtaattatgcataaaacaaatatctacatattgtccttcttcagaggaaattttaaaatattagtaaaggacttggagattcattctgcctgagggaaaattgcccactggaagtacaactcttgagctacttgttcctgaggcatcgggatctgatgtttgtctttcctcttttttgaattctttctttgaagccactggagtgtgtgatctgttattatttgagtgcttacagggtgttacactctgtgtgccaaacactctgagtaaataatttactcatcctcataccaacccatttaggtaggcacgcccattttgcaggtggaaaactggagcaagaaaaggttaaataacttccttgcccaaggtcacacaataacgaggaatcagagttcaaacccaggcagtatgactccagatctcaggctcttcaggtatgatagtaaactgttgtatacttgttggataaatgcgacctcattcttgctttttaaaaactatatttattcttaaaattattatgtaaaaattttttaaattataaaaacattttttcctaatgaaaaatggaaaaatcccaaaagtagaaaatactcataattacatctaagtatattaaatattaatgttttagagaatttctatcaaatctttttccttagtagattttcacacatgcttgttatgttgaatatatggttttttagttctgtttaattacctaacattttatagtattttccaacattatcacagatttcttaatatctgcttatttcatctactgtaaaaataataatttacctatatattcatttatagctggacatttaatttgtcttggggtgaggctaggttcattgaagctgtgatgtacattttttgcatctaaattcttttcaaaggttagatctattttcttaggatttccagaagtggttcaaaggttatgaacattctttagggtcttgatataatcatacatatctgtttcgaggcttaaggagtcatttggcttgatactgagggtgcattaaggaacaagcatcaggctgtcttggctttatctcgtgctgtgtgttgctaagacagagaataagacggagagacagggagaaaggatggctcaggtttggctcagactcttttgcaaaatgtccattggggactgttcaaagcagcaatatgtcccatcaaatagaagttaaaactcattgtacttttctcaatacaaggatggcacacaagaatgtagattccacagggtcaaaggtttttgtctcacttttatggctgtatccccattgtatacaaagagctggtacatagttggtactcactagaatttgttgaatgcatgaatgaactctacttacaacaaccgtacagacagaattgtaggagagctagcaattacttgggaatcataattgctgagattgcatagttaggtcaattcagataactttcctctcttcagaatctattgttgtggctgtttggattctttagccacatggaaatgactgctgcctaagcacattgcctaatcccactgccaaagtcatttgaagtcaagagttatctcacctcttttttttttttttttttttttttaatgtttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggggtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtattgggatggctgggtcaaatggtatttctagttctagatccctgaggaatcgccacactgacttccacaatggttgaactagtttacagtcccaccaacagtgtaaaagtgttcctatttctccacatcctctccagcacctgttatttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttcgtgttttggacatgaagtccttgcccacgcctatgtcctgaatggtaatgcctaggttttcttctagggtttttatggttttaggtctaacgtttaaatctttaatccatccatctcacctcttgttgactgtgattacagctgtggaatgaccccttgtctaaactctctgattggtcttcactttcccaagaagtcttggtgttccatacagtggtcagtcacatcacttatgcatgtggtggctgatgtctttttcaagactttgatgggaccttgataactgaatgaacaagacaaagaaacatttttttttccagagaagaagtgactacattgtgaaaaggttttgggcaatgtaatttccatgatatacatctagaagcagagtataatgcacacattagagtctgtttgaattcggagagatattccttgaggtttagatgctgaaacatttttttgattagccaaataaaatgatggcttcaataaggtgctttttgctttattagtcagttcattccccagcggaatttctcctcatccttcaagattcaggtcaggcatcctttcctccaagaagccttgtctgagtcttttcttttctctaaatccagttgtgatgctgttctttgggctttcataataggcagtgtggctttcgatgaggcatttcacacactggatcataattatctgttctaaggaaacgtagttctcatctgcccagcctcttcattttacagaagcaaagcacaaaaggttgggtcagttagggggaaatcaaagagttggaacttgagtcttctcatgagcccctgccaatgcttctcttatttcacgagaggtgcagatgtctcaactattcagaagtaatcagaccttgctaaggaaactactcatctgctgagaatcagaatgagaattaatggctactttggaaacaatagacaaatctctcctcttagagattaagaaaaaaaaagcccaagcaagataagcaacattcctgtgatcacttaatcatgtgttaaggatgttcctgaatcataatttaaataaattaagattaattgaaggatttttttagaatgagagtcagcaaactttttctgtaaaaagccaggtcatgatctctattgcagcaactcacccctactgttatagcgggaaagcagctacagacattatgtaaacagatgaatgtggttgtattccaataaagctttatttacaaaaacaagcagtgggccatatttggcctatgggccatagtttaccaatcccttctaaagaaaactatgaatggcgtggctttacattcagtgccctggtaattctataataaaatttggttaaattctatagcaaagcagcgggcatatcttagaaaatttctgctacatgtaagtggggacttggcagtaaatattgttttctgagaattcttgggttctaagtttttatttgaacttttatgggaaaatagtaggagtcttggagttttcattctaaatggaatgacatcataagcacatctgaaaaatatatagctatgtttgccaaaaatataaaccagctttggagatcgtgaccacttcacttttaccacactgaagaaaggaccaactttttgtccatttaaaatctaatttaatgtcacttaaaaagaacaaacaaaataaagaattacgatgggaattcaaggattcagactggcaaagtgacatgtaccaagttacatggcaagaaagggcagagtggagcttgaagcctggtctcctgatctttatcagagttctataggctcagaactatgctaggtctcatgggagtcataggagtacaatacctagtgcttgccctctaggaagaaggcaggaaagaaccttcattgtgtgcttctcactctttctggtgtgaaacttgggtggcagcaacgtcagtctgacaatatcaggcaggtgggaaaatgtaaactgagggggaaagaagcctggttagcacgggcccccgccaggccactgaacattcatctgagagggccctagtgcctgtctatgtttgattgtgcatgggacagggggcagatagataggtggataggtgttgagggggcctcaaaatggcacccttcttctccattcaagttcagaactaactgagagatccaggaattaggtaactagagacatattaccaccttttattactggtaaagctggtttgggggaatgtggcttagatttttggattatatgggccttataacacagtacctcagaaataattagctatgatcatggctgggcaaccacaggcctctcacagtggtacctgttctgaaaagacagcagaagggctgagctgtacgcatcctttggcaggtcctgctcccagattgacccatcaggtaattcacatttccttgcctgaggaggaatgggtgagggacagtggaagggcttgcagtgatgctctaatgaagggccctcagccagctgtagggggagcataaatattttttgttactagatggaatacaaacgttgtctacttattgaattttgccacagcctggcaacttgtttctgcaacttggggtacttcccgttctgctgttgactccctgccatgtatggcaatggggacatcaaagtctggactcaagttgttttaaaagtttctgtgctcaacccaggagcctttaacgagactcagctcaacataggagctctaaattttaaaaacccctgaactagggccaacagtgcaatttgtcttccatttggttatagaagggagagaagggaaaccaatatttattgcgctctgggtgttccaggcattatattatgttctttgcattggctatctcattttgtccttgaggcaatccctgttattagtgctattttacaagtgattgcagtgcagagcattgatggagtgagtgggagtgaagatgggagacttgacctggtccttgaagaatggcctgttcccagatttctgggtggggacatgatgtctgttgggaaaaggggcccatttggtgatctgtgacttaaatttgccttatactttgtatactcagtcttggagtatctctctacttttagattccaaacatcttctgtaactatgccatattatccagtcctactacccaagtcttaaattaggctctgggcctctttcaatttcttttttttaatatttgctccatattgttaaggctgatcctagaagttactgtgaagaaaacagggtaatttggttttgatattttttctttctaaccacgaaacatcccaagatcttttttcatgtatagactctggttctctcttgcctctctgcctgccctcttgtatcagcagtacatgatcttacttctatcttttaaaacttaactctgtgtctcatgctgtcagtcaatgccctttacttgccaaaagttactcatgtgataaacaaatctaagttctagtgtattgggttgtttgttttcttattattgagttttaaaagttgtttatgtattctggatagaagtattttgccaggtataaacttagcaaatattttctctcagtttgtgacttgtctcttttattctcttaactgtcttttgttttaaaaaaattatttttaggttcaagtttacatatgcagttctgttatacaggtaaactacatgtctcaggggtttggtgtacagattatttcatcaccccagtaataagcatactacccgataggtattttttcaatcatcaccctccttccatcctccaccctcaagtagaccccagtgctgttgttctcttagtatccatatgtacttggtgtttagctcccatttataagtgaggatatgcagttggttttcagtttctatgttagttagctgaggataatggcctgcaaaggacatgatctcattatttttcatggctgcataatattccatggtgtatatatgccacattttctttatccagtccaccattgatggatatttaggttgatttcatgtctttgctgttgtgaatactgctgcaatgagcatgcacatgcatgtgtctttatggtagaacaatatatattcctttggggatatacccaataatgggattgctgagttcaatggtgattctgttttaaattatttgagaaattcctcctagcagtgtataggcgttcccttttctccataaccttgccagcatttattatttttgactttttaatagtagctattctgattgatgtgagatgatattttatggtggttttgatttgcatttctctaatgattagtgatgccgagcattttttcatatccttgttggccacatatatcttgttttgaaaagtatctgttgatgtcctttgcccacttttaattgaattgtttggtttttgcttgtaaattagtttaaattccttatagatgctggatattagacctttgtcagatgcacagtttgcagatattttttcccattctgtaagttgcatgtttactctcttgatagttttttttcctgtgcagaagctctttagtttaattaggtcctatttgtcaatttttggttacgttgcaattgcttttggtgtctttgtcatgaggtctttgccagatcctatgtccagaatggcattttctaggttttcttctagggtgtttatggttttaggttttgcatttaagtctttaattcatcttgagttgatttttgtatgtggtgtaaggtagtggtccagttccaattttctgcatatggctagtcagttatcccagctccattttgaatagggagtcctttccctgttacttgcttttgtcaactgtattaaatatcagatggttgtaggtatgcagcattgtttctgggcactctatcctgttccattggtctatatgtctgtttttgtaccagtgccacgctgttttggttactgtagccttgtagtgtagtttgaagtcaggtaatgtggtgcctccagctttgttcttttttcttaggattgcctggttatcccagctcttttttgattccatatgaattttaaaatagtttttttctaattctgtgaagaatgtcatcagtagtttgataggaatagcatttaatctgtaaatcgctttggcagtatggccattttaacaatattgattctttctatccatgagcatggaatgtttttctgtttgtgtcatctctgatttctttcagcagtgttttgtcattctcattgtagagatcttttacctctctggttagttgtattcctaggtattttattctctttgctgcaatcatgaatgggattgcattcttgatttggctgtcagtttggatgttgttggtgtataggaatgctagtaatttttgtacattgattttgtatcctgaaactttactgaagttgtttatcagaccaagaagcttttgggaagagactatggggtgttccaggtatagaatcacatcatctgcaaacaggaatagtttaacctcttctcttcctatttgtatgccttttatttctttctcttacctgattgctctggccaggatttccagtactatgttgaaaaggagtggtgagagagggtatccttatcttgttctagttttcaaggggaatgcttccagcttttgcctattcagtatgatgttagctgtgggtttgtcattgatggctcttgttattttgaattatgtttctttaatgcctcatttgttgagggtttttaacatgatgaggtgtttagttgtattgaaagccttttctgaatctattaagataatcatgtagtttttgtttttagttctgcttatgtaaatcacatttactgatttgcatatgttgactcaaccttgtatcccagggataaagcctgcttgatcctggtggattagctttttgatgtcctaccagattaagtttgccagtgttttgttagggatttttgccctgatgttcatcagggatattggcctgaagttttctttttctgttgtgtctctgtgaggttttggtatgaggatgattctggcctcatagaatgagttggggaggagtccctcttcctcaattttttggagtagtttaagtaggagtggtaccagctcttctttacacatctggtgtaatttgtcttaactgtcttttgaaaaacagaaatgtttaattttgatgaagtctaatttttccatttttctttggcttttgatgtgatatctaaaaaatttttgcctaatctaaggtcacagtgattttctcttatatttccttctacaagatttgtagttttaggttttaatttcaggtctatgacacattttgaattaatttttaaagtaggtttccaagtttgaatcaaagtttttttgttgtgtttttttttttttgttttttgttttttgcatgtggacagtcaattgttttagtaccatttgttgaaaatactactttttgtccaatgaactgcctttgcaccttaactttaaaaataggagaattatatgaacagatactttgccaaagaaaacgtatgattggcaaacaagaacatgaaaggatgctcattattagtgattagggaaatgcaaattaaaccacaatggggtatcactatgtgtctgatagaatggctcaaataaaaaatactgaccataccaagtgtttgtgaggatgtggaagagctggaactctcatacctttgatgggaatttaaatgacaaccactttggaaaatggtttgatagtttcttaaaaagtgaaacatatacctatcatataatgtagccattgcatttctggttatttttctaagaaaaataaaagcatgtgttcatacaaatggtggtagcagcagcctgactggagtggctgcagtgttagaggcatggctggggctgcgcactccacagagctggcacggccaggaacaggcatgagccccatcccctaccaagttggtggggcagaaggccagtgctccttggcgcagctgcagccacccagccatggctctggacccgggcttccctgtgctctcaggggcctgggaagcgcccctgcccctgaaggcttggaagtacctgctcccgctccttggcctcttcccactctaggcacctgctctggggtggaacaaagttgtggctgagccaaggtgctgttgctcggcctggcatgtgcaagctcagggcggcattgacacaccagccccctgccgccttggccccctccagactttgggtgctgatgagcatgggaggaggggcaagtgggggctgagggtggcttagtgcaggcttgcaagcaccccttggcactaacagcctgggcaccatggatggcatgtggatggtggcaggaggcagacaggctcctgggtggaaaggggcaggtctcgggtgaaaccccaccttcaagccagggatggcctgaagcctgggtgctgggctgtcaattctggatggagtcagtggcccagagtgacaatttatggtgctttttctgaacctgctcatggtggcccatggaccaatcagcacgcccttccttctgaggctataaaaactctggactcatccagacttgggcagacatcaggactaccagctgtgggaaggaactgcccactttgggtctcccgagagcctctctgtcactcactgaagctcctctctgccttgctcatcctccagttgtttgcgtacctcattgttcccggacacgggacaagaaatcaggacctgctgaatgcggggactgaaagagctgtaacacaaacaggtctgaaacatgcccccctgcttgtcacattgcaggcaacaagaaggagagaagagctgggacccttcggggagcccagaactaggggagccctgagccagggctatgacaccctctttggggctttgtggttcctggcatctccaagcttccaggcaccaccatgttcccttcatccagatgtgggtgcccacagtggaagccacttggggtacatctggtccaaccatagcctcacatggagccggcacttatgctgtcatctggagctgcttgccttgcccagcaaccagtgtgcctggctgtgcacagtggctggaccctgcgctcactcacacacacacccctcatcattctgtgcctggctcacccttggcaggtgtgggatccaggcctgtagcatgagccaagtgcagcctgccaggctgagtggacagattgagctcagtgggcatgagcaatactcaggcagaaggcactactggccacagaggtttccagctggtgaagtgacaccccaaggatctcgtgacacaaagacttgtatacaaatgtttgtagtagctttatttgtacaagccaaaaactaggagtacatgctttatgattatgtttatataaaattctatgaaatttaaactaatctatggtgacacaaagtacatcagtggtttcctgaggacacaagagggacaagaaggtagaactacaaagggtatgaagaaccttttgttgtgatggatgtgttcattatttttatgtcacatggcttcatgtgacatgaaatatatctaccaaactgcactggtagatatatatatatatatacacacacacacacacacacacaccaaattgcaccctttaaataggttcagttgactgaatagtaatttacttcaataaaaataagaaaactaggtaggcctgtgaaaaaattatatgtatatgtggccctgtgtcactgagaattgttcaaagtttctgtgaagttcatctggaaatgttcaacaagtgctgataagctgtttcacttttttgaggtgtgagtagaggagggccaggaattctactcaagggaaataatccaaaaggaagaaatcagtctacacaaagttatagtgttactattcacaactgtgaaacactggaagttacctaaatgctctacaattggggattgattgtaatcaatatgattaaattaccatatatatttcaaaaatattagttgcatggactatatctgtgtatggaaataaatatatggagccatttagttaaaaagtagcacataaagagtacactctgatttaatccatgttgacatgtacaaatgaaaattgaccatgattggaatataaagtgatgtaaatagctgataatttaggtttgtattttttccttttagtattattaaagtatttaattatttaactcctattataccttatagaagaaataatactgtattacaaaattttaagatgtattttacaaactgaccatgcaattaaatctcagcagagatatgacaccccataagtagttactgttctgaaggattttaaaagtcacacttcgtgtgtgagatctcccccactgagctgctatgacacaacccacttatgaaattgtcatctttctatttctcctttgtatcaagatgttgatgatcccttaacatgcaatcatgttacctggcaaagtagcacttggcaaagtccaaactattatccttttaatattttgaatctgagaggatctcatctctttcatccttaatcatggtaatttatattttccactttttttccagatctttttgactagagctttagaaattgtattgatcatctcagaactagatttttatttcattgagtttcactattgattttgttttacatttaattgttttctgttttgatctttattatgttttttcttatgcttactttgaattttatttgctctcctttttctatttttattaaggtggaagccaaggttataaatggagactttctctttcttctaatatgagcatttattgctttgaatttcatcctacatattgttttgtggcacctcacaaattccgacatgttgttaccattttaatttatttcatgtattttaatttctcctttgatttattctcatatctatgggttatttagaagggtgttatttagtttccaaatgtttaggaattttccagacatgttctgtattcatttctaatttaattccactgtggatagagagcatactttgtatgacatacatccttttaaacttactgaatttaaaacttgttttatggcccagaattgggtctatcaatcgtaataattgttctgtgtaaacatgaaaagaatgtgtatactgccaagaagaggagtgttctaaaattgtccataggttattttgattgttagtgtgcttcaaatttctatatcctgatgattttctctctacctattctaccagttattgagagaagagtattgagatatctgatcaaaattgtagacttgcttttttttcttacagctctatcagtttttgcttcatgtattttgaaggtctattattacatgcatagagacagaactggtatgtcctcttgatgaattgatgcttttatcgtgatgaaacaatcttctttattcttggtaatatcttgctttgaaatctacttttgtcttatattaacttagccactacagatttctttttactagggttaacatggtatatgtatctaccatgtttattccaacattttacttttaatctgtttctgtctttagatttaatgtgtgtgtctcaaaggtggcatactgttcaatttttctttccccctgcccctgccattctgacaatctctgatttttaactgggatattagaatgtttatatttaatgagattatttatacagtttgaattatgtctatcatcttgctatttgtttccatttgtgtctctgttatttgttcctatttcctatttatattccatcttttggatttagtattattttatttcaatttatattgtcagtttattcattataactcttttgttaatttgcttaaaggtttattgcatgtatcttaaatttatcagtcttccttaaggtgatattataccacttcaagtatggtataaaaatctgaaataatgtacttccatttcttctctcttgcccttatgttattgttgttgttttacttacatatgtgctataaaagcctcaacttattactattatttttgtttaaatcgtcaattatcttttaaacagttttaaataagataataaaaaagttatatatttgcttatgtggttgccatatttgatgcttttcatttttgagggttgatttatatttctatgtggtatcattttttccttttacctgaaatcagaatttatatttctgaaagtgtttttatttcttgttttcgaagatagaaaattctaggatatagcaatccagattgacagctgctttctttcattactttaaagatgtttcactgtcgtcttgtttgcattatttccaacaagaaatctgttcttgcccttatccttgtcctctgtacttaacgtatcttcttatctttgcctacttttaatattttcatgttatcactggatttgagatgttgggttactatattccttggtgtatttatatttcttattctgggcttccttaaacttgaatccatgagcttgagtctttcatcaaaattggacgattttcatacactattcttcattccctccctacttctcctttcttttgctgaggaaaatatctatgagacctacatgtatattaaactgtcctacaactcactgatgctcttttcatttttgtggattcttttttttttctgtgtgcttcttttgggtaatttctattgctattcttcaagttcataatcttttcttctacaatgtcttatctgttgctaatcccatctctggtatttttatctcagggattgtagtttccatctctagaattttggatttcggtctttttttctctcttccatgtccctacttaattttgtgaacacatggaatgcagttataacagctgttttaatatcattgctaacctaatatctgtgtcatttcggtgtcagttttgactgattaattatttttcctataataagcagtgttttcctccctttttgcatgcctggtaatctttgattggagggtcagaaaattgtacctcattgggtgttggatatttttgtgtttctataaatattcttgagctttgttctgggatgaagttaagttacttggaaacaatttgatcatttcaggttttgatctgatttgttcagtggttccagaagagtgttaatgctagggctaattaataatttcctctgaggtaaagcctttttgagtattctacccaatgtcttatatgagcttttctatctggcttatgggtacaggctctatttgtggccatgtgtgatcactggatactgttccctttaattcttttgggtgattctttcctcacacaaatgcatgaattaacactctgctaatacttgaggaaaattctctgcaggtctccgtgtgtctctgtccttttcagcactctgtcttgaaaattctagatgtcttgatttcttgaaatctcaattttgttttctcaactcaggaagtcttttagcttctccctgggatccccttccctgtacctcagcctggaagttttctcaaaccaggaagctgggtcagttatgaggtggtgtgagtcatttttttcttgccactcactgtttttcattgcctaatatccagtgttttgtaaataattatttcatataacttaccttttttttttctagcctggaggataaatccaattcctgttattcctccttgactggaagcagaagtgtctccaatgggttttagtatttatctttgctaattggataatctgcaatactggttgatttgttggttttagtgacctctacttgtactcaatgtcatgtttttttccccaaactttccatcttcaggcttgacgtgtaatgctttgggacgtattttacttagaagactaagtgggatagcagaatgatgacttcctttacatgagtcctgtggctccatgtagctgcagctgggaaggtggctgtaggactatagagtaggagataaagagtgggagataccaacagatggttatgaatgattggtttgaaactttcacatggaaaattatgttgcagaaacctcagattgtgcttttgttctttttttgtttggtccaaatgaacaatggaatggaggtagatgtaggagggagatatgctgaggtagatcaatctttgaatgttgcctttgatcagggctactgaatccctggacatttatttatttgttttaaaaatttaattcagggggtacatgtgcaggtttgttacatgggtatattgtgtgatgctgaggtttgagcttctaatgatcccatcacgcaagtggtgaacatagtacccaataggtagtttttcaacccttgcccctctccctccttttcccttttggaatccctggtgtgtattgttcccatctttgtatcaggacaatatttaaatgtaggtggaaactttttaaaagttctcaaatttatggcaatatctaggcctcattgctgcaaaactgtacagagctgtttgcttccaaataacatcagaagacttgggattgttaatgggtacattaatatgattagattgaatgaataagttctagtatttgatacagactgactacagtcaataataatttattactcatttaaagataactaaaatagtataattggattgtttgtaacagtaaggatcaatatttgaggtggtggataccccattttaccctaatgtgattattacacattgcatccttgtatcaaaatatctcatgtaccacataaacatatacactatatacccacaaatattaaacataaaaattttttaaaaaggaaaaaaaagacctgtaaacctgggctgcactaagaagctaaacaactgaacttagaaaaccacaattttctttttgcaaacattgagaaataaaggagacaaaattatagctcagagaaatggcatgtatttatccaacagtgaaagtgcctgttatgtccttagctgctcttcataggcttgctgagctttttacttcaagctgaaaaccatcccatgtcaatatttgtattttcttgattttgtaataatcagttagcatgagtggctgagcaactgttgtttcatgatgccaaaatccacctcaagttgatcaatttatagaaaacggtaaactagttattcaaataagttgatttagttactcaggccatgaagttgatctgattctctttgattttgatcttctggggtattaaaaatttttttaaaatggagccagtggtcagtagcatgcctatgggaggtttcactccaatgatcattattctttctatcattctggggaatcctcaaagttttttaaaaccttggtaattcattagatgtttggattgaacatctattttaatgtagaggcaggaagaaagatactgagtggacagttccaaggtctcccagtattaccaggacatgccataaatacttaaaaacataagcagggaacttaaaggttttctgctgtattttagatattcacaagctaatcatctcaaagattttgcatgatttaaatggatctgccagattaggaccattagatagttaaaaccagataacatttgcatggggttgacaatgggatgtggctgccctgtcttccagcatggcagagtaagatgggaagaagtcttgagtcattgctctttggggaaaatatcattatatgtctaggaggccttaatatttgtcttactagagaaagtaattaggttaatattgctgtgctaatagagtcttggagcctgaaaactgggctaatccacactgtaaatactggaggccgtgtgtttccccagttagggcacacttggagaggagtcaggtgtgctcttttacaaatctcattgcattattattgagctcttggaaaggtgctgagtcttcattttagaaaaagggattagatgtggagggaatcactttgctttccccagggaggcatttctctattgcttttctagggttgggataggtatatagaaggtttgattctagaatttataaaatgatattctgggaactttgagcaatattttagggagggcacccatccaaaaaactagatgagttgctgcctttctctgcaacagcccttaggagactagcttctgatcttcttcctaaacttggtatccagtttattttgcttgtcttcctgcaggccattcttgtggagacaccgagtaacaaagtcttgaagtaatgtgtgacaagctctgtagggctataggattatagagcagctactcagagggcaagggtatgaagaaaaagagcaggtgcataaaaggaacagggaaaggggagtaaaaggaaatggggaaagaggtttaaaggagatacaacagtaaaaagaagaaaagctgggaaaggagaaaggaagcgcagcaaaaaaggtggaaaaagaagagagagtgctgatgcaggtttttcaggggcctatattgggcaaagcattgaacaagttacacccaaaggccaggagcctgaaatcaggtgccggttctcaaataacaagggcttattaagaatcagtgctattgcctaggatagttaaacagaaatacaaaaagtgctggagaagttcagggaactgtgagatatagagggaaaatcaggggaagatggacaggagatgggagctctagacacccttagacatcttggtttcaggttcattggtcagaactctctccccatccccacagtctatctagatgcttacatcaaaggcaatgcttgcttgacagatttctaaatagcagtagcaacaagatggaaagaagaatggaatgtcccattagaggatatagggccaggacttcagaaagagttcatatatattaatcacatgtcttagaatatcctggagcacctgtcctctcacctacctaaaatacttgattcccaatggtcaatgactttttaaaaaaagggggggggggggattggtatgtacatagatattgtgggaacgtacaattttttaaaaagtgatgataaagttctataggtaccttcacaaaccactctgttctacttaaatcttaacagttcctggaggaaactttgagattactcttcagagcttactttggtggttggggtgtgttgtatggctttgtgtgtgtgtgtgtgtgtgtgtgtgtgtgtgtgtgtgtgtgttggtttgtttacttttacttatgggcactgatgtattggttactagaaagttcatagataaatttttgtcctattcagtagacaaacatacctgacttgttgacatagagtctaggtgctaacttcattagtcaattcaccttactttcatatctttattttcatttgcctcctttttctttaaattttaggccatcttacagcactttatacatctatgtttatggccttaaatcttttctttttctttttttaagagcaatttgggaagaactaaaataaaattgaaatacaaatcaacattttttgttttatgcaaatgtatgttaaaatattcaaagaataaagaggttttttaaagaatagtaggttctagcacggctcagttaaaatatggtatcacttagtaagaaacactttctaaaaaacaatttatattagccataattaagaaaaaaagggatattgaataagtcaaagagtggtttccagggaagtctttctttgtctggaaagataccataggattttctgcagacagcttactcatttttttcttgattgaaatctggaaaggaaaacttgcaagaaaacattccattctggactcggcagcaggtcaagccaaagtggcaacatttgcagcctggagatcacacagtctgggagctcaaacatttaggcaataaaagctgatggaagccaaaaagccacgccactggcatctggtgtcagggtagctgctgggggagatctggccatggtggtggggcccagccatataaacaagttcagaggtagaactggagctgtgtactgggttgaagcatgtctctcctaaattcatgttttctctagaaccttagactatgaccttatttggaaatagggtctttgcgatgtcatgcattgcttaacattgtggttacattctgagtaatgtgttgttaggtgatttcatcattgtccaaacatcatagagtgtactcacacaaacctagacggtacagtctcctacacacctagaccatatactatatcctattgttcctaggctgcaaacctctacagcctgttactgtactgactactgtaggcaattggggtacaataatctaatgagactataatcatatatttagtgtgccattgaccgaaatgtcattatgatgcatgactgtagttaagatgaggtcatactggattaggtaggttctaaatccaatgtgactagtgtcctcataagaggagagaaacagacacaaacacagggaaacaccgggacgatggccatctgaagacagaggcaaacattggagtgatgcaatgacaagccaaggaatgccaaggactgcaaaccattgccagaagctaggaacactcaagtaaggactcctccctagagcctttagaggaagcatggctctgccaaccccttgatctcatacttccagccttcagaactgtgagacaatacatttctattgttttaagctatccagtctgcggcaatttgttatggcagcctaggaaattaacaccaggcatacttcagagcaggacaggtcaagggataaccaaataggtctcctgttactagaattatttacaatgtcagagtagttcttgatgtttacttggccctctcttggcaaaggctctttgtattttcctacactaaaggtctggccaagtaggggttcagattctcttcaagtatagaaactccccccgatttttatgtttgctggccttccaagtaagatttccattgaagaaaatgctccatggctaaaaagctttaaaatccattggtattatcggcagatttggactctatagagcctagtttctaaagtgcttcatagtgccgatctgaaagtgagatagcactagtcctatcagaggattgttcaacctgagactctgcatcagaaggtcaggcagcactgacctgtgtcaggcctggagcaggctctaggaggctgctttcgtgatgagttcctttttgttcaggagaatataaggaagctggtcctattttagaagcaataacagcctttgagtttgctctagggcaattgcaaaatcaagagcccccagggtgctgtactccagatttctaggtcacagatatccagaccagagttgaccagaaattggccagaatgggttctggggatgtggatgaatttccatttctcatccattcctactccatctccattttatcattctccattcctactccctcaataccaaaattaaaacaaattgttgattactaggtagccttcacattgagtttttcctatggtataacccttgaaaaaaattgatcaaccagaccattacaagaaaaaaaattatggttttactgagttaagccttttactaggttttgcggtccaatttctctgtgtagacatagacttggaaaagccaaaacatctaagcaatgcaaatttaaacaaattagttaaatctgccactgggagtcattatgtcattggcttttaacctggctgcacattaaaatcatctgggggaacccttaaaatgacttctgctcaaagtcatgtgcccaaggttgtgattaatttgtcttcagggtgattcctcccctttaatatttctaaagccactcaggtgacttgcttgtgcaaccaggggtgtaatcctctgatgtggacatgtgactgcaatagaggaaaatgctagagagcagatactctggaatcagtgccacctggacttgaatcccaactctgatatctcataattatgtgaccttgggctaacttagtctcattgtgcctcagtttccttctctgtagaatgggaataataatacctatctcctagggttgttataaagattaaatgagttaatatgggcaaagtacttagaacattgcctggaacatagtacgcaatatataaatattagttgtctgtcgtcctttgctgacatttcccttactggatgtctgaactgaaattgatctcaatagtgtaatattactccaacaagttatattaacttcctgtgactgctgtaataaattaccacaaagtggcttaaaacaaaataaatcttactcttactattctgaaggccagaagtctgaaatcaaggtgtcagcagggccacacttcttctggaagctctgaaggaaaacctgctcctttcctctttcagcttctggtggctattggcattccttggcttgcggtcacatctctctttgcttcatcttcatattacttcctcccctgtgtgtctttcttctcctggtatttcttgtataagaatccatgtgtttgcatctagggcccacgtggattatacaggatgagctgcttttctaaggattcttaatgtagtcacatcttttgccatagaagataatattcacttttttttgctatcataaggtactattcataagttcctggaattaggacatagagatatctttttggggtctaccattcaacccactatacaagatggcataataaaaagtaagcttggatgggaggcatcactgactcattctgtgtttagtggacttcacatttggcctgcacatcccattctctaatatgtctaaaaccattatttacacaacaggtaccatccaaatatacaaacaagtgactatttattgtcaatgtttgtagttacttctcggcaaggacccacagaagtggagcaagtgctcagaggactggttggcccaatggcctttggcatatagagagctccaacaaggaaaggcttcctggtggttttgctccaaagagaacaattttttgagaaactctattttgtgctaaaatgtgtacccaaaatctcaccaatgatggctgttttttattttgttttcattttagagatatgatctcactatattgcccaggctggccttgaactcctgggctcaagagatcttcctactttaccctcccgagtagctaggactacaggctgcatgactacgcctggctaattttgggtttacatttggaaaagtctgatgcttattttaaaagagaacagggtgatgctacattatcaggacatgttttctgtcccaagtgatagaaaaatcaatctgaataggcttaagtgaaaccctaatttattaactctcataactggaaaattccagcttcaggtccagatcaatgcagtggttccaaagatactatcaggacctggtttctttctccagctcttggctctacttttgctggctgtagtttcagaaaggccgtccttaggtactggcaagacaactgtactaagacctacattctctcaggttcaaggcacatgaaaataaacagtcctagaaaaaaatgtaagcaaaaccttaccgagatttgttgggttgaatactcatgcctgagacaaccaatgtgatagcaccccttcctgttctgtttggccgaggaccttggaaaggatgacccctcttaatacatgggctaagactgtggaaagaggtaggtctgttctgaagaaccagtgtaggtaccatcagaagggagaatgaatattgggtggcaaatacaacagatgaccactgtagatgcaattaggtccttggactaaaatgtctgaaatccaaacctgggttttcttgagcgacatgtgggatttttttttttttctagttgtgtgtgttggtcacaatttccctttccacttggaaataagtgagttattttgaagcagaagacccacatttaaattccatctctgctgcctctttgtagctgtgtggccttgggcacattaccttatgtctgtaagctttaaattcttcactggcctggcggtaacacacacacacacatacacacacacacacacacacacacacacacacacacacacacacgatcaggatagaggccatcttaccaggactattcatcaccagggcacataaacagaataagcctacatgaacacagtctgattgataccgaagaaccatctgtccctacatatttttcatggtcctgaaacatgttggaaatttctaccatttgagtaatggaaggaatgtttaaagcaacatgtttccagagagccaggtgaaaaatgcaaattgatgccagggaaaagcaaaatgaaatcctgcatcactgactactccttatccgccaccttagaagggatgagccaaagtcaccttgtgtgatcattctcaacatgcaaggcaaccatcaagagacttcaggcaaaatgatctttctgtttttccacatttgttttaggattcttctctaactgcttctcctgaggcagtgttccctggggatatccaataccacagggaatgtccatattgaaaaactatacctagagctcttctttctccaagttgtctccagttgcaaaaatgacctcttcatctccgtaatcacagtgctcattttcacagtggagttgctattaggtagggcaagtaccatctgattatgaattgattaaagcattcatattaagcatgtgtgagtgacaggctcaacttttttttcagggagttagtgtttatcttcaatcttctagattgaggtaagacattttttgagaaagatacccgggtctttttccctttctcctagatcggttgcaagtgtactcacaacagatgttatgtggtattctacttctaaaagactgttggccgtaggttttagctatcacttggaagataacaagtagtagaattatccttcctgttatgggtaggaaggaattcctacggataggaattatctcaagatccctcacagatgtgcactatcatgctccaaaaggtttatttttcctagaaattgactagccttcaagtcttttcagttctcttatcaaaacttactactcctttgtccaaaccctttactattcctttgtccaaacctccgtaacccctgttacagcagccacagggagctaatataccttgttggagttatattagaccattgaaatcaattttagttcagacatccagtaagggaaatctcagcaaaggaccacagacagctaatatttatatattgcttactatgcttactattcctttgtccaaactcctcaaatatccttcctttagattgcagagtagtattctgtggtgtggacctacctcagttgaattggcagttttatttttcttcagctgtttgaatgtgtcattccactgtcttctggtgtgtaaggcttcttatgagaaatctgatggtattattgatgtgtccttgtatgtgacgtgtcacatttctcttgctgccttcgacaatttctttgtctctgtattttggcaatttgattgtaatgtgtcttggtctagatttctttatattcatcctatttgtggtgctttcagcttcatgaatctgagtgttcatttcccttctggaatttgagaaattttcagtgattgtttctttaaataagctttttttcctattgtctctctgctttccttctagaatcaccataatgtatatatttgttgtcttgatgatgtctcatatgtcccttaggctttcttaactctttcattcttttttcttttgcacttataactggataatttcaaataacttgtctttgagttcactgattccttcttaggtttgatcaattctgtgtttgaagctttctattgattgtttttctttcagcaattagattcctcagatgcagaatttgtctggttctttgtatagttcctatctgtttactgagaatctcatttttcaggtattactttcctgatttcctttggttgttcatatgtttcctctcgtaactcattaaacttctttatgataagtattttgaattctttgtcaggcatctaaaagatctccacttctgtagggttggttgctggagatttgttttttcctttgattgtgtcatgtttcccagattttttatgtttcttgtagctttgccttggtgtctgcacatttgaaaaaacagccatctctcccagtttttatggagtggtgttgacagttaaagaccttcatcaattagcccagctagagatttggagagcctctcacatagcaagctgactgcctcttttcctttgttcttagctgcccccatcaaactatactcattctgtcagtcctttgggttgagtggaacagggactggcattcttctggcaatgtagtgaaagaccaagaggttggaggtatacaccactcttctctcttcttggtgagatgcctaggttctgcaatttctcccaatctcacagagctctgctatcctgtaacaatctgtttacgccctttccattgttgagttgaccgaggggtccaaactatggcagtactgtcaatgttccatgtggggcaagatagaaactgtccccttggacaattcactgaaagactgggatgccggatggtcattccacttctcttcccctcctaatgagagaagtgtgggttgaggcaatatcccttggcattgatctgtgctggctttggggagaggctgacataggtaaagtgtaattgctcttcttatttgttttaatgtggctgttcttcattttgtgctcatctaggatgcttgcaacttctcataaaagtagtctcacaaaggtattttggtgtgtatattattgttagcttgatgtttctgtggaataatgaggtgagggaccatttattctaccatcttgctgatatcactcccctgaagtgcaaaagttttaaattttgatgaagtccaatttatgagttttccttttatggatggtgcttttggtgtcaagtctgagacctctttgcttagtcctagatcctgaggattgtctcctgactgaaaggctaattttcctccattgatttgcttctccacctttataaaaaatcatttgagcctatttttatggctctatttctgggtcctatattctgttttgtcaatctatgtgtctatcccaccaccaacagcacatagtcttgatcactataactatttaataagtcttaaatctgataggaactctgactttttttttccaattattttagttatccaagttcctttgactttctgtatacagatggtccctgaaattcaacagttctacttaaaactttttgactatatgaaggtatgaaagcaaaatgcattcagtagaaaccatacgcagtgtccacacactgttctgtttttcacttttagcacagtactattaaataaattgcatgacatattcaacactttattataaaataggctttgtgctagattattttgctgaactgtaggttaatgtaagtgttctgagtaagtttaaggtaaagcaagctaagctgttatatttggtgggttagttgtattaaatgtattttcaacttctgatatattgaaaacaatggttttatcaggaagtaatctcattgtaagttgaggagcatgtgtacattttagaattatcttgtctatattttttaaaaatttctgggatgtaataaaaattgcattgtcattttgggggagaattaatatccttgctatattgagtcttttaatccatgaacatgatatgtcaccatttaaaaaagatctttaatttattttattaattctttggagttttcactatagaacccttgtacatgtttggttagatttacaacaaaatatggtagttttggggtcatcgtaaatttggtgatatttttaaatttcagtgtcaacatattcattagtagcaaatagaaatttaattgtgtattttgtatcctgcaaattcactgaaataatctattagaagtgaggggtttttttctgtatatttttggggatttcccacatagataatcatgtgatttgcaaatgacttttatttctccttttctaatctataaatttttttcttaccttattacactgactagaatttctagcatgttgttgaataaaagtagtaagaatgcacatctttgtcttgttcacgatcttaaggaaaaaacattcagttactgactgttcgatataatgttagctgtagatgttccttatcaagttcaggaagttttcctctactcttattttctatttcttataattttatcattaatagaaattgaattttataaaatttttaaatgattgatataatcaggttatttctctttttttattctgttaataaggtgggttacatcaattgatttttaagtataccagccttgcatctctgaactatatctccagttggtcatgctatataattcttcatatagaattactgaattctgtttgttaaatgtttttgcatcaatttttatggggactagtagcctgtaatttttttcttgttcttctttgcactgtctttatctggtttatctttaccttttttttttttggattagggtaatacaagctttataaaatgaattgagaagctcttctattttttggaagaaatcacatagaattggtattaattacttaaatgtttggtagaattctgcagtaaagccatctggacaaggatatctctattttggggatattgaaaattaagaaataaattacctagtttattttttaaagtggttacaaaaacaaagatgaatgtagtttttaatttaccttgagacttggtctttgatccatgaattatttaaaagtatgctgtttagtttctaagttttggagaatttcttgttattattatgtctgatctctgttttgtttctattatggccaggtgacatattctgtataattttactttttaaaaatttgtctaggattgccttatgatataagatgtggtctactgtggtatatatcccatggccacttgaaaagaatgtgcattctgctgttgtttgatgctgtgtaatagaaatgttgattatatcttgttggttgatagtgttgttgagttcttttatatctttgctgattttctagttttcctagttttctggttttcctatctatggtttagaaatgggtgttgaagccttcagctttaatagtagatctatttatttttccttctggttttgcttcatataatttgccagtttgttgcttgatgcacacacatttaagacttctatatcttcatggttaacttaccattttatcattatataatgtccctctctaattctggtaattttgtttgctcagagtctactttatctgaaattagtatagtaactctacttcatttttacttttaacatttattattttttattgtggcaaaatacacataatagaacttaacatttgaaccattttgagtgacattaaatacattcttaatgttgtgcaaccatcacttctatttagctcatgactctttatcttataaaactgaaactctgtacctagtaagaaaataattcacgcctgtaatcccagcactttggaaggccgaggcgggtggaccatgaggtcaggagattgagaccaacctggctaatatggtgaaaccccctctctactaaaaatacaaaaaattagactggtgtggtggtgggcacctatagtcccagctacttgggaggctgaggcagcagaatcgcttggacctgggaggcggcggttgcagtgagccgagattgtgccactgcaccccagcctgggtgacagagtgagactccatcttaaataataataataataataataataataataataataataataataataataattccctctacttccagcccctggaagccaccattctactttctgtttctatgcttttgactacttttaactacctcatataagtgaatcatatggaatttgtcttctcgtgactggcttatttcacttagcacattgctctcagggttcatccatgttatagtacgtgttagaattttcttcctttataaagccattgtaagtatataccacattttgcttatccatttattcatctgtcaatagacacttgattgcttccacattttagctattgtgaataatgcttctatcaatgtgtgcacaaatattgcttcaagaccctgttttcagttcttttagatgcatattcagaagtggatttgctatgtcatgtagtaattctatttttaatttttgagtaaccaccatattgttttcctcagtggctgcaccattttacatttctactatcagggcacaagtgttccagtttctccacatctttgccaagacttgttattttttgttttcttaatagtagccatcttaattggtttggttggagatggtatctcattgtagttttgattttaatttccctaaagattagtgatgttgagcatcttttcaggttcttatgggccatttgcatagcttctttggagagacatttattcgagtccattgcccaattttttgttgttgttgttgagttttaggagtgctttatatattctggatgtcaatctcttgtcagatatatgctttgcaaatactttctcccattctgtgggttgcccttttcctctattaatagtgtctttgatgtacaattttaaagattctccatgaagttcagtttttctgttttttcttttgttggctgcacctttggtagcatatccaagaaatcactgccagatacagtatcatgatgcttttgtcctacgttttcttttaagaattttatagtttttttcttatatttaggtctttgatcaattttgagttaatttttctatatagtattaggtaagggtctaatttatttattttgcatatggatatccagttttcccagcatgatttgctgaaaagactgttctttctccactgaatggtcttgacatctgttttaatcagggttcttcagagagacagaattaataggagatatatatctatatctatatctgtatctatctaactatatctatatctatctatctatctatctatgtagagagaggcgggggagatataagaaaggatttattaggggaattgactcacttgattatgtaggctgagaagtttcataacagatcatctgtaagctggagtgccagggaagctggtagcatggctcattccaagtctgatggccttagaaccatggaagccaatgttgcaattctcagtccaggactgaaagcccgagagcctggagaattgctggtgcaagtcctaaagtccaaagaccagagaatctgaacttgtctcatgatacaaatataatctaccatggtatatagcccatgtacacttgaaaagggtagaagaaatgaattctggctccagaagacagatcaagaatttgtccttcctttacatttttattccatcacccacattgagggcagatcttctccacccagtccaccaactcaaatgccaatctcttccagaaacaccctcacagatgcacctggggtagcccaatcattagaatcaaatgctaaatcacttgggtttcccttttacagaagggagacatgatcagtttctactgaagcattgagaataatttgtactttatcagctgctgggtatcccttaatccagtcaaggtcacatccaaaatcaaccatcatagcacccttgtcaaaaatcatttaaccatatatattagggtttatttctggactctgtattgtatttcacaggtctatgtgccttttagacttttatttttatttttattttattttattttattttttttttgagatggagtttcactcttgttgcccaggctggagtgcaatggcgccatctcggctcaccacaacctctgcctcccaggttcaagtgattctcctgcttcaccctgcctagtaactgggattacaggcatgtgccaccacgcctggctacttttttgtatttttagtagagacagggtttctccatgttggtcaggctggtcttgaactcctgacctcaggtgatccgccctccttggcctcccaaagtgctgggattacaggtgtgagccactgtgcccagcctatttttattttttttaactttaaaataaagttgagggggcacatgtacaggtttattacatgggtaagttgcacgttgctgaggtgtggtgtacaaacgatcccatcacccagttagtgagcattgtagccaactggtagtttttcagcccttagccccctctcacccttcccactttattagtccccagtgtctgttctttttgtctttatgttcaagtgtactcaacgtttagctcctacttataagtgagaatgtgcagtatttgttttctgttcctgtattaatttgctttggataaaggcctctagctgcatccatgttgctgcaaaggacataatttaattttttatggctgcatagtattccaagatgtatatgtaacatattttctttatccagtccatcattaatgggcatctaggtagattgcatgtctttgtctttataggcttttattgtctatatgccagtactatattgctttgattactatagtttttagtaagatttgaaatcaggaaatgagagtcctcaatattttttctcctttttcaaaattgttttggctttttgatgtctcttgagattccatttgaattttatagtggactgttttatttctgaaaaaaaaaagtcattggaattttgatagggattgtattgagtcaatagattgtgttggtagtatggacatttgaaaaatattgtcttccagtccatgaacatggaatgttttccatttttatattcttctttaacttctttcagcaatattttataattttttactgtacaagtctttcacgtctttagttaattcctaagtattttatttgttttgatgctatcgtaaatgagactttcttaatatccttttcatattgtttattgtaagtgtatagaaatgcaactgatttttgtgtgtcaactctctatcctgctactttgcttaattcgtctattaacagttttttaaaaatgtatgtggaatcgttagagtgttctagacacatgatcatatcatctgtaagcagagataattttagttccttctttctgatttgtatctctttgatttcttttccttgtctaattgctctggctaaaacttctagcactatgttgaatagaaatggcaaaagcagcacccttgccttgttcctgattttaaaagaagagctttcatctttgagtacgtttgctttgggtttttaatatacagattttattatgttgaggaagttgccttccattctcagtttggttggtgcttttatcatgaaagagtgaatttttcaaatgctttttctgcatcaattaattgaccacgtgttttaccctctgtaagcctgacaacgctatggattacactgattgatttttgtattttgagttatccttgcattctagaattaagtcttacttgatcatggtctataattctgtttatatgctgctcaatttggtttgctagtattttgtttaaaaaattgctttgatgttcataaaaaatactgctctataattttcttttctgatagtgtctgtgtctaaatttggtgtcagaataatgctgacctcatagaataagtcaggaagtgttctctctcctcttcattttttttttggaaaagtttgagaacaattggggttagttctttaaatggtagaagtatttctactattggtagaattcaccagtgaaactgttagatcaagggctttttttttcattatgagattttgatttttgattacttatgtaatctccttactagttataagtcttttcaaattttctatttctttatgatttagtcttggtaggtttagtatttctaggaatctgaactttttcatgtaggttatccaattttggggggtacaattgttcatagtgctgtcttagaattctttttattcccatagaataagtagtaatgtcccacttttatttatgattttagtaatatgagtcttgtctctatttttcttagtcaatctaagtgtagaattgtcatttttaaaaaaaatttttaaagaaggagcatttggttttattggttttacccttgtttttctattcttgatttctttgatctttgttctaatcttaattattccttctttctggtagctttgggtttagcttattcttttctagctccttaagttgtaaagttagttggctgatataggatcttccttgtttttaatataatcatttgtagtttcaaatttcatgcttaacactacttttgctgcatcctataagttttagtatgttatgttgtcattttcattcatatctaagtattttctaatttccctttgctttctcttttgatccattaatttttttaaagaatgtgttttaaaattttcacatatttatagatttttcagttttacttttgttattgatttctaactttatcctgttgtggtcagagttgttttgtatatttctgttagatctagttggtttattgtgttaagttctctatgtcattacttatattctgtctagttattctattcatttttgacagtgtggtattgaattctttaactattattgcagaaatgtctctttttacttcaattctgaagttttcactgtctttattttgatggtctgtcattaggtgcataaatgctcataagtcttctatcttcttgctatactgaaccttttaagattaagtactttttttgtttcttgtaaccatttttaaaaaaatttaaagtccattttgcctgttagtacagccacatctgctcttttttcatttccatttgcatgaaatgtcatcttccatttttccactttcaatttatttgtgtctttggagctaaagtgagtctcttgtaaacagcatatatttggatcatttaaaaaatccattctgctcatctatattggttgaagagtttaatacattttcatgtatgctattactgaaaaggaggaacttacttctataatttttatatttgttttctctacaccgtataactccccatcccttgttcccttttgtatatattctatagctattttctttgcagttaccattggaattacatttaacatcctaaatttataacattctaacttataaaccagcttaatttcaataacataaaactctgctactttaacagctccttcccatctctctttgattgttaatgtcacaaaattgcaactttatatatcatgtgtcacaaaacataaataattccttgaaatgcattaaactcttctatggaaaaaataatgagttagaaaccatagtttcagtgatattaacttttagactaataattgtttttttaaaaagtattagtttcttaaatcatgtacagaacacaaagtcaagaaacattgttataatcataccaccttttacaatgtccctatgtttaccttcattgatatttttatttctttatatagattctagttactgtatagtatgctttcattttaacctgcaggactccctttaacagttttggcatggcagatgtagggcagcaagctatctcagcttttgtttagctgggaatgtcttaagtttctcctcactttcaagttttgccagatatggtgttcttgcttgacagtttcttttttatattagcactttgaaaatatcagcccactgccttcttatctctaaaatttctgatgagaaatttgtagataatcttattgcagatgcttggtatgtgacaagtcatttctatctcttgctgctttcaagattttctctttgcctttgtatttggaaagtttgattataatgtatatccatgtgggtatctatgaattcatcttacttggagttaattgagcttcttggaggtttatgttcatgtcttttttcaaattcgaagaatttttcaccattatttcttcctatattctctctactcctttctttctctctgcgttgtctgggactctcatggtgtgtatgttgagccccttgatgatgtctcacaggtctcttgggctctgctcacttttcttcaattttgttttctttttgttcctcagacttgatgatttccattgccttatctttgagttctctgattctttcttttgcctactcatatcttccctcaaagccctctagtaaatttttcatttctgttattttaatttttagctccagatgttctttttaggttttcaaaatctttatttgtattgtcattttgttttatacattgttttcttgacttcatccacatgtacttttagtttatttatttatttatttattgagacaggttcttgctctgtcatccaggctgtagtacatggttcagttagctcactgcagcctcaacctccttggctcaggtgatccttctgccttagcctcttgagtagctaggactacaggtgtgtgccatccatgcctggataaataaataaataaatttaatagagatgaggtctcactatgttgcctaggcttttaaattttattttttgggtatgtagtaggtgtatatattcatgaggtacatgaagtattttgatacaggcatgcagtgcataataatcacttctaagatacaaaataaagccctctttactctttgctttcctttccttaagcagatggtgggagtaaattttgttgtgagttgtgttgcctggtgttgcaggaggaatggcacaagcacttccttagccaccctggctggtgtccaatgttcactgactctaagcccagcacagcactaggacttgcccaggaattgcagtccttgtggcctagactgcctctcaagtttgtttaggatcccagagcacttaagcccatggtggtaagtcttgtgaaaattcaagttccagctgctgggatgggtgattcccctctggctagggctgatctatatgctccctgtgtgtgttggcattggctgagtttagcccagctttactttccattgtgacagggcagcattgagttcaatgcagagccccacaatcactgtactgtccatttcccaggtttacagattgtctctctgtgctatgtggctgctgccagagggataggggaggggcatcattggcaattcaagactatgtttcttaccttcttcagtgcctctttcagcaatatgaagttaaaaccaagtactgtgattgcttatctgattttctgtttttacgaaggtgctttttgtgtgtgtagatagttgttaaattggtcttcctgcagtggggatcattgttgcaggtttccgtttggccatcttgctccaccctccctcttttccagttcttaaagtatcttcaagacagttattttaaagtcttttttgagtagatctgctgttaggtctttttcaggggcagtttctgttgactattttttcctttgaatgggctatattttcctcttttttttttgaatgccttgtgtttttttttgttgaaagttgggtatttcaatttaatgatgtggtaactctgggatgcagactcttctttttcctcaaggttgtttgctttttgttattgttttgtttgtttataaaaattgctttagtctgtctctgtgccaaggatcagcctgaggtgtaaacataaggtctttactggtattctctgagcttgcatctttctgtggtcatgtgtgttaactttctaattttccccatatattcagttgtttgtgaatgtccttatctttaatatctggctcccaaaaggagaaaaagagaaaaatgaaaaagggagtggaaatagggtgccagccctttaaatctctggaagtcatttcagctggatgggaaggggtttgcaacaatggaataaggtgtaacagcaaagacccaccacctctttgtctgtacctctctgatcagaagcagcaatcatcaatctaagcacatatgcctgatacttagaggacagggtccattttgcttatcctggctccttcaagctgtgtgcaacaagctgctgcaggaatacatgcacagctgcctgccacaggggtggggataggaaatgggtagctgttactgtgctaagagctaaaattgactgagctgaaatcaaagttaactgcaatgtaccatccaaatgtttccctgaaagttgcaagccttcaatagactccagatttccaaaacagttatatcagacatactctgtcagtgcaattattgcctaagcagggagacagattcctcgtgtttcttactcttgcagctccccaggatgctctccctaccttcctttatttaatgtttttatgatacatcttttcccctttttattacgtttaccctgactatattgttatatttgagtgagtttcttgtcatcaacctattgtttggttatgttttagtcaactcttgtcttttaattgtctttagccaactcttgtctttacaatgatttgaattatttacatttattggatttattaatgtattaatgcttaagtctgaaattttattttttgttttatatttgttctctctgtttttctatgtgttttctttttttatgcttcctggtgattatatgaatattttttagaatttcattttgatttatccttagatttgatacaagagaatctctttcatatagttttttagtgattgctcttggtgttaaattatatatgcacaatttttcatagtttaaaagtgttgtcattttaccagtttgagtgtagaaaacatacttcccgtaatgccacatttttcttcctcatttataatataattgtcttaaatattcccccttcgtacatttagaattacataatacagtgtattggcatctattgatttttaaaaattcagtttgagaccttcttggttcttggtatgttaagttattttccattgaaacctggacattttgaaacctgaacgtggaggctccttgttacttttgtgtggcggtggggtttttggctccctgttagtcctccactgatatctgtttggctgagagagttgggaatgtttcctttcacctcccaactggtttccactgacaccatggaatgcagtggaggagggaaggtggccttgttgtcactgggaaacggtgaatattccaactctccactagggcttctctgatactacccaggccagcaggaggatgtggagttaagaaatcctggctccccatgttgtctctactaacactgtggagaagtgggatgagcttgttacttcccagtaggaattcctgactccctacccagccttttctgacacagcctggcaaggggttagagtgcctataacagcttggtaagggggaagcacaggcttctgcacttccatcagactttgctagtggggtgagagtgagccagtttttctgtggtgtttgttataacaaagcaactatattctaaaagtttttgtctttctggtttttccctttttctcattccttggctagagaaagtaagattttgtttggcctttttgatctgtgatggttccattttatggttgccaacttcaatggctctaaatctggaatatatgaggcaaaatgaaaatccaggaacacactgctttgtttttcttcaaatcctaaggtttctagcccatatgccttgttctctccaacttttagaatcttctcatgtttgctttttaaataacgtccagagactcaattatatgtagcaggaggaatgtggaaaagcatctccacttcacacccccctggaagtaaaagttatgatgcatatacagtgagataaaatttgaagctctgcatgcgtatgatgtgtgccacttatagcacatgatagactctctttcattcaaaattcattccaggcctgctgtgtcccaggcactgttcaaggcattgcagatatagtgatgaacaaaatagataacatttctctctttatggtgcatacattcttgtgggaagaggtggacaataaacacagaaagtagaatatgttagtaaaaaatgctactggaaaaagtaaagtagatttatgaggctagtgagtgctggaggcattggaggttatttattttacataaggtggtcagggaagctaacatttgagcagagtggctgcagtgagatggacaaagacaaaagtggtagaagagagcagagatgtagttggggaatcagattgtctagggtcttgaaggcagtcaagaatttgggctttcatttagtcatgaaggaggttttcagagagaagtaatatgatccagtttacagctttattggtctgctatatggagaatagattgcggtggagtaaatgtggtggtcaaatgaggaggcttttacaaatacccgggagaggtttaatgagagattaaactcagatggaataatggagttagtgagatgtggccagattctgaaaacattttgcagataaagatgacagaaattgctaacagattttatgtggggtgtgagagaatgagagagagagagagatcaaagatggtctaagatctttggcttaagcaattggaagaataaacttggcatttactgagatggggaagaccgagggaagtgcaagtctggggaagaatggggagtcagaggtttgggtttgactgtgttaaaattgaaatatccattaaactaggggcatagtaggaggttgcccacaggagtctgagtttaaggactgcagatatcctgtctggagatatcaatttgggacttgctgtcctatagataattgcttttgtctgttttgcgctgctataactgaatacctgagactgggtaatttacaaagagcagaaatctatttcacacggttctagaggctgggatgtacaaggccaaggtgccagcatctgatggactccttcttggtgtattctcacgtggaggaaggcagaaggtgaaagggcaagaatgaacaaatccactccctcaagtcctatttatagcagcattaatccattcatgttggcagagccctcatgacctaaacacctcctaaaaggccccacctttcagcaccgttgcattggggattaaatttccagcacacaaattttggggaacacattcagattatatgaatgatatttaatgatatgtctagatgtgatcacatagacagagactgtaaataaagaagaaaaagagtcctgagttctgggggcactctcatatttagaggtcaggaggatgaggagaaaccagcaaaggaaaatgagaacagatcagtgaagcagaagaaccaagagagtgtggtgtgctggaagttgagtaaagaaagtgtttccagaaagagggagtgattaatttgtcaaataagaagagagttgtaaattgattcttgggtttgggaatgtgatggtctctggtggccccaccaagatttgtttccatgggaggagggggaaggaggaaagaagtggaggagaagacagagatggtgagcataagcaactctctggagttgctataaaggaaagcaggaaaatggagtagtagatgaacaaggttacagggtcaagaaaggtgtaattactatacagaacagttaaatatatacatggaaactttgtatttatctatagagtttgaatttattttgattgacaatgagtctaaaatttcatatagtgaaaagtcttcaattggcttgataatcttagcaatagcatttatatttgaagaagacttagttaaatatgagttggtctatgcaagatgtgtaattttaaagcttcttttctttggtttaatttggatttgcaatttcagttaaccctttccaatgaatccccccaaatgaatatttacttagcaatgataaaaaaactttatatttacagagtacttatcagtctctctataagaacaaacataaaagaatgaaaatttacattagaggtgtaggaggtaattaaagtgatgtggtcccaaaccagggaaactgagtctcagaccataggtggagcatgggatctgaaggggaaactcacctacaactctacagcaccaattgccagcctcttgggctaatagactctctcccgcttctgtcattgtctttgtctttttctacagtgaaacaagctttgaactatttccagctttccaatagcaaagttattcagattagatgaactttatttgttctccgggacatctagttctccaaagtcttctgtctgtaccatgtgttcaccaaacctccttctttttcctgctgggaaacccaatcagctgcatttcccagcctcccttgcagttgggtggggccaaaagaatgagggtggaatttatgccacttccagcctgaagcatggtcattaagaaaatcttctacacaatcctccttgtcctctctcttcctttgcctgctggatagatgcagaagattccttggaagggcctgggtcctgaatggctgtggagcagaagcttgaatagcatcttactgtggcatgagcaagaaatgagcttttattatgttgatcttttgatactttgtagttgtttgttacagtagtgagcctgccctgattaatacatacttctactgcaagtattacaaaaatacaactttttaaaaaatacctttctgtagcctttcaggatcctttccttctaagaagtcaccttcaggctcccaaagctttcctggagtgtgaatgcaaggagaaacaaatagcaacaatcctgtatcagttactttttcctgcatcatcttatttaatttctgtaggaatccaatgattctcataaaacagtagtccaatgagtccagcctcataatccaataaggttaataattaacctcagtttacagatgaaggagtttgtccaagatcacagagttatgaaatagtgaaatccttcgagcctgacctttttaaccacggagcccttgctctcccactacatcttcactctgttctttttccctctggggaaggaagtaaaactcatgaatctaattcacttatgcacactctggtattagagactcaatttcctttctcttgttgtgtgtatttgtgttttgaaggaggtgagaaacagagaaggtaattatttactgacatgaattgtaggcactgttgtgattgggtggggtgggaggcattctgcagacgacatagtagacctgagtccaggtgtgaaggggagagggagacagcagacagcatttagtttctagggagacagcacaggaaactaacctttctttccccttcagctttttaatacaaataattaaagatcctcatagtccattaactggccaggagagcagatggtagaggtgagaagtttcagcatcctgagaacacttgagcagcctccctgttccaacagaattgtccatattcaagccaagagaggaaagatgtggaactgctgttgccaagggggaaagtgcaggtcttcaataccaccttgatgttttatgtttataaaatttggctcagctgggcgcggtggctcatgcctgtaatcccagcactttgggaggctgaagcaggtggatcacgaggtcaagagttccagaccagcctggccaatatggtgaaactctgtctctactaaaaatacaaaaattagctgggcatggtggcaggtgcctgtagtcccagctgcttgggaggctgaggcaggagaattgcttgaaccctggaggtggaggttgcagtgagccgagatcgtgccactgcactccagcctgggcaacagaatgagactctatctcaaaaaaaaaaaaaaaaattgactcacacataatgcaacacctgtctgcatacttttgccagtcactccataatttaaaatgtgcttcttcataggaagcatcaaattagataatttcatcctcacagcaattttaggaggcaacactcacatatgatccaggtaaaaaaaatggtgactcacatccctgacatgaagcccagggcatttcttagacttcctgtttttgagaaggaaatctaagacaaacctcccagactttgaaggatgggtgttcctatccaaaatgcaactgtgattatctgtgaaatctgcagatcttgtctgctctttcttgtctgcaaaagatcagatgaatgctctggagatgtgtgtggttgtctagcatgagcatgtgcgtgtgcatttgtacatgtgtgtgtgcatgcatatgtgtgtgtgtttttgtgtaagagacaaagaaagaaaaatgaatataaaatttacagaatcaaatatcagttttcaaagcttcaagatccaattgtgtgtataggattatctgccctgtttaggaaagtgttttctggagtggagctccaagtctgtgatgaatgtgccaaactaggggttccttctcggagagtcatcatatccttagtatgccatggcttgaagaaaccccacaatgagtaaatattaggtcttgtctgatgttatagatcccaagcttacttaactatggattctcttttttgagtctatcactcattcacatacagtgacagtacatctttttgaaaatgccaattcaagagtaattagaaaggtttaatgtagaaaactaggattatcagaagacctagattttgctcttactctatcactaataggctttataatttttgataaattatttttatttagttctttttcaagtatttttttctgccttgaaggaaacatttctttaaggatatttattgtacttatttaaaattgttgttctgtcatgataattccactttgcatggtacatgttattcattatttattacataaattatttatatattacatgttgttgattatttcttagtggttgtacttttcaggtatgtaattattttggcctgtgatatacatcctcctggagaagataatttgtattgggttaaggcgaaatggcagagcctggtttttgtaccttctggtgtgagcttaagaaagaggtggggatgagaccatgttcttttttaacagtgaatcctaacctttcctccctgtgtgtcccaggacatttgtgtactcactgctcaatcgagggaggccttatccagctatactcattctcagaggcactgccttctgcactggaaatggagtccttcaaggctactatctgatttactgtgctgaataccctgatgggtggtacacagacatacggtttagcttgggtaagtgaatctgcccacttctcacctacttcccagctaacaacccttcccacaatctacatcgccatggcctctccctactgcaatgacctcgtaatgatcccatcttcccctccctcacctctaccctgatcttttctctatatggtagccagagagattgtttaaacacatatcatgccatttcccatcgcaaaactctccagtagatttcctttactctcaaaataaaatacaaattccttcccactgcctttaaatcctaaatattcttggtcttttcaatttcccaacctcttttcctggctccctgcacctccttttctgtgctccagtgccagtggccttcctgctgtgccacaagctgtcaagcttgtccagccccagtgtttttgtataggactgttccctctgcctagtacaggggtgtccagtcttttggcttccctggaccacattggaaaaagaagaattgccttgggctacacatataattcactaacaccaatgatagctgataagctgaaagaaacattgtttcttaaaacaatgttttaagaaagtgtacgaatttgtgtcaggccacatccaaaactgtcctgggctgcatgtggcccacaggctgtgggttggacaagcctggcctagaaggctttgcccccatgtattcatgggggttggttcctcactttatttagttccctaccaatttgcacctcctcaaagggactttccctgaccaccctatctaaaatggttgaagacactgctgtgtgtgctgtcccccttccctccccgctcccctaccatcccctgccccagataccctttcttccaggctaatgatcttttgactaggcaaggtggaaaatccttgttttatatcaaatcaaataaggtgagaatagacttgattgtttcaactaaactgttcttgctttttgcctgacatattttgaaaagcaccaaagtgctttgctgacaggttgggttgggcctctttgtgggacggtgagtgtttctgggctgtaataatgccttttgggatgcaggatctagcatccctgatcctggctgtcctcacctcagaacagggccctttctgtaccagtggatagtgcacgtggagacacctccaggatatgtggctaagtaagataaataaaaatgtgaacagtgtgtgtagtatgctacttttaatgtcagaatgtgtgtgtgtgtgtgtgtgtgtgtgtgtgtgtgtgtgtgaactggcagtgatggaagtcagtttgttagtggccacgcctccaaactagctcacgttatttcatgagagtgggtgtttcagtcaggaatgcgttcagaaaaccatataatagtgacgggaataattcagaattcatagttcttacataacaagtgtcgaagtaggtggcttctgcattcctgtggttgcttactgacaccattaataactcaggcactttgtgtctcccctattcttagcatgtttacctgtggtcctcttattcatcacttcgtggttgcaagatgttgactgtagctcaaggcattacatctggcaatcaagacaggaagaaagacgaagtaggggcaccggtcttgcctgcaccttttatcagaaaagcaaacgatttccaaggaagtcccccaaccaagacttcactttacatcttattggtggaactagctcatgtgaccccctttctcagtgcaacctctgtagtgggggatggcaaaagaaaaggggctggaatcagctgttgagatatgaaacctcgatttgactgtttgtgaatgagctaaaggcttactattatgatccatgcatttgtttgtttatctatttaaatactggacaatggtgctacctcctgctctcctctcttttctaatctgtctccatcagtggtgccactgtgtactttcagcccaagtctaggaaacagcacacccagtgctccccattcaggaccaggactcattgccctccccactttctgccacgtcttaggaccattcttagatttagaaattaaatgcccctcctttcattttagcttagtttgtgaaaaaagcaccacaatctggacacatttaaaaaaaatttctcctttctctcttctttgtcaaggtgtcttcttatttattttgggaatgggaataaacattcatagtgactatatattgcgccagctcaggaagcctggagaaatcagctacaggattccacaaggtaatgtctcccctgcccccagactctcactcttccctggagcctgtcccagggatgatgctatggtagcagatggagaggggacagtgagggcacgaatgatacaatacctctcagcttgctcttgacttcccctgcaaacccagtcccatcacagtacctctgcatttctaatctgaacccagaagctccagagagctaccagagccctcaggaaggtgcgagaccgcaatacccggaaggtgggagagagtgggagatttgagtagggttggaatcggctacctacaccctcattgcagtaggtaaggttgtcatgtacagagggctgatcctttctaggttgcaaatgatgctgaatgcttggccaataaatgtgtcccctccaattgatctagacttatcttgtgagcagttaaggctagaacttgcgtatttcctgccattcatatatacttttaaaggtgtagagaactatatttacttaatcaaaacttaggatgggaggccttacaagcacaagtgcatttttggagataaaggtgagcatgtttgtaatcctaactgctccaaagaaaccagggtatgagattgacaaatatacgcagatgggagcaaatcagtccaagtcatccttcagtaggtttagatgggtatttgtgtaggtccttggcttccaccgtttttgatgtaaatacaaccctttatttacatcaaaaaatttcctcaattatgacatgatgttagtgcacattaatagtcattgattaagaaattaatgacaaagttactatgaattcagtaacagattcaaatgaatttgaatgttgttaatatcctaacagtatctacatcaaacaaaaataatttaggaggttaagatgtgccgtttactgtcttcatagaaaatttataggccctttgctttagatccgtggttcctcccagggcgtagggaatcacaggttgggaaccactgacgcagtctcatcttcaagaaagattcaactctaaggggctttgattttaaaaacattcactccataactagataaataaagaagagcagagaaagcacttgaaaaccagttgccaagattagtttccaacttttgaattataatagagaatgatttaaaacaaagtatttttatgtaactgtagaaagaacaaaattgtttcggttgaaacatccccagtttaatgtgggtaataaaatttagtgtggatatatttaatatcattagaaatatgctgatttctagatacagtcctgagagaagaaatacctggttggatagaaaatgaaacatttaaaatctagaagccgacttcaccagcctacagcaggacaaatacctgcagctcctactctctgctttaaacatgaacagaggagagtgctttgcagaagggtggggaggggcaaatcccataagagaatctaaattccttctcccgtgagttcagatttttattattttaatgtagtgtgcagtttcacattttgggactgtgaatgtgaacgtgtgtgtgtccaggaaaggagcggggaggtaagaggtggcccaaaaaccttccttaacagaacaaaacaaaaaccagacctcctacacctctcccttatcctacccaaagctagtggtccagcagttgttagagatttggatagagcccgttaagcagttgaggccactcttcgcaactccagaatgttctccaggcaacaggctgttgttgctttgtttccccttctccccaagaggattccaccaaactcctatgactatggagggagcctccagccccacatttgttcttgctgcctttgtgtattttggaacaacacagatgggtttaatgtcaaaatgattcagttgcaatgattgaccttccgattcttctgcacgcaggtggcttgtttacgtatgtttctggagccaatttcctcggtgagatcattgaatggatcggctatgccctggccacttggtccctcccagcacttgcatttgcatttttctcactttgtttccttgggctgcgagcttttcaccaccataggtaaatttttcaataaaagcggcagcattcacgtagctttcttcttctccaaacaggcttttaacccgcagaggaagattgagaaaccgaagatatttaattttttaagggaaggttgatactataatctgggttagcatattctgacttgctgggcttgtattgaagttggaagttagctggatgagagtagcagtaataaaattttttctaagaacaaacataagtccatgtaaacagaggcaactgaggtgacggccgggaaggtcctgtgcctgtcttgttgaagaaggctgtccagcgagaagtgccttgcaccttcttgggttagctgacccaggctctgtgcccaccaggcaggcttacctggagatgcttagataaagcctcaagaagcggaagaagccgcttccatttccaccttcagtttcatcccctcccaccacatttctggaagtgtgctccagaggtgggaccatggccagcactttccaaagctccacagatatttatttatttatttatttatttatttatttttgagtcggagtctcactctgatgcccaggctgaagtgcaatggggcgatcttgcctcactgcagccttcacctcccaggttcaagtgattctcccacctcagccttccaaatggctgagactacaggcccaccaccatgcccagctaactttttgcatttttagtagagacaagtttcaccatgttggccaggctgtccttgaactcctgacctcaagtgatctgcctgcctcggcctcccaaagggctgggattacaggcaaagccatcacgcctggcctccacagatgttctgaggcacagcaggctagagaaccactgggaaaaagtactatcttggtgactatgtggctgctatttttggcaacaagatttggtgctaacagttcaggtaatcacagagccctggaactccagaaggattatttcccctggaatctctgcaatgccagggtttattttggtactgccttccttccctgacacccaccctctataaatcataaccaaggccaaccctggattctggggaaggtaggacaagaaatcccatgtatggggcaatcttaggactgccctatctgctgggaaatgccagggattgcaggtgtttcagaaccctccctctgaaggtctggcctaaagcttcactaatccactaacctggggtggagtggggacaaaagaattaactaaaagtattgctggaagtgaaaggtaatatattaggttgttatcaggctttaacttgccaagtgtaaatgtcagatcctttccctaaaatggcttttgtggaaagagaaagcctataattactggagactatggatactcaaacagggaatgagtggtcttggaaccaggaccctggggttatgactcaatgcctagttttgaagatttaactaagaatgagttcctttttttctgattagaattgttcgaggacaacagttctgaaatgaatgaagcaacagctagtgacctattcctaccacctcctagactctgtgaggaggggtggcagagggttcctagcccataaaagagtcataacagttcttaccatttcaggctgggtctgctgcccaccagaggcagagcgggaatgggagaagagaaggcatcactcagcacttggagggtccctgggaaggagggactctactgtgcttggttaggggagggatggtaattccaccagacgtttccagctgctgcaacaacaaaacccaaattgaggcctcatcctgtgatgtcagacctcccagagaagggccagaaggcatagtttttaataggctaacaggactttgtgaaggcttctataaaacaaagccaggcactcacatcagaggcagcacgggcggaggcagcccaccagacttctcaaatcacagtaccgaaaaccagccaccttttgtaacttattatttgccccctaattcaaactaaggtactttaatacagtgtgtcatcttgattatgccttgaggaccgccagcatcaactagttaggaagacagcctggcaacttaagcagacaggcttcttataagatgcattcgtctcctgtggctgctgcaatacattaccacaaactgggcggcttaaaacaacacagatttgtcctttcatagttctggaggctagaattttgaaatcgaggcgtaggcagggccaggcccccgtgacggctctagggaagaattcttccttgcctctttttagcttctgatggtggccggcaacccttggtgttccgtggcttatagctgcatcactctgatctctgcctccgtcttcacatggccttctctcctgtgtgtctctgtctcagtctctttgtctcttctcctcttctttttaggacacagttatattggattaagggcacaccctgctccattatgacctcatcttaattttatctgcaatggtcctagtttcagaaaaaaaaaaattaccctctcagttactgggggttaggacttcaacatatcttttgacgagacaaaattcaacccatgatacatggtgacaatttgctggcattcccaggcctcatgaagggatattttcctgggaacattgctggttctctttgcccatagtctttggttccctgtatttcccagctgaatccaaacaagtacctccttctagatactacatttttttttctggtaggatatacgtaacaaaaattttaccactttagccgtttttaattgtaaaattcagtggcattaggtacattcataatattgcacagccatcaccactaccctctgcctgttacttttcatttcccagcaaaagaagcttcaacatttacaagaaataggctgtgggaaggagaaataagaatcataagtgaccatcgaaatagtcaggcccaaaataactgtaggttgacttgtaacaaagatttggtaagagcaaacctcagctgtcagccactgctccattatatttacaattattcctttcttgtcttttaggttctacctcaagatgtttgaggactaccccaaatctcggaaagcccttattccattcatcttttaaaggaaccaaattaaaaaggagcagagctcccacaatgctgatgaaaactgtcaagctgctgaaactgtaattttcatgatataatagtcccgtatatattatatagatgtaatagtaggtctcctggcgttctgccagctggcctggggattctgagtggtgtctgcttagagtttactcctacccttccagggacccctatcctgatccccaactgaagcttcaaaaagccacttttccaaatggcgacagttgcttcttagctattgctctgagaaagtacaaacttctcctatgtctttcaccgggcaatccaagtacatgtggcttcatacccactccctgtcaatgcaggacaactctgtaatcaagaattttttgacttgaaggcagtacttatagaccttattaaaggtatgcattttatacatgtaacagagtagcagaaatttaaactctgaagccacaaagacccagagcaaacccactcccaaatgaaaaccccagtcatggcttcctttttcttggttaattaggaaagatgagaaattattaggtagaccttgaatacaggagccctctcctcatagtgctgaaaagatactgatgcattgacctcatttcaaatttgtgcagtgtcttagttgatgagtgcctctgttttccagaagatttcacaatccccggaaaactggtatggctattcttgaaggccaggttttaataaccacaaacaaaaaggcatgaacctgggtggcttatgagagagtagagaacaacatgaccctggatggctactaagaggatagagaacagttttacaatagacattgcaaactctcatgtttttggaaactagtggcaatatccaaataatgagtagtgtaaaacaaagagaattaatgatgaggttacatgctgcttgcctccaccagatgtccacaacaatatgaagtacagcagaagccccaagcaactttcctttcctggagcttcttccttgtagttctcaggacctgttcaagaaggtgtctcctaggggcagcctgaatgcctccctcaaaggacctgcaggcagagactgaaaattgcagacagaggggcacgtctgggcagaaaacctgttttgtttggctcagacatatagttttttttttttttacaaagtttcaaaaacttaaaaatcaggagattccttcataaaactctagcattctagtttcatttaaaaagttggaggatctgaacatacagagcccacatttccacaccagaactggaactacgtagctagtaagcatttgagtttgcaaactcttgtgaaggggtcaccccagcatgagtgctgagatatggactctctaaggaaggggccgaacgcttgtaattggaatacatggaaatatttgtcttctcaggcctatgtttgcggaatgcattgtcaatatttagcaaactgttttgacaaatgagcaccagtggtactaagcacagaaactcactatataagtcacataggaaacttgaaaggtctgaggatgatgtagattactgaaaaatgcaaattgcaatcatataaataagtgtttttgttgttcattaaatacctttaaatcatggatgttaagcagttttgtttgaattaaaatatcctgggacttctggagattttcacaaggtattggggtgtgcttccctgtcccgcctgtccctcattcccattcaccctgtctgtagtgtcgtttcctttcttctcttctctcttcatgaaattaggggctgtgtgctggaaataaagaagtatgacttatacagcctctcagccacaattcagaactacaaggaagtacaataaaggtgcaggaaaacgtcatgaggttagatgccactcctggtgctgaggaatacacagggggaatgaacacacttggtgaagtaaatcttcaggtgtagcttgagctctgtgacataaaagacttccagttctctccatgacattgaaaactaccttgcttaagtcctttattttactaccatgtaaaacatccaggccggtccttgagatgaaataaatatacaataaatggcagtactcagtctcaggacaaaaccgccatttggcaatttcactttttgccacaagagggcgctttctaaaatagtatttagtccaaccttgacttaattaggtccaaccccagtcctgttgcctgatcgtggacctttcaagttagcatgatcgtggaacttcttaatctgaatatagggtagagtagcgtgaactctatgaaagctgaaaccttcccttgataattcaggtattctcagtgttctagggctgttgtgttcaatgacagtttgtcattgtttagggctaggatatgtatgtggattaaatacagtaaaggtctgaacatgtgctcatctctaaacatatttcttcccacttttaaaaatagggtgcaacaaaattatagttaattgaggtttccatggactgttttttggctaaaataatctaacagtgtcctagctcacaagatactctatcttggtcttgctgaagctttcacggaagaggcgttttcctgccaaccttgaagaaaatgttgagttttgtttgtttttcagaatttagacttaaagagctgaagcagacctcagacatcagctattcctaccacttcacattataggtagtgacactgagacccacagagttaaaaggcctcctcacagctggtacagagctggtcagagcagccatctcattttgtccctttgagggtcagatgtatgcttcttctgcttaaggcacagcctttagggctgccatctggatttctacagagctcatgcaggagaaaaatagccagagcttaagtgctgttgcatagttcagtttatacacctattgtcccatgcctgtttgtgtgtgaggcttccctcgctccgtgggagcaccaggctcatgccctttcataaacctatttgacagaatagagagttttccctcattggtgtagtcaagacaacatgtgtgttcagcatggaaaaaaggtttcaggtcataaacccccttatccctaatgcttactttcataaagaacaacagtggctccactgtattctaaaaggaaaaaggagctctaatgagaaatacgcaattaaacagctatttaggcggcttagaccctttcaggaacaaataaataaatccgtggttttacaaccctgaagtttgataatagctctcttggatttttgtggttacctcatggcaatctcactaagaagcaggggagcaagctcttggcacatgaaggaataggctcatgaagattcatttcttttcccgcttggccttttggttctctaataagctgtgagctgaggtccatgcagggaaaacaaggagggtaacggcaaatgtaaagtgaatttttctggagaaggatgctgattattttatagcatctacactatcctatgatgaaagaggcatagagccgggtggcaatgtgagttcttgggtgatttaataagccatcgagtggatttaatttctaagtaagacatttgtttattctttgtacaagtccatggagttgtgatcttaa

SEQ ID NO: 13313 - DNA, 75212 bp, Human
ttacttaaacccaggagttagaggttccagtgagcgagatcgtgccactacattgcagcctgggtgacagagcaagactgtgtctcaaaataaagacaggaacaaaggtatcgataactcttaagtataggttaaattcccacaaaaatctagttttaaaaaatctttttttttttttttttttttaaaaacagagtctcactctgttgcccaggctgagtacagtgacgagatcttggctcactgcagcctctaattcctggactcaagccatccccccacctcagcctcctgagcatttgggactacagatgcatcccacctgcacccagctaattatttttttgtagagatagtgttttcctatgttgcccaggctggagactgatctgcaactcctggccttaagctctttattttttaagcaaatttgcactgttttcaattaatatgaatttgcatttcgctgatctcatgctagctgacaatgggctgaaggtgaggggaggagaaagatggacatggtacataaaagcatgtatgataaagtggaatgtcaccttggttaaaaatgtgtaatgatttgaatgatacaaatataagtagttaagggttattttgaacttgatacctttgctggaggaaaaattactttatgcatttttgatgaaaaatcattagaagaaaaaaaatggaatatttagaggaaagagtatcctgatgttaaaagtgaaaatgaaataggacattgagaaaatttttttatgtaaatgtgtatatggtaatgtattaattagcgttaggtatgtacacggatttttgccttctatatttctgaaaaccttctgtgaaaaggaagagttgaaatcataaagaattggctgatggaaattaaggtagacaggcaaatgggaatgtggcccccctaggagggtgaactctgagagacacagtcatccctgtaaataaggctgcgccaagatcaaaggagaggtctgaggctgggagtcaggagtcagccattcttttttttttttttttctgcaacctccacctcctgggttcaagcttttctcctgcctcagcctcctgagtagctgggattacagatgcgcgccaccacacccggctaatttttgtatttttagtagagatggggtttcgccatgttggtcaggctggtttcgaactcctgacctcgtgatccgcccgccttggcctcccaaagtgctgggattacaggcatgagccaccgctcctggctgagtctgcgatttcttgccagctctacccagttgtgtcatcttaagcaagtcactgaacttctctggattcccttctccttttgtaaaataagcatgttatctgtccgtcctgccttgggcattgtgataaggataagatgacattatagaattttgcaaaattaaaagcgctagacaaatgattttatgaaaatataaagattaggttgaatttggtcagcatagaaaaaggaatgttgagaacattccttaagattactcagctccctttgctggaaatcagaagtcattaagtatctttgtggttgaaaatgtttggtgtctcaggcggttctacttattgctaaagaggtctaccttgagcttatagtaaatttgtcagttagttgaaagtcgtgacaaattaatacattcctggtttacaaattggtcttataagtatttgattggtttaaatgaatttactaggatttaactaacaatggatgacctggtgaaatcctatttcagacctaatctgggagcctgcaagtgacaacagcctttgcggtccttagacagcttggcctggaggagaacacatgaaagaaaggtttgtttctgcttaatgtaatctatgaaagtgttttttataacagtataattgtagtgcacaaagttctgtttttctttcccttttcagaacctcaagaggctttgttttctgtgaaacagtatttctatacagttgctccaatgacagagttacctgcaccgttgtcctacttccagaatgcacagatgtctgaggacaaccacctgagcaatactgtacgtagccaggtacagtgtcagtctctgaaactgcctttgccagactggattcacttatcatctcccctcacctctgagaaatgctgagggggctaggcaggctttctctactttaccacatttataatatatttggtgaacttcagctgattgctggaggacacagggctgtttaacacataggtgttgatacagttcctacctaattcacatatcaccacctcagttgaagccttctccagcttcccaaggtgtgcagcgcctcatagttcatgttgtttattattttacctatcttgctcttattcttctacggctgagtccattttatttactgtattcattacctaacagttccttttagtgctcagtaaatattcattatgattgtacaatgcaaggataagtgtagaagttctaagggttcaaaggagggattcaggaaaagaacgtaatctgtgctgtcggacaaagagattcctcaccagctacatacacagacatgaaatttgactgcaactctactagctaatcatcataaagtgagagcagaggccaggcacggtggctcatgcctgtaatcccagcactttgggaggctgaggcgggcagatcacctgaggttaggagttcaataccagcttggccaacatggagaaaccccatctctactaacaatacaaaaattagccgggcttggtggcaggtgcctgtaatcccagctactcaggaggctgagccaggagaatcgctggaacccaggaggtggaggttacagtgagctgacgtcgcgccattgcactcgagcctgggcgacgagcgaaactccatctcaaaaataaataaataaacaataaataaatagagaaaaagaaagaaaagaaaagagagagagcatggatgtcctgtgagacagttggagtatctataggatttttagaggtggacccagaatagaggaaaacacaaggccaactataagctatccagttgcactaggtgtggggtcagattttcctctgttaggaccagagagcagagctaggaacagtggtggaagttaccaggcaataaggtctggatcaataaaaagaactttctcatagcctggcatggtggtgcatgcttgtagtcccagctactcaggaactcaggaggctgaggtacgaggattgcttgtctaagagtttgagtccagcatgggcaacatagagaggttctgtgtttttttttttttaattttcccacagttatggtacatctgggctgccttgtaggcttgtgtgtacatttcactacaaacagtcacaaaaggctggaaggccactccagcaagatctgtagaggattagtccgtgaattccgcagttgaactagagcactgaatggcgtggaacttccttttacactctgaagatttaggattcttcacttttcccatcagtaaaattaggtaatttactagataatttgaaaattctttcccagctgggaagttttgatgtgcccagaagctaggatgggcagttgtccaggtttgtttaaaactagaggttctagaacacaggactttcagttttaaaattgggacagtcctgagcagtaggatcaagtcagttgtctaccagagtataatcaaattgaaataattttggatctgactaaccaagtcttattcaattagttgacattgttgtttaacttcgagtactattacagttctatattgttatagttcaaatagaagataacatctaaagcatttctcattccaaaggttaaatcttgcctttagcttcatttcttcaactctaagcaaatactgtgacgagctgctatagcctggaaaatagttttccttttgtgggctgctgtgcataatctcattcatagtaaagggatttgaagtttgatgacagaatagtcagagagctgaagttgtgtttgtttttttagcccaaatatttatttctcaagtttttgttgtgaaatgtttctagcacatacagaaagtatggcacataatgtaataggcacccatgtacctatcacccagctttattaaaccttaacatcttatttgctgtttttttgataagctttttttgcttctattgcttattgatcctacactaaatgaaatcctaactaaacaaaacaagattttgcatttaatttgaaaagagactagttatatgacaaaaaattgcagataaaattgaagtgctcctcccccattctttttcctcttttctcaggatagttactgtcctgaattgggtatttaccatgtttaataaaattgagtattaggcttactataatatttatgtacataaatcgtatcgcattatgtaatacacttggcatgttttaaaactttaggctgggtgtggtggctcacgcctgtaatcccagcaatttgggaggccgaggctggtggatcacaaggtcaggagttcaagaccagcctggccaacatggtgaaaccctgtctctactaaaaaaaaatgcaaaatttagccaggcgtgatggcaggcacctgtaatcccagctactccagaaactgaggcagagaattgcttgaactctggaggtggaggttgcagtgagccaagattgcaccactgcactccagcttgggcaacagagtaagactctgtctcaaaaaaaaaaaaaaaaaaaaaaagccaggtgcggtggctcacgcctgtaatcccaacactttgggaggccgaggagggcggatcacgaggtcaagagacagaccatcctggtcaacatggtgaaaccccgtctctactaaaaaaatacaaaaattagctgggcgtggtgacacgcgcctgtagtcccagctacttgggaggctgaggcaggagaatggcatgaacctgggaggcggagcttgcagtgagccgagattgcaccactgcactccagcctgggcgacagagtgagactccatctaaaaaaaaaaacaaaaaaaaactttatgtggtttatgtctgaaagttgaagagaatttccacatatatgttagtatatgttgcaaaagagacattcctatgtagaattttgggcattcatgtatatgtagatgcatgtagctctagcatttgttttctcttgtgaatatataaaaataattctgtttacaaacatttggtaggttccagtttttcacaataactgacagtgctgcagtgacatactaattcattagtctgtgtgcacttgtgtgagtttctcaaagatagttgctgtgattggatatatggatcttagaactattttagagattgctaggattcttccaaagtgtatattgcaggccaggcatggtggttcacggctgtattacatctatctcagaaaaataagagaagaaaagcatgggtgatcttggtgatttccccctttcattttctaaatgttctataatacagttatttaataatttaaaaagctattttgaaaaagtaatctcacgctgtcaccaaagctggagtgcagtggtgcaatctaaactcactgcaacctcgacctccttgagaccagggtggtctcaagtgatcctgccacctcagcctcccaagtagctgggaccacaggctcatgccaccacacctggctaatttcttgtatttttggcagaaatgaggtttcaccgtgttgcacagtctggtcctgaactcctgagctcaagtgatccacatgtcttggcctcccaaagtgctgggattacaggtgtgagctactgcgcccaacctaaaatattttatatatatatatatattttttttttttttttttttttttttttttttttgagacggagtctcgctctgttgcccaggctggagtgcagtggcacgatctcggctcactgcaagttctgcatcccgggttcacgccattctcctgcctcagcctcccaagtagctgggactacaggcgcccgccaccatgcctggctaattttttgtatttttcatagaggcggggtttcaccgtgttagccaggatggtctcggatctcctgacctcgtgattcgcccgtctcggcctcccaaagtttttttatattttttaatgtgaggaaaggtcacaaaagaatagtatgctacctgaggaatatctctggaaagggatcaagcattcgaggttttctgtgatgactgactaaagtcatggagttagaacagctgatacaaaagaaaccaaaaaaggccaggcatggtggctcacacatgtaatcccagcactttgggaggccgaggcaggtggtcaggagtttgagaccagcctggccaacatggtgaaaccccatttctactaagaaaaaaaaaaaaaaaaagtcaatgggtgtggtggcatgtacctgtagtcccagctactcaggagactgaagcacgagaattgcttgaacccaggactcagaggttgcagtgagctgagattgtgccactgcaccccagtgcagtgtgacagagtgaggctgtctcaaaaaaagaaaaaaaaaacccacaaaagctcggtagcatgagatctttgagagcattcttatgttcttattggtaattggagtttatattatgcccttgtcatcaataatagcttcagttatgtttcttagtctccatttgaaaaaagaaatattcgctgggcatggtggctcacgcctgtaatcccagcactttgggaggccaaggtgggtggattacttgaggccaggagttccagaccagcctggccatcacggtgaaaccctgtctctattaaaaatacaaaaattagccaggtgtggtggtgcgcccttgtaatcccagctacctgggaggctgaagcaagaggattggtttcaaggttcacctgggaggtcaaagctgcattcagccaagatcacaccattgtactccagcctaggtgacaaagtgataccctgtctcaaataaatacatagacaaaaagcaaacctatgagctatttaaaggaccttgaggagaaaaaaaataaatgaaatgggtgatctaaatttaaatagaatctgcagctctggttagcctttgacagtgttgttgtatcattatagttatgaatttgttttctcagttgtgttaaagtggagtaaggcaaaaaagaacttgaaatctcaacgacctccagagaaacatgctagcttttgcatgagtaaaatctcttaggcacaaatattaataatatgttaagaaactttaggcttaagcctaacataacagccccataagtgttcagtattatctctaaccagttatgtcaactgtttgtggaaatgacagcctttcttggcattagaggaatggttaaacctctgactccagggaatcacaaagcttggtcagatgctgaatggaattatgtgtgttgttggaagcatgttccctatgattaataaatgttttcaagttttccacttaacttgccagttctttggttaagccactcttctagtcctgtcctacagagcaggcttagagccccacatttgtcattgtagaaattcaaacaatatccattaagtcatttttttttttttttgcccattaagtcttaaaggattaatacattttctttccttttttttttttttttgaaacggagcctccctctgtcgcccaggctggagttcagttgtgcgatctcggctcactgcagcctctgcctcccaggttcaagcgattctcctgccttagtctcccgagtagttgggattaacagggttgtgccaccacacctggctaattttagtattttagatagagatggggtttcaccatgttggtcaggctggtctcgaactcctgacctcaagtgatctgaccacctaggcctctcaaagtgttgggattacaggcatgaaccaccgtgcctgccaatacattttcttacaaatattaattattgaaaaaatgtattttaagtaaatattcagactataaatatatcagcataattgaatacattataaccacgtaggcatgttaactgcttacatgcgtgcatgaaatattaagggaaaagggcagaatataatatttgtaaacacaactatgtatacctgtgtgtatatattgaaaaacgttagcatttggggtgtcgtaaaaataagtttctgttttctttataaaattacctaaattcatattcaactacacacaattataaacttaattgcagagctaggtgtggtggctcatgtctgtattcctagtactttgggaggctgaggcaggaggatcccttgaggccaggagtttgagactagcttgggtaacatagcacgatcttgtctctacaaaaaaaaaaagtgaaaattagtggggtgtggtagtgtgcttctatggtcccagctacttgggaagctgaggcaggaggattgcttgagactaggaggtcgaggctgcagtgagctgtaatcatgccactgcacttcaacctgggcagcaaagtgagaccctgcctcaaaaaaagaaaaaaatgtgtggcaaaaactgccatgaacaaagtccaaaacaaactaggacaaaggcttgaaatatatgacagatatatcccaatatacatagaattcttatgaaattaaaaggaacatgaacaacttaactcagtagcaaaggttacaagcaatatttatggagtaagaaatagaaatggcaataaatatatgaaaagcctagttgatcagccttactaatagggataaaaattaaaacttcacttcttacctatcagtgagttaaaattgatacactgctgctgaggttgtagggaaataggctttcttgtatgctgtgttctttggagttaagttagtatttatttggaggcaagctcttaattgaatctacagatacacatgccttttggaaataatttagcaattaaatctaacctaatctgatctcacctagcatttcacttctgaaagtttatcctataaaaatattaccatagaagtgccaagaatttttattgaagttttatttataacagtgagaatgtggcagtaatctcaatctttatcattaattgcttatggtttacccagttagtagtgtaaaggtactagttaacagtagggtctcttgactaaacagttggactttgaatctccattctagaacttcttagcattatgatctttggcaaattaactggcctcgctaaacttcagtttctttatctgttaaatgaagtttatagcaattaacttagagttttatttaaattaaatgagataaactgaatgattagtacactacctagcacatacttgttcaataaatattaacatttcttatcaaaattgccatatttaagaatgaggtatatttatatgtctagcatagaatcaaatatatattatcattattattttttttttgagacagggtctccttctatcacccaggctggagtatagtggtgtgatcatagctcagtgcagcctgtaagtcctgggctcaagtgattctcccatctcagccttgtgaatagctgggagtacaggtgtgtgccaccatgcctggctaattttttttgctgttagtttcactttttttgtagagctggggtctcgttatgttgcccaggccggtcttgaactcctgggctcaagcgattctcccgtctcggcctcctgaagcatacagattttttagggcagtgaatctattctgtatgatactgtaatcatggaaacctgtcattatctgtttatacaaacccatagactgtataacaccaaaaagtgaaccctaaggtaaactgtggactgtcaatgtaggttcatctgttgtaacggtttaccacagtggtgcaggatgttgatagaggctgttggaggggttatgtgggaactccgtgtactttctgctcagttttgctgtggatctaagtttgcatttaaaaatattttatggcttggtggctcatacttgtaatcctagcactttggaaggctgaggcgggtggatcacttgagttcaggagtttgagaccagcctgggcaacatggtgaaaccccatctctatgaaataaaaaaaaaagtaaataatactaatagtaattaactgggtgtggtggcatgtgcctatagtcccaggtacttgggaggctgaggtcggaggatgacttgagcctgtgaagtggaagttgcagtgagcagtgatcatgccactgcactccagcctgggcaacacagccagactcggtctcaaaaaataataataataaaataaataatataaataaaaataatattttgaaagaaaagagctatcaagccacaaatgcaaaaggcttcaagttcctatcttttagaaatacatactaaaatatttatgaaggaaatgatatatctaagatttgcctcaaaataatactggagtggcaaagtgagcgggggagtagatgaaacaagattagcatgagttcataattattgaagttgaataaattgcacatgggcttcattgtacatttctgacagtatttgtttgaactttttccataataaaaagttttgtttgtttttttttttgagatggagtcttgctctgtcacccaggctggagtgcagtggcatgatctcggctcactgcaagctccgcctcccaggttcacgccattctcctgcctcagcctccagagtagctgcgactacaggcgtccgccaccatgcccagctaattttttgtaattttagtagagatggggtttcactgtgttagccaggatgatctcgatctcctgaccttgtgatccgcccgcctgggactcccaaagtgctgggattacaggcatgagccaccacgcctggccttttttttaaaatggtcttacaggtaataccatgcatgcttaagtcatcattctcatatttagctaccaagatttttcctttcggaaatccctcagtattctagtaccactttcctctcatttgacacttttcaaagcacctacacactcccttgagaaagatacctttttttttttttgcgagggagtttcactcttttgttgcccaggctggagtgcagtggcatgatcttggctcactgcaacgtctgcctcctgggttcaagcgattctcctgcctcagcctcctgagtagctgggattacaggcacgcaccaccacacccagctaatttttttgtatacttttttttttttaagtacagatggggtttcaccgtgttggccaggctgggctcaaacttctgacttcagatgatccgcctgcctcgatctcccaaagtgctgggattacaggcgtgagtcaccacgcccagcccaagaaagatacatttttaaaaacagctttattgtggtataattgacgtaaaatgtacatacttaaagtatacagtgtgatgttttgatatatatgtatactcttgaaaccaccaccacagttaaaataatgaaaatgtccattacctccagaagtttcttcatgttttgttgtaatctctccttctcctccctgattcctccccatccccaggcaaccatgttttgtcaccgcgcgcagccatttactattatgatactattttatataaatagtatcatacaggccgggcacggtggctcatgcctgtaatcccagcactttgggaggtcgaggtgggcgatgacttgaggccacctggccaacatgaaaccccttctctattaaaaatgcaaaaattagccaggggtggtggcgtgcacctgtaatctcagctcctcaggaggctgagacatgaggattgcttgaacccaggaggcagaggttgcagtgagctgagattgtgccactgcactccagcctgggcaacagagtgagtctctgtctaaaaaaaaaacaaaacatacagactcttgtctggcttctttctttcagcataattattttgaaattcgtccatgttatgtggttcctttttattgctgagttgtataccacagtttttgatctatttacttgttggtagatatttggattttcagttctgaagcattacagatagtggctgttacggatattcatgtacagatctttctttgtatgggcatatgctttaatttatcttgggcaaatacctaggagtagaatatgatccaatatggtaggtgtatatttaacttttttttctatctatctatctatctatctatctatctatctatctatctatctatctatttttaagacggagttttgctccatctggagcaaaggctggagtgcagtggcatgatcttggctcactgcaacctctgcctcctgggttcaagtgattctcctgtcccagcctccccagtagctgggattacaggcgcctgccaccacacccagctaatttttgtatttgtagtagaggctaggtttcttcatgttggccaggctggtcttgaactactgatctcaagtgatctgcctcggccccccaaagtgttgggattacaggcgtgagccatcacacctggccagtttttatttatattttttatagaagatggagtcttcctatgtttcacaggctgatcttgaactccaggcctcaagtgatcctcccgccttggcttcccaaagtgctgggattataggcatgagcctctatgcccagccttatatttaactttttaaggtactaccaaagaactttccaaactggttgtataattttacatttctaccagcagtatgagttccagttcctccacatcctgtcagtacttgatactgtcagtcttttaaattttttagctcttataaaaaggtatatagttacatctcattttggttttaatttacatttctctattgagtaatgatgttgagtttcttttcatgtgcttgtcatcctgatatctttggtgacttgtctgttcaaatctcttgcccatttaaaaattgctttcttaatggattttaagaattatttacatagtctggatacaagtcctctgtaatatatataatttgcaagtgttttctcccagactgtggcttttctttttattaacagtgctttttgaagggcagatttttttttttttttttaaagagacagagtcttgccctgtcacccaggctggagtatagtggtgtgattatagctcactgcagcctcaaactcctgagctcaaagaattcttctgcctcattcttccaaacagctaggactacagatgtgtgccactgcacccagctaattccgtttgtatttcattgattgtgtttttggtgtcacatcttaagaaactttggcctacttcaagttctcaggagttttttcctgcattttcttctggaagctttatagtttcatgttttacattaggtctgtgatccttttgaagttgattgttatacgtggtccaaggtatggatcaaagttcatttttctgcatatggatattcaattgtttcagcactgttttttaaaaaagactattttctccactgaagtgcctttgtacctttgcaaaaatcagttgtccatatatgtgtcaatctgttccatcagtcatgggtcaaaggctgttctcatggggaggcttttgaatttgaaaaactgaaactctatactcattggacaactttatacccattgaacaactccccattttccatttctctcagcccgtggcaatatgctttctgtttctataacatggactacttgagtttttttcttttttttgatgacaagatctcactccgttgcccaggctagagtgcagtggcatgatcttggctcatggcagccttcacctcctgggctcaagctgtcttcccacctcagcctcctgagtaactggaactacaggtgcactctatcatgcctcgctaattttttaatttttttgtagagacgagttctcgccatattggccaggctgatctcaaactcctgggctcaagtaatcctcccactttggcctcccaaaatacagagattatgggtgtgagccatcatgcccagctggctagatatttcatgtaagtggaatcatacattatttctcttttagtgacttgcttattttgcttagcataatgtcctcaaggttcatctatattgtagcatgtgacaagatttcctttttaagggctgaataatattctgtgttatgtatataccacatatctgtgagtagacatttgggttacttccacttcgtggctatactgaataatgctatggtgaaagtggctatgcacatatctgtttgaggtcttgtttgtaattcagttcgtttttatatatactcattggtatttatataaatgggattgctgggtcatatggtagtttaattttttgaggaacctccatattgttttccatggtggctgcaccattttacattcccaccaacaatgcatagtggttccaatttcttcacaactttaccaccgcttgttactttctgttttttggtagtggccatcctaacgggtgtagtttttttttgcatttttctaatgattagtgatgttgagcatcttttcttttttccccccatattacacagatgtagagcatcttttcatgtgcttgttggctatttgtatatcttctttgaagaaatatctgttcaagtcctttgcccatctaaaaaaatctgatgatttgtttttttccaattgtttaattgtaggactttttttttttttttttttttttgagatggagtctcgctctgtcgcccatcctggaatgcagtggcgcgatcttggctcactgcaagctccacctgccgggttcatgctattgtaggactttttaatgtattctggatattaatctcttaccagatatatgatttgctttttttttttttttttttcgatacaaggttttactgtgtcacccaggctggagtaaagtagtgatgtaatctgggctcactgcaacttccgcctcccaggctcaagcagtccttccacctcagcctcctgagtagctggaactataggcactcgccaccatacccacctaatttttgtattttttgtagagacggagtttcaccatgttgcccaggctggccttgaactcccaggctcaagcaatccacctgccttagcctcccaaactgctggggttgtagatgtgagctaccacacccagcctgatttgcagatattttctccagttctgtaggttgccttttcactctgatgactgcttcctgtggtgtgtagaaatttggtgtaggcccatttgtctatttttgtttttgttctttaatttctcttagcaatattttgtaagtttcattgtacaggatatttggggatctgtaagacaaccctcaggttcagtaatttgctagaaagactcaactcagagaatgttttatactcaaattatagtttagtacattgaaatgatatggattaaatttagcaacagaaaaagacacatagggcagggtccaggagacaccccaggctcaagctgtcaatagtcctctcccagtggagttgtgcacacagtgcttaatttttccagcaacagtgtatgacaacacacgtggaatattggcaaccagggaagctggctgagccttggtgtccgggtcacacatggctgacctcagttctctggccccttcagaggccaagctgatactgtgtgacacaaggccctcaccgtagatcacattattagcggaaacttgttggcatgacccaatgcctcatgtaaacagcgcagtggctgtttataggccgggcgcagtggctcacgcctgtaatcccagcactttgggaggctgaggcgggcggatcacctgaggtcaggagtttgagaccagcctggctaacatggcgaaaccccgtttccactaaaaaaaaaaaaaaaaaaaaaaaatagaaaaagaaaccaaaccaggtgtggtgataagtgcctgtaatcccagctactcgggagactgaggcaggagaatcactctaacctgggaggccaaggttgcagtgagccaagattgcgccactgcactccagcctgggcaacaggagcaaaactccatctcaaaaaaaaaaaaaagttaaatagaaaaaggacataaatgaaaaagcactcaaccatcctgataataagagaaatagatattaaatttatgccaagattccatatttctcccatcagattggtaaaaatctaagcacttgctaacataaggtgttagcaacagtgtggtaaagtaggcaatctcttgcattgctgattctctaaattggtgcaatccacagggagggcaatttggcatgctctcgttctctctctcgctcgctcgcgcgctctctctctctctctccatgagaaggagagagagagagagagagagcacgcgaacaagcgattgagtgagagagagagcacgtatctgcagtctcagctgctcaggaggctgaggtgggaggattgcttgagcctaggaggtcaacgctgtggtaagctgttgactatgccactgcactgcagcctagtgacagagaatctgtctcaaagataagaagaatgaggatattctttatgtactgatgtgtagaaaaatctctaagatacatagttaagtggagaaaacaaaatgctgcatggtgcatttactgtactaccatttgtgtgaaaagggggagtaagagtatgtgtttgtatttgcttgcatatgtagaaagaaactttgaaaggattcaccaaataacagtagtaagcagggggattaggaaactaggtatatattaagagggagcttttgtactctataccttttaatactttctttgagaccatgtgaatgttttacctatgtatttatttatttttaatttttgctttgcctgcttttaaacaaataaattgtactttttttgaagagctctatttttatttcctttcgattatcatctgtagattcttatgtcacattttactttaacagcacatttagacagaatacagtctttaaatggaagccgacaattgatttccctggaaaatttttgaagtacaataacatttgattgattgaactttatttagtaagaattcttagcaaaattccctcccaggcacacctacatggtgcttcattttcagtgaactacaaatctctgaaacccaaaactgcaatctaaaagtacaagatggctggactcgatggctcatgcctgtaatcccagcacttcgggaggccaaggcaggaggattgcttgagcccagaagttcaagaccagcttgggcaacatggtgaaactttgtctctacaaaaaattagccgagcttcacaaacaatcttacaggagtcattcattaattaactcaacaaatatttatagagtacaggagacactagagatccagcaaaggtcaataacatgtgctgtcttagagaaaacttatattctaagaatagtcaagtgacaaacaggagctacatcaaataatcacaagtacacttcagagaattaaaaccagatcaacgtagagaaaggcttccttacattcgatagtcaggaaattctctctctaccaggagggaactgagtgacaaggaacagtcaggtgggagaagggcattccagatgaaccagccctgagcggggaactagaaggccagtttgagaaaaggaatggagagaggaggaacagtttgtggtcagagcaaggaccaaaccattttagacttcatgagcctaagaagttttgattttgttatgagcatgacaagaagccattgtaatcgagttttaaacaaaggaatgacatgatctcattttgtttaaaaaaaaaaaatcatcctggctgtagtgtggagaatggactaggggagcataaaagcagaaagaccaattggaagcctattaacagtaatccaaatgatagataatagtggtttgaaccacaaagattatggacatagaaagaagcagatagatccaggagatgttttggaggtattctggcagaatttgctggctgactagacagaggtactaaggaaaagaatcaagaataattcctagattcgggacttcctagaaactgggagaatggtgctgctgtttattgagataaatggagaagacagaggagaagcttagaatagagttctaggagaggtcagagatggagatcaacatttgggagacagaattttctaattccatagtgccgacgattttctattgatagactaaaaatgtctggaattttatatgcagtttcatctggacaataccctaagaggagatcagttataccttggcacctgctaatagccataggaatatgtatatgtagaataaatggtaaaactactgaatgcttaatatgtgccagacaccgtgagatacgtctttgaagtactatcccagtagaatttacaacaaccctatcaggagatactttttttatcaccattttacagatgaagacactgaagttcaaagaggttaaataactcgccccaaatcacactatatagaagagaaatctaaatcctggtagtctgaccccagaacttgggctaattaccactatataatacagtgtcactggggtaaacccaagatatgataacataagttagagacttttaaattccaaatttcacacactatgatttcacccataaaatgtagtgattcagccatagtcttctgattagttggagtaccctatgcaatactttaggaacttgcttcttttattttcatatatatatatgttcattcataaattaaatctggacagccagtgaatctgccatttttgtctctaaccaacacttctgtcacaaaattgtacttttttttgtttttttttgagacggagtctcattctgtcacccaggttggagtacagtggcacgatcttggctcactgcaacctctgcttcccgggttcaaacgattcgcctgcctcagcctcccaagtagctgagattacaggtgcccgccaccacactggctaatttttgtatttttaatagagacagggtttcaccatgttggccaggctggtcttgaactcctgacctcgggtgatccgcccgcctcagcctcccagagtgctgggattacaggcatgagccaccacgcccggcccaaactgtgctttttttaaataaagaaattaaaacagtatttttttccttaaagatggtgtctcactacattccctggctcaaacgattctggctcaaacgaattcctaggctcaaacgattctcctgcgttagcctcctgagtacctgggactataggtatgtgccactattcctgaaaacataatcagttttgaaggtagtgtctgggctgggcgcagtggctcacgccttcaatcccagcactttgggaggccgaggtgggcggatcacctgaggtcaggagttcgagaccagcctgaccaacatggataagactccatctctactaaaaatacaaaaaattagccaggcatggtggcgcatgcctgtaatcccagctactcaggaggctgaggcaggagaattgcttgaacctaggaagcagaggctgtggtgagccgagatcgcaccattgcactccagcctgggcaacaagagtgaaactccgtcttaaaaaaaaaaaaaaaaaggtagtgtgtggccgggcgcggtggctcacgcctgtaatcccagcattttgtgaggccaaggtgggcggatcatgaggtcaggagttcgagaccagcctggccaacatggtgaaaccctgtctctactaaaaatacaaacattaagccggcgcagtggtggatgccgataatcccagctcctcgggaggctgacgcgggagaattgcttgaacctgagaggcagaggttgcagtgagccaagattgtgccactactaggcgacagaatgagactctgtctccaaaataataataataataataataaaataaaaataaaagtagtatccagcgtactacaaagaggaagagtttgtgaatgtgtatgttactgttaagttaaacagtgttctagtatccatctcattatcagccttgggcagggcagggttgagttggctaatgttcattataaaccagatcatccagttggggactctgaatgagcatatgattgcccctttcatgctagacttagctaattaaactgttcatatgacctaaaaggatggctgtggtgccatagaaagaaaacaagttttgaggcaagagactttagtttgattcctacctctgctgttttctggttgtgagatttttggatcagttgcttttgtgttcatttaccaaaacttctcaagacaaaaagaataaatgagataatgtgacagtgccttgtaaataccaaatactatatagagatagctattattacttgtatgtttattgtgaacattaatcagccaatcaagttgttcagacttgtactgctgaacatcaattgcagatataacattcttggcagatgacttagtcacctccttctgtggaagaatagaagatagacagctccttgctgtctatcacagtatgttctggtcccgttggcctcaccttccatataatcatttccattctactgggctttagccactctggtgacttgagttcagcaaaaataatctttcttgatgggtggtatatatatttctaccttttatgctttagaatagtttcctttccatttctcatagggtttggatcttcataactgtttgaagagaaatcctgacctccagactgaaggaaagcacaccatgcctttataacgccagcctcggtcttttttttgttcccctctgtcttagttccttttgtattgctataacagaataccgcagactgggtgatttatttatttatttattttgttgttgtcatttgttttcttcttttttgtatcttttgaaattcttttcattgttgttgttgttttgagactgggtgatttgtttattcagctcatggttcttgaggctggaaagcccaagagtatatggtaccagcacctgattatgccatggtggatagacagaacggcaagagagagcttgcttttgtaacaaagtcactcccatgataactaacctactcctgtgataacgacattgcaggttcagtatccctgatttgaaagtctgaaattcaaagtgctcccaaatctgaagctttctgagtatcaatgtgatgctcaaaggaaatgcttattggagtgttttagattttggatttttagatttggtatgttcaacctgtaagtataatggaaatattccaaaatgcaaaatctgaaacacttctggtcccaaacatttcagataaaggatactgaacctttaatccattcatgaaggcagagtcctcatgacccagtcacctcctaaaggcctcacctcttgatactaccacaatggcaaccaggtttccagtacatgaatttttagggggatcattcaaactatagcaccctcctttatcccttaccctattccattagttttaatccccactttgtctcttcctctaatcttcagtctacactgtgacatgataggtatgctcaagtctctaacagctctaaaataacgttttctgtttttttttttgtcttcatttctggtggggttggataagaaaagtttttcaagttaaatcactctctattgcaagcctcttccaccttttttttttttttttttgcttcgaagaatgattgcctttaccttctcagttctcagttattttccagcacattatgattttatgaccttgatacagaagggctgggctcctggctaaattccacccttaaacctggaactgcaaccctaagtgaaaacagctaaccccattttttttcccacccaaatgttgcctctttggcctgccatgcccctatcctgtgctcataaaaatatttcagctgggctgggtgcggtggctcactcctataatcccagcactttgggagaccgaggcaggtggatcacctggggtcaggagttcaagaccagcctggccaacatggcaaaaccgtatctctactaaaaatacaaaaattagttgggcatggtggtgggcaccataatcccagctacttgggaggatgaggcaggagaattgcttgaacctgggcggcggaggttacagtgagcccagattgtgccagtgcactccagcctgggcaaccgagtgagactctgtctcaaaaaaaaaaaaacaaaaacaaaaaagatttcagcagctgggagaacaatataagcagctgacgtcagggatataaatggctgtgtgttgggaatacaagcagctgattgtcggaaatacaagccactgagtgttggtgatacaagtggctgagcagcgagcagagaatcaggtgagcgttggagactatggatgggacgtggctaacttcagatggtgcagctttggagaataggcccagccggagatggcctggcttcagggaaagatcaccttcttcccataccatccctttttcaactccccattctgctgagaaccacttccatcgtgcaatacaatcttctgcatatactacccttcaatctgttcatgtgatctgattattcctggacactggaagagaacctgggtgccaagaggagagggcaggggctgccaccctgaccctccactgagctggctggcacctggccatccccgaatggccgcgttgaaggagcattgattgtaacacacttggatgctgctgcggggccgcatagagcctgcgcctgccagagaggagcaactggctggttcccgcattcgtttgctctgattcccacactcactcactcgcttgcacactgcctcttgcaaggggtttgagtgtgtggtggccgagtaaacgagccacgctccgagccatgagggggtcaagggaattatccagtctcatctcaatccgacttccctcttcactgttttacttttgtaaaacccttgatgaacttcccattgtcaattcagggtctttttagctctcatcctgccagactgttgataacacctctgatttgtgctccacttttggcttctgtgtcatattgattcctgagttttcttccttctcctctattctcttaatctcgttttctggttttctcccatcacctgctggttaagcttaggggttatttacacttctctccttggtcatctttttactgtatttttccctccacagctatttcatccatttctgaggcctgagatttcatccatttctgaggctatagagaccagtgacttcctctgactcttctgagcttgaaattcctattggtaactgccattggacttaactgcctggttatatctctaactaaagtacttctctcttccagcctgtttatcttattgtgttccattgtgttccttatctctaccaatgctagttccttatgctagaaatctcattcattgccactcaatcaagtttgctaaaaacgaaacatctgattgtgtcacttattcaaccttaccaatttttttttttttttgagccttgctttgtcacccatagtggcacgatctctgctcactgcagcctccaccacccaggttcaggtgattctcctgccgtagcctcatgagtagctgggattacaggcatgtgccaccatgcccgactaatttttatatttttagtagagacggggtttcaccatgttggccaggctggtctcaaactcctgacctcaagtgatctgcccaccttggcctcccaaagtgctgggatttcaggcgcctggcctgttacttgattatatgctaaacaaggggtggattattcatgagttttctgggaaagaggtgggcaattcccggaactgaggatccctcccctttttagaccatacaaggtaacttccggacgttgccatggcatctgtaaactgtcatggtgttggcggggagtgtcttttagcatgctaatgtattataattagcgtatagtgagcagtgaggataaccagaggtcactctcctcaccatcttggttttggtgggttttggccagcttctttattgcaaccagttttatcagcaagatctttatgagctgtatcttgtgctgacttcctatctcatcccgtaactaagagtacctaacctcctgcaaatgcagcccagtaggtcttggccttattttacccagcccctattcaagatagagttgctctggtccaaacgcctctgacacaaggattttaaagtcttattaattaaggtaagatagttccttgcatatgtggtctgaaatcacagaaagctgaatttgaaaaaggtgcttggagctgcagccagtaaacaagttttcatgcaggtgtcagtatttaaggtacatctcaaaggataagtacaattgtgtatgttgggatgaacagagagaatggagcaagccaagacccaggtaaaagagaggacctgaatgccttcagtgaacaatgatagataatctagacttttaaactgcatacttcctgtacattgttttttcttgcttcaggtttttagaactcatagtgacgggtctgttgttaatcccaggtctaaccgttaccttgattctgctgagaatctgatttactgaaaatgtttttcttgtgcttatagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctgtacgtatgagttttgttttattattctcaaagccagtgtggcttttctttacagcatgtcatcatcaccttgaaggcctctgcattgaaggggcatgacttagctggagagcccatcctctgtgatggtcaggagcagttgagagagcgaggggttattacttcatgttttaagtggagaaaaggaacactgcagaagtatgtttcctgtatggtattactggatagggctgaagttatgctgaattgaacacataaattcttttccacctcagggccattgggcgcccattgctcttctgcctagaatattctttccttttctaactttggtggattaaattcctgtcatccccctcctcttggtgttatatataaagttttggtgccgcaaaagaagtagcactcgaatataaaattttccttttaattctcagcaaggcaagttacttctatatagaagggtgcacccttacagatggaacaatggcaagcgcacatttggacaagggaggggaaagggttcttatccctgacacacgtggtccctgctgctgtgttcttcccctactgactagggttagactgcacaggctaaactaattccaattggctaatttaaagagaatgatggggtgagtgctttggcaggagtcagggaagagcaggtagcaggtaactggaatgagggtggagcaggtaatggaaaaacattgctttacgaggaagttaagtttaaaagtagaaggcaaagaattgaacatactggcgtattaattctttgaaatttagaactcacatctaacattggcttaaatgttaaatcctcaaagataacattcctgtttctcctaacacgattaagtccttcttggtatcttttctcatagcaacttgtcctttctcacttgtcacaatttgcaaatatatatttatttacattgtttatttaatgcctaatttccttctttattgcaaggcctgtgagggtactgagtctccagggtgaggtgtataataaatggccaaacgaattgttaattgaaaggatgaacaactaattcaagccagcactctctagactcctggggggctatcatgtgggttccctggtgctgctgatgtcagcccttggcctccaagaaaaatgcttgattcaaatgtcatctagttccatctctacgactctcatggggtccaaagaagagttttaattgagttttagaatttgaagttgtgaagtgtctgaaaaactacatggtgttctgaaagccaaacttttagccttttgggagagcatctaagacagcaggtgaagggcaggggttagaactagagggattgaagaatattatccatataggttagggttaggtttggcaacgtattatagaacaaacattggcaagctacagccacaggccagatctgtctgctacctttccacaaaggtgtaataacaaagttattcacaaatttgtgaataaactttcattggaaagtgaccacgctccttggtttatacattgtctgtggctgctttcacactacagtagcacagttgagtgtttgcactggagaccatatgacccatagagcttaaaatattcagtctggctttttacagagatgtttctgactttgttaatagaaaatcaaaacaactggtttaaataatgcacatactttctctctcatagagtagtgcagaggtaggcagtccagattagtacggtggcttcacgttcatcaaggactcaatctccttctttcttctttagcttctaacctctagcttacttcagggtccaggctggagccctagccttcattctgacagtaggaaggagtaggggagaaaagaacataggacatgtcagcagaattctctccttagaagttccatacacaacacatctccctagaagtcattgcccttacttgttctcatagccatcctaaatataagggagtcagaagtaaagtctttttggctgggaatattggcacctggaataaaaatgtttttctgtgaatgagaaacaaggggaagatggatatgtgacattatcttaagacaactccagttgcaattactctgcagatgagaggcactaattataagccatattacctttcttctgacaaccacttgtcagcccacgtggtttctgtggcagaatctggttctataacaagttcctaataagctgtagccaaaaaaatttgatgaggtattataattatttcaatataaagcacccactagatggagccagtgtctgcttcacatgttaagtccttctttccatatgttagacattttctttgaagcaattttagagtgtagctgtttttctcaggttaaaaattcttagctagattggtgagttggggaaaagtgacttataagatacgaattgaattaagaaaaagaaaattctgtgttggaggtggtaatgtggttggtgatctccattaacactgacctagggcttttgtgtttgttttattgtagaatctataccccattcacagaagataccgagactgtgggccagagagccctgcactcaattctgaatgctgccatcatgatcagtgtcattgttgtcatgactatcctcctggtggttctgtataaatacaggtgctataaggtgagcatgagacacagatctttgctttccaccctgttcttcttatggttgggtattcttgtcacagtaacttaactgatctaggaaagaaaaaatgttttgtcttctagagataagttaatttttagttttcttcctcctcactgtggaacattcaaaaaatacaaaaaggaagccaggtgcatgtgtaatgccaggctcagaggctgaggcaggaggatcgcttgggcccaggagttcacaagcagcttgggcaacgtagcaagaccctgcctctattaaagaaaacaaaaaacaaatattggaagtattttatatgcatggaatctatatgtcatgaaaaaattagtgtaaaatatatatattatgattagttatcaagatttagtgataatttatgttattttggatttcaatgcctttttaggccattgtctcaaaaaataaaagcagaaaacaaaaaaagttgtaactgaaaaataaacatttccatataatagcacaatctaagtgggtttttgtttgtttgtttgtttgttgaagcagggccttgccctgtcacccaggctggagtgaagtgcagtggcacgattttggctcactgcagactcaacccaccagtttcaagcgattctcctgcctctgcctcccaaatagctgggattacaggtgtgtgccaccacactcggctaatttttgtatttttagtagagacagggtttcaccatgttgaccacactggtctcgaactcctggcctcaagtgatctgcccaccttggtctcccaaagtgctgggattacaggcatgagccactgcgcccggccctaagtggttttaatattttgattgacagtatactgaagaaatatactctaagacctttatgaatctcctcattcacaaataacactgtaggatataatggtccctataaaatacggtataactaaaatcagatttttatattggagtacagaacaataaagccatcttcagatgctggtattaaactcactggtgactggtcacaccttgcctaaactggtagccaccatgcatcctctcaccatctccactgtactacttccttccttgggaagtcgggcgctgggaggttgtacaggaaagatacagacccacccttctcagcctctcctcccctagctcgctcttttgccaaagtgacctactgctgagtttcaaagtgacctactgctgagtttcagccaactagcacgtttcagattcataccttagaaaaaattacacattatcacaagtcatgcaccttttaaggtcattttcaaataatagaaattataagtgttcggccaggcatggtggctcatgcctgtaatcccagcactttgggaggccaaggcaggaggattgcttgaggtcaggagttttttttgtttttttgtttttttccccgagacgaagtctcgctcttgtcccgcaggctggagtgtgacagcgcgatcttggctcactgcaagctgtgcctcctgggttcaagcgattcttctgcctcagccccccgagtagctgggattacaggcgcctgccaccacacccggctaatttttgtatttttagtagagactgggttttaccgtgttggccaggctggtctagaactcctgacctcaggtgatccacccacctcggcctcgcaagggctgggattacaggcgtgagccaccatacctggccgaggtcaggggtttgagaccagcctgagcaacatagtaagacctatctctaccaaaaaaaaaaaaaattaactttccaaatgtaggagtctactctgtttccttctagtatttatttctgtatacttttctaacatggttaaaatgtgtaatcaatatgtgtccttttactttggtgtgaacattttttctattataaattcttagaaaatatttctatggctatgagatatttgattcaagtgccttgtaatttacttctcaaatgtccctgatgttggacatttgtttctagtgtttcactattttaaaaaacagtaatatctgtctttatgcttagagctttttcagtttttcaaattatttccttagggtaaaatcctagaagtagaatttttggggcaaattatctacatatttataactgtcttggtattcaaaatctcgttttcaaaaagcttatatcaatttgtacttaacaccagtagtgaatgagagtatctgtcgtaccccaccagtgctgaatttcttttttaaaactgtgctggtttttataggtaaagaaaatgtcttaatttgcatttagttggttactagtaatatcacataccttttcaatgcttgtgaactttaagcttatacagagtttaaccttgcatgttgaacatttgagtgagtggaagtgttaagtgatggccatctgtataatctattagtaatgtatggagaccattaaagatgacaggtatgtgtgatgatgacaggttgttaccaacactcagaaggccaaaaagcaagtgatataaacccatgctgggaagcattcacctcccccactttaaaaatgctagtttcttaattccttttctttatccctttttttgtctgcacgtgtttacttgcctttagtttccctgctttagtaggctgaccttgtgacttttaccaggatcccattatacttttgttcttctgtttatttctcagattttattggagggtggaattctactttttctttcttataatctagaatttacattcagatttcctgcctttcccttacaaaatacctgtgtagttggataggtggagctctggactcagagttctttcttctagtaatcttaggaaattatttaatttttctgtgttttcatattttcacacataaaagagaaaacaccatttctaaactacctcttcttttctctgcttttaagcatgtaaaggttttcccaatcttgggcagtgacatgtacaggacagtatagctttacatctgccttgttttaattaaacactagttctttgaggtaacccctactattatcccagttttatggatgaggcactgaggcaggggtcacacagctagtgtgggtcagaacctaatgggtcagaatggacatttgagtccagagtttggcctggattgacacacatagctattacgtaagattcctctcaaattcagtcctcagctccctgaagtgtgggttctcttttcatgcctccatggaaactgcgtatcatgtggttaccagtttttcctttggtcgtatctgctgacctttttgaacctaattttttctggaccttattgccatttgacttatttattgcctcccacttgacactgattctggcttttgcttttcttcctactttggtcctttttgcagttttctaaagctaaccagccatgactctcagatgatggactttttcgtctctcccattacttcttgggaaattatattttaatctcatggtttaaattttcatccttaaatataacttttaatgtagtatttttagcccagaagggcccatggttggtttgttttctcctttgcatatctcttctactcagatacctggtagcatataaatcaaatgaattatccttcataccatttcattatcatcagtaggactgctttgctggggtttttttgtgtgtgtgtttttgtttttgtttttgtttttgttttgagataaagtcttgctttgtcacctaggcaagagtgctaggattacaggcgtgagccgctatgccaggacagccgttttcttctagtattatttgccctctgtctgaacatcttcctttagtaatgcttttagagcaaggcagctggcctcaatttgttttaatttttcttccccttaggatgttttaattttacctttattactgaaggatattgttactgggcagaaaattgtcttgatattccccttttcagcatttaaaaaatgctcttctgctttctttcagcctccatggtttctcataaaaatcagtcattcgaatcactgttcttctaaaagtaatacattgttttgttctggtcactttcaaaattttctttttcttttcagcagtttaattatgggactgtgtgaggatttctttgttcattctgtttggagttcactgagctttttgaatctctaggtttatgtcttttaccaaatttggaaaatttttcaaccattatttcttcaaaatttttctgtaccacattctttactctttttttttttgaaacagagtggcgcactgcaacctctgccttcccggttcaagtgattctcctgcctcagcctcccaaagtgctgggattacgggtgcctgccaccatgcctggctgattttgttaatttttagtagagacggggttttaccacattgaccaggctggtcttgaactcctggccttaagtattccgcctgcctgggcctcccaaagtgctgggttacaggtgtgagccaccacacccggcccttttttttttttttttttgagaccgagtctcgctttgtcacccaggctggagtgcagtgatgtgattttggctcactgcagcctcagcctcccaagtacctgggattacagagatgtgccaccatgcccagctaatttttgtatttttattagagatggggtttcaccatgttggccaggctggtcttaaacccctggcctcaagtgatccgtctgcctcagcctcccaaagtgctgggattacagacgtgagccaccatgcctggctctttaccctcttctgggagtgacaacacaaataactttttattccacaggtttctgaggctctgtttattttccaatttttttcactattgttctggttagataatttctattgatctgtcttcaagtttcctgaaatttgcattttgttggtaaacctattcagtaaaatgtttttggttattttatttttagttctaaaattcctatatagcccgtctttacatttttttattctgaaacttaaaactttcctttcattttaagagtgtttgcccttacttcttggagcatttttatgctccaaggattttgatatttttgttttattggccaattgatctgattgggctaggtccagccagccttgtcaaagcctttgcagtgttgctcagatctgccccatgtatatgccacccagtcaccagtctgggactggtatagtggtgttctatttgtaattcggttgtcagggtcggtgtgtactgttgaggatcatatccatactcactcaccttgggaatggacccacaagtttataaacagctttaagagattgctttcatgagtttctttctttctgtgatctccatgtggtttcttgggcttcccttttccattcctgcagccaaaagtggactttatcttcctaaagtcagggccaaaatgtgggaggagagagagaaataaagcaagggctatttgccccactctctcgggactgacattcttccagtcagagtaaggattccctccctctgaattttaggcttctgccacccacattaccatcaccacaggattgtgtgaggactgggcatacgagaatggagaaaagcggaaaagaatgccgggtgtggtggctcacgcctgtaatcctaacactttgggaggccaaggcgggcagattgcctgagctcatgagtttatgaccagcctgggcaacacagtgaaaacctgtctctactaaaatacaaaaaattagccaggcatggtggtgggcacctgtagttccagttactcaggaggctgaggcaggagtattgcttgaacccgggaggcagaggttgcagtgagccaagatcgtgccactgcactccagcctgagctacagtgcgagactctgtctccaaaaaaaaggaagaaaaactggatttttacactgtctgggtgttaggagacctctttcctgatcctcaagccagaactagaggtcttctggagctcccattgtcttgctaatgcccactcatgttgtaatgagcacaggtggaggaaaaaaagtggtcagctcactgctagtacttctaattccccagcccacctacctctcattacttttcatcttttgcaaccagctgctgcctgctttctgcccaggttttgtaactgtattcagtgggatagagagagtggaaggtacttactccatcttatctggaacctttcttaatatattttttgtcgcatttgtacatcttttatccatccttcattttattttatttttttttttgagacggagtctcagtctctcgcccaggctggagtgtagtggcatgatcttggctcactgcaacctccgcctcctgggttcaagtgattctcctgcctcagcctcccaagtagttgggattactgggacacgccaccatgcctgggtaatttttgcatttttagtagagatgagggttccccatgttgcccaggctggtctcgaacttctgacctcaggtgatccactggtttcggcctcccaaagtgctgggactacaggcctgagccaccacgcccagccttatccttcattttagacagtttaagaggtttgtattcagccagatctccacatttacttgttcatttgtgttgtgatgttttttaatgttcaagtcttagcacacacaaacaattatatagaaacaagttgtttactttgacacccagtataactaaaaggatcttttgagtcagagattgagtaacttgccagagcctgtttggaaataaaccctgaggatttttcatatcagtggttggttatgcaatgtctgtggcaagccctagaaactaaaagaccaaaccttaaaatgttaaaaacaggaaaggcagttaattattatacataatttgttataaaaggaactataacttattaaagtcagatgatttctggccttgatagtttagggtttagagaagatactgttgtgtactataaaacagcagggctgttttctttcataccctttagcacaggaaagctgaactagggatttttgcaagatgagaaaggcctgttgaaatgtgtgtgtataacatagtaataaaagaaatgcatatgaaaataacaaattaacatatttgacatattgactttgtcaagattagtcttttttgtcaagtaactaagccagtgtgtattaattaaatcagtaattagaaaaagtttgtacactttgatttagtaattttgcttttatgatatattctaaagaaggaattagaaatgcagaaaaatatttgtgaagtaggatgttcattttaatgtaaattaaaattggggaaagaaagggaaaacaatacagattccatgcataaggcaaaggttcaattgtgggtttatccgtatgagtagactattattttgtcatttaaaaatcatagtttcagctgggcgtggtggctcacgcatgtaatcccagcactttaggaggctgaggtgggcggatcacctgaggtcagaagatcgagaccagcctgaccaacatggagaaatcctgtctctactaaaaatacaaaaaaattagctgggcgtggtggcgagtgcctgtaatcccagctactcaggaggctgaggcaggagaatcgcttgaatctggggagtggaggttgcggtgagattgcgccattgccctccagcctgggcaacaagagcaaaactccatctcaaaatcaatcaatcaatcagtcaatcaatcatagtttcacgccaggtgcagtggcacggacctgtagacccagttacttgggaccctgagacgagatgattgcttgagcccaggttttccagtctagcctgggaaacatagtgagaccccagtctcttaaaaaaaaatcatattttcaaataatatttggtggcatgagaatatgtttgtaataaaagattacatttgtgaaagcagaatgtaaacagtacactagttgattctcactgttaaggtctttacacacgcctatacgtgcagatagaaaacatgtctgaaagggaaacggttttattttgtttcgtatttttttttgagacaatgtctcactttgtcagtcaggctggaatgtagtggcactgtctcggctcactgcaccctatacctcctgggttcaagcaatcctcccacctcaacctccatggtagctgggactacaggcacctgccaccacgcctagctaatgttcgtatttttagtagagacggggttttggcatgttggtcaggctggtcttgaactcctgacctcaggcaatccacctgtctcagcctcccaaactgctgggataacaggcgtgagccactgtgcctggcctgaaagggaaatgttggtattaattttggttgtcactggcctttagaatagttttcttcttttagtgtttctgtgtttcttaagtgttacaagcatatgttacttttgattcagaaaaatgctatttttaaaataagcaagactgggcacggtgactctcaccagtatggctgagaccagaggatcacttgaagccaggagttcaaaaccagcttgggcaacagagtgagacccccacctctacaaaaagaaaaaaaaaaaattaaaaaattagccaggcatggtggtgtacccacgcctatagtcctaggtactagggaggctgaggtgggagtatggcttgagcccagtggttcgagattgcagtgagctacgatcatgccactgtaccccagcctgggcaacacagtgaggccctatctcaaaaaataattaaaaaaaaaatatttgggggctcctagaaggtacagttaaaaaaattaaaattaggccgggcatggtggctcacgcctataatcccagcactgtgggaggctaaggagggtggatcacttgagatcaggagttcaagaccagcttggccaacatggtgaaacttcatctctaatacaaaaatcacctgggcgttggtggtgggtgcctgtaatcccagctactcgggaggctaaggcaggagaattgcttgaatctgggaggtggaggttgcagtgagccaagaccatgctactgcactccagcctgggcgacaaagtgaggcttcatctcccaaaaataaataaataaaattaaaaaaagaaataaataagaacatctccttcttcctttgccaaaaaaccgaggtgaaaagcatctctcaagaatgatgagaatttcaattatttaatatttactctggtccttaatttaaagcttaatatggaatcccagtgtacatctcccactggtattgtttgtcttggccaagacagacaagttttaaagagtgagataaaatttaggctaaagttgaagtatttggagggaaatgtacagatgttctcagcttaccttttttgtttttttgagatggagtctcgctctgttgctcaggctggagtgcaatggtgcgatctcagctctccacaacctccgcctctcaggttgaagtgattctcctgcctcagcctcccaaatagctgggactgcaggtgtgtgccactatgtctggctaatttttgtatttttttttttaatttattttttattgataattcttgggtgtttctcacagagggggatttggcagggtcataggacaatagtggagggaaggtcagtagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaaacacatcttgcaccgcccttaatccattcaaccctgagtggacacagcacatgtttcagagagcacagggttgggggtaaggtcacagatcaacaggatcccaaggcagaagaagttttcttagtacagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggtgcccctcacctcccgggcggggcggctggccgggcggggggctgacccccccacctccctcccggacggggcggctggccgggcagaggggctcctcacttcccagtaggggcggccgggcagaggcgcccctcacctcccggacggggcggctggccaggcggggggctgatccccccacctccctcccagacggggcggctggccgggcggggggctgacccccccccacctccctcccggacggggcggctggccggccggggggctgaccccccccacctccctcccggacggggcggctggccgggcggggggctgacccccccacctccctcccggacggggcggctggccgggcggggggctgacccccccacctcccgtcccggacggggcggctggccgggcagaggcgcccctcacctcccggacggggcggctggccgggcggggggctgacccccccacctccctctccgacggggcggctggcctggcagaggggctcctcacttcccagtaggggcggccgggcagaggcgcccctcacctcccggacggggcggctggccgggcggggggctgacccccccacctccctctcggagagggcggctggcctggcagaggggctcctcacttcccagtaggggcggccgggcagaggcgcccctcacctcccggacggggcggctggccgggcggggggctgacccccccacctccctcccggacggagcggctggcggggcggggggctgacccccccacctccctcccggatggggcggctggcctggcggggggctgaccccccccacctccctcccggacggggtggctgccgggcggagacgctcctcacttcccagacggggcggctgccgggcggaggggctcctcacttcccagacggggcggctgccgggcggaggggctcctcacttctcagacggggcggccgggcagagatgctcctcacctcccagacggggtcgcggccgggcagaggtgctcctcacatcccagacggggcggcggggcagaggcgctccccacatctcagacgatgggcggccgggcagagacgctcctcacttcctagatgtgatggcagccgggcagaggtgctcctcacttcctaggtgggatggcggccgggcggagacgctcctcactttccagactgggcagccaggcagaggggctcctcacatcccagatgatgggcggccaggcagagacgctcctcacttcccagacggggtggcggccgggcagaggctacaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggtggatcacttgcggttaggggctggagaccggcctggccaacacagcgaaaccccgtctccaccaaaaccagtcaggcgtggcggcgtgagtctgcaatcgcaggcactcggcaggctgagtcaggagaatcaggcagggaggttgcagtgagccgagatggcagcagtacagtccagcttcggctcagcatgagagggagaccgtggaaagagagggagagggagaccgtggggagagagagggagagggagagggagagcgcttaaaacaatttttaagatgtatttcttttctcatagttccagaggccagaagtcccaagtcaagggttggaagcaatttttgtatttttagtagagatggggttcaccatattggccaggctggtcttgaactcctggcctcatgatccgcctgccgtggcctcccaaagtgctgggattacaggcatgagtcactgcgcccgatctctcagtttactttgatatgtattaataataacaaagactaatggatgaggagctagacagaaattttataaaccaagtactgcaaaatatgaatggtagactctaggtgatatatgggtgttcactgtaaaattaattaaattttgctgtgtgttcgaacatttttgtaacaaaatgttggaaaatttttgtggaagaacaccagaaacaactttgttgtatctggatataatttagaatattcaaatgttggctaggtgcggtggcaacctgtaatcctagcactttgggaggccaaggcaggtggatcacctcaggtcgggagttcgagaccagcctgaccaacatggagaaactgtgtctctactaaaaatacagaattagccaggtgtggtggcacatgtctgtaatcccagctacttggggggctgaggcaggagaattgcttgaaccctggaggcggaggttgcggtgagccgagattgcgccattgcactccattctgggcaacaagagcgaaactccgtctcagaaaaaaaaaaagaatattcaaatgtccaaggagtaccaatatctaggtaaagccattctgttggcctttgccaaattgtactattttataaagttgttttaaagagagatgtgggccgggcatagtggtgcacatctgtaatctcagcactttgggagtctgaggcgggcggatcacttgaggtcaggaatttgagaccagcctgggcaacatggcgaaaccctgtctctactaaaaatacaaaaattagcctagcgtggtggcgcgcacgcgtggttccacctactcaggaggcttaagcacgagaattgcttgaacccaggaggcagaggttgtggtgagctgagatcgtgccactgcactccagtctgggcgacaaagtgagaccctgtctcaaaaaagaaaaaaaaaatctgtactttttaagggttgtgggacctgttaattatattgaaatgctttcttttctaggtcatccatgcctggcttattatatcatctctattgttgctgttctttttttcattcatttacttggggtaagttgtgaaatttttggtctgtctttcagaattaactacctttgtgctgtgtagctatcatttaaagccatgtactttgttgatgaattactctgaagttttaattgtttccacatataggtcatacttggtatataaaagactagtcagtattactaattgagacattcttctgttgctccttgcttataataagtagaactgaaagaacttaagactacagttaattctaagcctttttgaagattatatagtcttctagtagaagtctgtgcatcagaatgttttaagaaagggttttaagaatgtataaaaaccaaaataattgattttcatacttctatattgttttttatcagtgactcttttttctttcaaatgaaatcttatatgaaattttcatatataatatagaaaaaagtggatctagtctgtcaaagagaatagtgaagctcagagatgtgccagcctggcctttttctcagctcaagtggcagaatacagtttgtaaacaattgcactagctcttaaattcgaagaggcagtcaaactaataaataaattggagagttatttctttggtagaggattaagggaaataaccacagacagaagaagcaaatatgagaatctatgtgaaatggatgatattctagaaaaaaaattatcaaaactgacccctaaagagagaatatctaaacagagtaaagaagaggtacagaaagttactgaagaagtttccaccccacctgcacaaataacaatagtaccaggccccagtggattaatggggaaattctgttaaacctttaaggaatggtaactctaatactaagtgttccgaacatataaaaagaaaaaaagcttccagattaattttatgaagccagcataacattaataactaaagccctgcaagttatcaagtaaaagaaaactattggtcggttatatttattgatttcaaaagcataacagaatattaagagaattcagcaatagatgaaaagaataatactttttttttttgagtctcacgctgttgcccaggctggagtgcagtggcatgatctcggctcactgcaacccccacctcctggattcaagcgattctcctgcctcagccccctgagtaaccgggactacaggtgcgcaccaccatgcccagctaatttttgcatttttagtagagacagagtttcaccatgttggccaggatggtctcgatctcctgacctcgtgatccgcccgccttggcctcccaaagtgctggaattaacaggcctgagccaccgcaccctgccataataatacatttgaccaagtggagtttgtttgcagaatcgttcattataagttgccatattactagatcatcatctctgtatgtgctaaaaggcatttgataagattcctgttcttgatcagattccttaataaatagacggggtcgggtgtggtggctcatgtttataatctcaatactctgggaggctaaggtaggaggatagcttgaggttgaaagttggataccaacctgcgcaacataacaagactttgcctctacaaaaaataaattagccagttgtggtgtgtgcatgtagttctagctgcatgggagactaaggcgggaggatggcttcagcccaggaattcaaggctgcagtgagctatgattgcaccactgcaccccaggctgggtgactcagtctctaaaaataaataaataactaaatctctaacattataaaatgtatgcatctcattctaaaggccaatgtcatcctcatagggaagctagaagcttgcctattaaggtcaggaatgagatggaggttttcttttctttcttttgtttgtttgttttttgttttgttttttctgagatagagtctcactctgtcatccaggctggagtgcaatggtgtgatctcggctcacaggaacttctgcctcctgggttcaagcgattctcctgcatcaaggcctcccaagtagctgggattacaggcacctgccactatgcccggctaatttttgcatttttagtagagcaggggtttcaccatgttggccaggctgttctcaaactcttgacctcaggtgatccacctgcctccgcctcccaaaatgctgggattacaggcgtgagccactgtgcctggctgagatgaaggttttctttatcaccaattatctagcattgctctggagggactagcaaacacaattaaacaggagaaagaaatacgaactatataatttggaaaagaaggttaaattaccaatatttggagataaaatgattgtttactttgttttagaactaactgaaaaccaattcaaattactaagtaagtttggtaaggcaattaattgattacaaaattaaacaaaagtcccctgtctgggtgccgtggctcatgcctgtaatcccagcactttgggaggccgaggcgggtggttcacctgaggttaggagtttgagaccagcctggccaacgtggtgaaaacccacctctactaaaaatacaaaaaattagccgggcgtggtggtgggtgcctgtaattccagctactctggaggctgaggcaggagagtggcgtgaacctgggagatggaggttgctgtgagccgagatcgcaccattgcactcccacctgggcaacaagagtgaaactccatttcaaaaaaataaagtgaaaacacaaatcaataaccttcacataaacaactagttagaaaacataataaaaggataagtcccatttatgatagcagcaaaaaagattaaatatctacgagtaaacaagaattgtgcaagccctggacactggtgaagcagagatgccagctgaggtcctgcccccagctccccttaagctgagcagtgtggagaacatcttgcacaggctgctgactgccttccaagaagcccttgacctttaccatgtgttggtctcccttgaccgggtgggcactgagcagtagcaggtgtagactgagctggcctctaacttcctttggatccacagccagttgtaggccaacaacggggtggaggggtctgatgtggctccaggccctctccagctcaggttacccctccttatgtacattgtactcagagctgctagtgcaggctgtgcagaggaaggcaggggacactgaggtccagcagtccctgctcctgcttctgaagaaatagatattttaagtgaataaactgacagcttagaggggtaaaaaagataatatgcaagatctattgagaattttaaggctgggtgtggtggctcacacttgtaatctcacctatttgggaggccgaggtgggaggatcctttgagcccaggggttctagaccatcctgggcaacatggttgaaactccatctctacaaaaaatacaaaacttagccaggcgtggtggtgcatgcctgtagccccagctgcttgggaggctgagtcaggaggatcacttgagccaaggactttggggctgcagtgaactgtggttgtgccctctatccagggtgacagtcagaccttgtctctatttaaaaaaaaaaaaaaaaaaaattaaaatatgctatcatttgtgtcaagtagaaaagtatatatatgacatgtatagactttctggaaggatgtacatgaaattaatagtagtgctttccaatcaggcacggtggctcacacctgtaatctcaacatttttggaggtggagacaggaggactgcttgagcctaggagttcatagccagcctgggcaacatagcaagaccccatctcaagaaaaagtagtgctttcctctaaagaggggaaccatggggcacagtggggagaaaacctacttttcacagtatctgttgtgaattttatatcttattcatgtgttacctggccaaagattaataaatagattgtttttgtttttgttttttagtttgaggatactggaaatgcttaatataaatatctacatcgtccagaaatttcaatgtttactctattttggaatttcaaagtgggagaggaatcatctttttggatggtacctgaaactgaaagtttatgcctaaaggcgtgcttgctttctcctcagttacctcaggcatcttctacagttgcaatctctttgttgttagatggtggattttgcctccccagaattaaaatagcattttcttcattataaaaatacttaacattcattgtttttttaaaaaagacattatataagattataaagaagaaaaatgaccagattcccaccacctaaagataagtcctgtcatcctttcaggaattaatatatcaatttctcatctactcttctctcacactactttgcataaatgggatcataaatgggatcctatattttttcaagcaacagtgtgttatgcctatactccatgtttatatgtgtgtattaaaaaatgtatttgtatatatgtgtatgtataagtgtgtgtgtgtgtatgatgattcttctcccgctttgaaggtgaaagaaagcacacctttatttaagcataaactttgggtttcagatactgtctggaaaaatgatttatctcccactttgaaattccaaaatacgtacatatattttttttttcttttcttttttagttttagggtcttgctgtgttgcccaggctggagtgcagtagtgtgatcatagctcacacagcctctaactcccaggctcaagctatcttcctgccccagcctcctgagtagctgggactgcaggcatgtgccatcaactttagctaattttaaaatttttttgtagtgatagagtctcactgtgttgcccaggctcgtctggaattcctggcctcaagtgatcctctcacctcagcctcccaaattgctgggattagagtgtgagccactgtgcctagcctgcatatatctatttttaatgactgctaaatctcattgtatgaaaatttatgtcctagctataaaatttgttagcacatgtttaattttttctaatttcagatgttttaaactaatatttcccaaagtatagtatggcattttaggtatgatatgatcttttttcctcttcgtactcatttttatagttatggcctgtgcaactggtttcccatttatatgaatgatacagagcttcctattaagaaaaagttcagcttgggaaaaaaaaagtgaattgttcaacttgagggaaaaaagtgaattaattggccaggcaccgtggctcatgcttgtaatcccagcactttgggaggctgagacgggtggattgcttgaacccaggagttttagaccaacctgggcaacatgttgaaaccctatctgtacaaaaaaaattagaaaaattagctgggcatagtggcacacacctgttgtcccagctacttaggaggctgagctgggaagaccacctgatctccggaggtaaagactgcagtgagccgtgattgcaccactttactccagcctgggcaacaaaatgagaccctggctcaaaaacaaaaacaaaaacaaaaaaagagtaaattaatttaaagggaagtattaaataaataatagcacagttgatataggttatggtaaaattataaaggtgggatattaatatctaatgtttgggagccatcacattattctaaataatgttttggtgaaaattattgtacatcttttaaaatctgtgtaattttttttcagggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatggtaaaacccaagactgataatttgtttgtcacaggaatgccccactggagtgttttctttcctcatctctttatcttgatttagagaaaatggtaacgtgtacatcccataactcttcagtaaatcattaattagctatagtaactttttcatttgaagatttcggctgggcatggtagctcatgcctgtaatcttagcactttgggaggctgaggcgggcagatcacctaagcccagagttcaagaccagcctgggcaacatggcaaaacctcgtatctacagaaaatacaaaaattagccgggcatggtggtgcacacctgtagttccagctacttaggaggctgaggtgggaggatcgattgagcccaggaggtcaaggctgcagtgagccatgattgcatcactgtattccagcctgggtgatagaacaagaccttgtctcaaaaaaaatttggtttttcaagctttttgaggttttgacaagctggccaatatggtgaaaccccgtctctactaaaaatacaaaaattagctgggtgtggtggcgtacccttgtattcccagctacttgagaggctgaggcaggagaattatttgaacccaggaagtgaagtggaggttgcagtgagccgagatggtgccactgcactctagcctgggtgacagagcgagactctgtctcaaaaaaaaaaaaaaagcaaaaaaaaaaaagcacaagcagagtggtagacacacaaaatgctcaattcattttttaaacgatttttttcctttatatcttactgcagaagcttttttcttttttttgagacaaagtcttgctgtgtcacccaggctggggtgcagtggcacagtcatagctcactgcaaccttgaactccctggctcatgcgatcctcccacttcagcctctcaagtagctagaactacaggtgtgcaccaccatgcctgactaacttgtttattttttgtagagagaacgtcttgctatattgcctaggctggtcttgaactcttgggctcaagcaatcctcctaccttggcctctcaaggtattgggattataggtgtgagccactgcatctggcctcaattcacttttaaaatcaaaattaggttacctactttttataaggtaatgtatagaattattcttttaaaaataaaaccgatttggacagtgtgagattcacattctgtaaccaccagtgtgacatgggtcctgaacagttagaacatactccagccattaacccaggcagctttcaggtacgtactctgtggctgttgccttgtatgaaagccaaaaagagatccattttcagagattaatatgtgaccccttctatattataaggccatggccatactcttttttttttctttttgtttttttcttccaaagacaggatctctctctgtcatccacgctagagtacagtggcatgaacgtggcttactgcagcctcaaacccttgtcctgggctcaaacaatcctcccacctcagccttcaaagtagatagaactacaggcatgcactaccatgcctaattttttaaaaaaaaattttttttcagagatgagatctcactgtgtttcccaggcttgtccggaactcctggcctcaagcgatcctcccaccttggcctgccaaagtgttgggattacaggcatgagccaccatgcctggccatacacttttttttttttttttttcaagacggagtctggctctgtcgcccagactggagtgcagtggcgtgatcttggctcactgcaagcttcgcctcccaggttcatgccgttctcctgcctcagcctcccaagtagctgggactacaggcatctgccaccacgcccggctatttttttgtatttgtagtagagacggggtttcaccatgttagccaggatgatctcgatctcctgacctcatgattcacctgcctcggcctcccaaagtgttgggattacaggcatgagccaccgtgcccggcctggccatacacttttgtcattatttacatacttactaaaatgtttggtggcctgtaataggaaacatcatcctcatttgattgacgaagaagtctgtggaaataggattgaactggttctgttcttgtatttgagtaatcagttgtggaactatagaagtcatatactctctctgactttcataattaccttatgttgtatagtacttgatggtttgcaaagtaaccatctattcttgcttagctgtgagtaagaatgccaggtctggagacagaatgtctgggttcaaattctactcatcactttttatttttattttttttgagatagagtctcgctttgttgcccaggctggagtgcagtggcgtgatctcagctcactacaacctctccctcccgggatcaagcgattctcctgcctcagccttccgagtagctgggactacaagtgcgcaccaccacgcccagctaatttttgtatttttagtagagacgaggttttgccatgttggccaggctggtctcaaactcctgacctcaagtgatctgcctgcctcagcctcccagagtgctgggattacaggcttgagccactgcgcccagcctactcatcacttactagctatttgaccacacaagttactcaactcctatgtcagttatgaagattaaattaaatgatccatttaatacaataatacacttagaacaatgtctatcagtaaatttttttctgttttaagaaacaggatctcactctgtctcccaggctggagtgaagtggcacgattatagctcactgtagcttcaaaagcctgggctcaagcagtcctcctgtctcagcctcccgagtagataagactacaggcacaggttggtgttgacctcctagcctcaagcagcctcccaaagtgctgagattacaggtgtgagccactatacccagcccagtgttatatttttgtataatcctatgaagtatcaaggcagttattatccctgttttactgctaagaaacttgaagtttacagaggtaaattatttgcctaagcctaaactctgatctcgaatctgaatcccaagtccaatattcttttcaccgtattacaatatttttaccatcaaccctccattctgtctgcacatcatacaaatgagtatctctacagagctttgagttgcttttaaacaaaagagatttttgtacccaatgtttagagtagtgattctcggctccatttttacaagatttcaagatttaatttgtcaaaaaagttctgaaattttcaaagcaaaagcaattttaatttaattgctctaaaaaataagcagatttatcatttagcaattctttaagggagagtgtatcataaaactgaaatagtactgaatgtggcagaatcaaacaagttgaaaatctcatcacttcagagcagggcagacttctcattcaaacaaattgaggtagaagtggtgagagtagagatttctttgtgtatgtgtgttttattactgtactatattatattatagttctatatatactatattatattgtacatatatattattatatgaagagacatgaccactttgaggcatgaaatttttttttttttttttttttttttgaggcacggtcttactttgtcacctaggcagtggcgccatcttggctcactgcagcctccacctccagggctcaagcaatcctcccacctcagcttcctgagtagctgggactataggcacctgccaccatgagctgctaattttttgtatttttggtagagacggggttttgccatcttggccaggctggtctcaaactcctgagcacaagtgatctgctgcctcagcctccccaaagtgctggaattacaagcataagccactgtgcctggcaagacatgaaatttttaaatgtaaatgcatttaagtgacaataatgtgaatacaagttatcaattcttcctttacaagtttagctatacctgttttatatttttcagtgtttaaaattatttttatatttttatattctgaattttctttctttctttcttttttttttttttttttgagacggagtctcgctgtattgcccaggctggagtgcagtggcgcaatctcggcgcactgcaagctccgcttcccgggttcacgccgttctcctgcctcagcctcccgagtagctgggactacaggcacgcgccaccacacccagctaattttttgtattttttagtagagacagggtttcaccgtgttagccaggatggtcttgatctcctgaccttgtgatccgcccacctcggcctcccaaagtgctgggattgcaggcgtgagccactgcgcccggcctatatgctgaattttcatgacagagaatgaaagaaaaagtgcagttgatcgaaagaaatggtggtataaacaggaataacaggcatgttgtttcctctctgatttattatttttgtaaaataagctacttttcagcaccacatacatatgttctgagacctgaatatttgtgaccaaagagtaaagaagtaataaactttatctcgcaaagagttattattgtgttttatttaaatttactgccctcttacttcaagtacttctcagtagtacgtaatactgcttttaaaaaggagaagggatgaatttcttctactctgctcttcatattttgaaaagttcagtcaaatcccctttattaaattcatctcagagtaatctttttaatttgtagttcatatccgtgattagtttagaagtgacttctccctgtttctgctcactgtaggttgacaactgcttaaaatagtctatctcatcattatctctgcagctttcctttaaactaggaagacttgttcctataccccagtaacgatacactgtacactaagcaaatagcagtcaaacccaaatgaaatttttacagatgttctgtgtcattttattttgtttatgttgtctcccccacccccaccagttcacctgccatttatttcatattcattcaacgtctttttgtgtaaaaagagacaaaaaacattaaacttttttccttcgttaattcctccctaccacccatttacaagtttagcccatacattttattagatgtcttttatgtttttctttttctagatttagtggctgttttgtgtccgaaaggtccacttcgtatgctggttgaaacagctcaggagagaaatgaaacgctttttccagctctcatttactcctgtaagtatttgagaaggatattgaattagtaatcagtgtagaatttatcggaactgaagcacatgtaactatggtcattttcatggtacttgttctcatcttaaatgcacagcattcctggaactcctgcagatctctttgtttccttgcaagcaattgtcttctacctgatgttgattcaagagagttttcaatatgaatagaaagaaagaaaatgtttagatattggggaaccagcattcccattttaaaacctgttaggagttgttgattagggcaagctcaaggattcctttgagtgactggtttagatgtctttctgctattcggtgaccactggggaactgagattgttgagcagaagggtaatgtgagcagagccgtgcctttgtaagctggcagcactgtgtgagatgaattggtgggttggatactgagatcatgagaggcatactaagcataattaagatgatattgccatgatctaggtggaaagtaatgggggtttgaattatggtagtggcagtagcaatcaagggaaagagttgatcagaggattcagaggtagaatcaatagttctagcaactgaggagagaagttgtaagcttgaaggaaaggtgatgaagaaaaaatgctttcctgtgttttcttgttgttgttgttgagatagggtctcactcccatccaggatggagtacagtagtgtgatcatggctcactgcagcctcgacctcccaggctcaggtgatccacccacctcagcctcccgagtagctgtgactacaggcacgcactaccaggcctggctaatttttttgtgttgtgtgtagagactgggttttgccatgtgcccaggctggtcttgaactcctcggcttaagcgatcctcctgccttgacttcacaaagtgcttgagttacaggtgtgagctaccacgcctggccatgttttcttgtgtgaaggatctgtttagttttatatctttctgtggctcatatctaatttagttgacagtacctgtgggtcactaggtagacattgctagcagacgtttagaaatgaaatactagagcttgggaaaaagttgatatttgagatagagacttgaagaacattagcagagagttggtagttaaggtctgtgagctggtgagcaattcaaataaaagcagaagagaagaggaagacaagggtcaaactttgtcaactactgtgtttagagaatgagacaagagaggatactacaggaagtagaggaaaatagtggaaaattgggcaagccagtatttttcacttaagaatatcattactgttttttgatgtcagcacatgaaatggctgcatagtgttctcttacgtagatattcagtggtgggtatcctcattgatagacatttagatcatttccatttattttctatcacagacagcacttacagagtgcatccatgaacttatgaatattattataaaatgtattcttacagtagaattgctaagtcaaaggatgtatttaaattttgatagtttgccatattgcctcctaaaaaagctgtgcctgtttacattcccttcagtaatatgaaagtatcaatttccttacccctttggtgttttggtttgttttgttttggagactgagtctcgctctgtcatgcaggctggagtgcagtggtgcgatctcggctcactgcaacctccgcctcctgggttcaagcagttctcctgcctcagcctccggagtggctgggattacaggcgtgtgccaccacacccagctaattttttgtatttttagtggagacacggtttcaccatgttgaccaggctggtctcgaactcctgacttcaggtgatccgcctgcctaggcctcccaaaatgccaggattatagctgtgagccaccatgcccggccactgctttgttaatgcttgcctgtgtctgtgcatacatgcatgtgtgtgtgtctgagagagaaagagatctaataggcaaaaaaataacatcttgttttattttttattgtttgtctaatgctttgggtgattatttgaactttttttcatgtgtttcttagttacagatctgaatttattttgtaactggcttggtataatctttttcatatttgtgaaattaatcttttttgtgtgtgtgtgagacagtctctctctgtcacccaagctggagtacagtggcgcaatctcaactcactgcaacctccatctcccaggttcaagcaattctcctctctcagcctcccaagtagctggaattacaggcgcatgccaccacgcctggctgatttttgtatttttagtagagacgggatttcaccacgttggccaggctggtctcaagtgatccaactgcctcagactcccaaagcattagtattacaggtgtgagccactgctcccagccctgtaaaattaatcttaattatacaagtaattcattatccttgaaaaaggataaacattacagataaaaataaatttcacggtaactatcatctctaatcttaatgccttatcaagtacttacccctgttgtcagtttgttgtatatccttgtagattttttttgccaatttttctgttgagttactggaaaagcagtttcaagaaggagagaggctgggcgtggtggctaacacctgtaatcccagcactttgggaggcctaggtgggcggatcacttgaggtcaggagtttgaaaccagcctggccaacatggtgaaactctgtctttactaaaaatataaaaatcagctgggtgtggtggtgcacacttgtaatcccagttacttgggaggctgaggtgggaggatcacttgaacccaggaggcggaggttacagtgagccatgatcgtgccactgcactccagcctgagtgacagcaaggcttcatccccaccctcccaaaaaaagagaatatctttttgtttgtttgtttgtttgtttgtttgtttgtggcagagtcttgctgtgtcgcccaggctggagttcagtggggcgatctcggctcactgcaagctccgcctcctgggttcagccattctcctgcctcagcctccccagcagctgggactacaggcacacgccgccacgcccggctaatttttgtatttttagtagcaacggggtttcaccatgttagccaggatggtctcgatctcctgaccttgtgatccgcccgcctcggcctcccaaagtgctgggattacaggcgtgagccaccgcgcctggccgagaatatcattttttataaagaagtcaaaggtaatgaggactaagtaaaaccatacagtatttgctgtctaagatgtcattagtgacattgaagagagcagtttcagtagagtgatagaaccagaagcagtactccaaagggaaggtgcgtatgtgtgcatgcatgtctctgtgttttgccagtgctggcagtggaagtgatggtgtaggcagagaatgggtggtgaagaaggagaggtatagtaaatgtcatgtactacatcaaagattcctgtctcacaggcagagcaggtggtgacctgacaggagaacaggtttcaggaaaggtgtttcaaggagagggaaggttccattttattttatttatttattttttttgaaacagagtcttgctctgttgctcgggctagagtgcagtggtgtgatcttggctcactgcaacccccgcctcccaagttcaagcaatggtcctgtctcagcctccggagtagctgggattataggcacccaccaccacatccggctaatgtttgtatttttagtagagttggggtttcgccacattggccaggctggccttgaactccccacctcaagtgatccacctgcctcggcctcccaaagtgctgggattacagacgtgagccactgcacccgacctgttttattttatttttgaggtaagtcttgctctgttgcccaggctggagtgcagtggcgcaatctcagctcactgcaacctccatctcctgggttcaggcaattctcctgcctcagcctcccgagtagttgagattacaagcatgcgccactatacctggctaatttttttttttccatatttttagttgagccacaggttgggagaagggaaaatacattctactcaaagtgagtccgtggcaaaagtgtgagtacagagatgggtgaggaattaggaccagactttcagtctgcagcaacattaaacatgtatgttaatttaatactcagaaagaagcatttactctgttttaaaatatctatcacatactatatatatatatatatatatatatatatatattttttttttttttttttttttttttttttttgagacagtcttgctctgtcacccaggctggagtgcagtagcgtgatctcgactcactgcaagctccacctccccgggttcacgccattctcctgcctcagcctcccgagtagctgggactctaggcgcccgccaccatgcctggctaattttttgtatttttagtagagacggggtttcaccgtgttagccaggattgtctcgatctcttgacctcgtaatctgccctcctcggcctcccaaagtgctgggattacaggcgtgagccaccgtgcccagcctatcatatataatatttttaaaactcaacgtctgtgctcgctttagcagcacataatagtaaaattggaatgatacagatgatttgcatgtatttttttaaaagttctcaagtctatttaataaccacagaatatgagacattctgagatgttttagaaacagttcaacatatgtgggaaaataggagtataaacccttacctcctgtgtagatcaggtaggttcaagattgcatctgttcttttgtaatactaaatgtctggtgaagatttgaggattttatataaatcattgagtttgagaggtttttttgtttttgtttttgagatggagtttcactcttgttgcccaggctgaagtgcaatggcacaatctcggctcactgcaacctccgcctcccaggttcaagcgattctcctgcctcggcctcctgagtagctgggattacagacgcctgccaccacgcccagctaattttttgtatttttgtatttttagtagagagagggtttcaccatgttggccaggctggtctcaaacttgtgacctcaggtgatctacccgcctcaccctcccaaagtgctgggattacaggcatgagccaccgcacctggccttcgttttgttttttcaacagaatgtaagaattttttcttacatttttcttacatttttaacagaatgtaagaaaaccacaacgcaatgccgatgagtactttttccctgaagtggatataagcatgaatataaaaagttttaaatcagtcatcctggctatttgttctctaaaaatcaataaataattctttcatgcattttaatactgtctcccagttaagggtattcagtttgcaaaatgctcttactgacaggaaatgtatgagcatttttgttttttacttctgtcgtttgacagaaaaaatatacacctactctttgagctaatttattcttacctagtggtcattagtagaagtggttcactctgggagcttaactagaagggaaactaacaattccttgaggtagatcattttatctaaagctttttgatttcatatcagttgggggcgggtatattatgttaatttttaaatctgcatattttccagccaggcatgactataatcccaggactttgggaggtagaagcaggaggattgcttgagcccaggaattcaagaccaccctagactacattaaaaaacatatttttttgtatttattttttattttatttttttgagacagagtttcgctctcattgcccaggctggagtgcaatggcacgatctcggctcaccacagcctccgcctcctggattcaagcaattctcctgcctcagcctcccgagtcgccgggattatagacatgcaccaccacaccgggctaattttgtatttttagtagagacagggtttctccatgttggtcaggctggtcttgaactcctgacctcaggtgatccacccacctccgactcccaaagtgctgggattacaggtgtgagccaccatgcctggcctttttttttttttttaatttaaacgaaatctgcttattttcctgttgatgtaaggtgtttgtgttaaggtgaaatgaaaagtgatttttaaaaaaatattattttaggactatttaacaaatatactatttatgataattaacatggggttagcaaactactgcttgaagccaaatatggcccatggcttgtttttgtacagcttataagctaaaaatgctttttacatttaaaaaaaaaaaaaaagaacaaggaagaatatgtgacacacaaaacctgaaatgtttactccctggccatttacagaaaaagttagctggacattgattttcatgttactattaactgctaaaacaaaggagcttgtagctatattttttcatacttgcataaagaaagaaaacctaataaatcgctggtggcttcatttccaaaaggctatggaaatccataaacaggctgggtgcagtggctcatgcctgtaatcctagcactttgggaggctgaggcgggaggattgcttgagcccaggagtttgagtctggcctgggcaacgtagtgagaccctgtttttagaaaaaatgaagataaaaaactaatccataaacctcatacttggtggttgcccttcagtttttcttctttagatctggatttagttaaacagtgtattgcctgcctggtttctgttaacttttgatcatttggttgggttatcctataatgaaacttggttgacctcagaaataacaaggtggtcgttcagcttctttgattgtgtgtttctttcataagttcttcaagaagcctgagtattagaaacatggataaaattattgtgataaaaagccagagagacataaatgtcaagtatcttgtttaaaattactgtgaccaggccgggcgtggtggctcacgcctgtaatcccagcactttgggaggctgaggcgggcggatcacgaggtcaggagatcgagaccatcctggctaacacagtgaaaccccacctctactaaaaaaaatacaaaaaattagccaggcatggtggcgggcgcctgtagtcccagctactcgggaggctgaggcaggagaatggcgtgaacccaggagacagagcttgcagtgagccgagatcatgccactgtactccagcctgggtgacagagcaagactctgtctcaaaaaaaaaaaaaaaaaaaaaaattactgtgaccagattggactcagcttgctgctggcatttggttcccaccataacctcatatgtcatgtgtttgcttatatgtacttttgtgttattgttggtgtatcttcaggataagttccaaaatgtaatattgctgggttaaaggattaatgcacatgtagttttattagatgttaccaaatttccctccagtggggattataccatttttcattcctgcctgaaatatatgagagaagcaccattttaaagttttcacaatgtctctgaactaaaatgtggtagagatgcacatgtgtatatctagatctagattgatatattgatatacatgtatttttgtagaaggggcacagaggaggcctcttgactatccctattatgtttattgcttttaacgttttttctcacgccgggtttaaaacatggtttagcattattgaacattctaaaaatgagacataatatgaaggaaatttactctgtgcatcttttgaattataatcaccatctgaggcttttgtgagctccagtttgtcctggaatttagaacattcaactagtccagctattgtttcagtggaatcttgctggcctgaacagttttccttctggttacttttcagggactaaaaatgatgaagagttttgtgatagcaggtgcagtttgagtactacagtaaacattcagtttcagaacttcttctcttacctgctaaaaccaaagagaaccttttttttatttttacttctgattgttgaacagtcttaaggcagcattaggaagactggcgatttgtgtggagaaatgatggcttgttgttgtctatgcatactttgtgtgtccagtgcttacctggaattttgtctttcccaacagcaacaatggtgtggttggtgaatatggcagaaggagacccggaagctcaaaggagagtatccaaaaattccaagtataatgcagaaagtaggtaacttttattagataatatcttgatttttcagggtcactgttataagctaacagtatagcaatgtttttatcgtctttctttggtcatagactcctttgagaatctcttgagaactatgataatgcccagtaaatacacagataagtatttaaggagttcagatactcaaaacccaacaatacagtcaaagcatcctaggttaagacacctcccattaaatacagaataccagcatggaaaggttcaggctgaggttatgattttgtttttgttttttgtttgttttttataagtcatgattttaaaaagaaaaaataaactctctccaaacatgtaaaagtaagaatctcctaaaagaaacaaaaaagaaacagacaataaaggaaaaataagtaaacaaaaaaagcaaaatataaacaacataaaaatgagaacctcttgtctaacatggccagaataactgaaatatgatttgagatgtgctgatgtgtatactgagaagatcaaatattctaggtggatatgactttttagaagaggataagaatgacttaggatgagctgggtgcagtgatgtgtgcctgtagtcccagctacatggccaaggcaagaggatcacttgagctaaggagttccggattaccctgggcaacttataccttacctcaaaaataataataataatgaataataataatgacttaggataagagagtgaaaggccctctaaggatactacagaacatattaaggagaacacaagttagaagttgttattagatggagttgagggggagctttcattcagttttctggaatggaggctaccttcccacacacactaaaaaaaaaaagaaagggttgaggaataacagcacaatataaatagtctaaaaaaagggctaacttttatgaggaatctgaaaaacaacaggcacagtaaatattggtgaggaaaaaaaggccttaattgagttgctgtttgtcaggaaagggagagtttatgttttataaagccaggaaatctacagagttagcatttaggcaactgcaaggaagatactttcaaccaggaattcctatttggaactcagagatgtgagtctttattatacagtaagcaaggcagcagaacaaggtcatgttagactctcacgggatccttagggtgtgactttgctagccagaaacctctgtggctggtggcaccttttcctgagatttgctcaggcccactgggctcattccacctactcagcctagctggctatgcttggctttctctaccagctggaccccatgcctgccaaaggcaagccaggcatggagcagcgaggagtgcatgagcaagtgagtgcagggtccagccactgcacacagccaggcatgctggctgcagcagggcaggcagcctcaggtactagctccctgctgcagctagaccaggcattacctaagcagctttgactacaggccactaccactagtaaacctgatagaaaagtaagaaatatactggaaagaattgccacaagcctggctcttgtgttaaccttgtgttaacctggggaacacaggggcacccagaagcttggagatgccaggaactgcagaaccccaaagaggggggtcatagccctggcttagggaactcctgagtctggactccccgaagggccacatctcttcactcctctcttctctccttctcgccacctgcaacgtggcaagtggggggcacgtttcagccctgtttgtcttacggttctttcaatcctgccattcaatgggtcccaagttcttgtcctgcatccaggaagaatgaagtacgtggacagctggagggagagcaagatgaaaaggtgctttattgagcaacagtacagctctcaggagaccctatctgcaggcaggtcgtcccattgtctctgcagctctcagtggagaggagacctggagtgggtagctcctgtctgcaggcaggtcatcctgatgtctgtaatcctcagtggagaggagacccggaatgggtatctcctatccacaagcaggtcatcccatcatctctgcagccctcagtggagaggagacccggagtgggtagcttctttctgcaggcaggttgtcccttcatctgcccaagtctgactgagtctggggtttttatgggcttcagaggggaggaagtacatgctgatgggtccatgggtggccatgagcaggcccagaaaatgcaccataagttctcactgtggtctgtggaactgggagcttggcctccaggcttcaggctttccctgacttgaggtggtgcttcaccagggaacttcccctttccgcctaggagcctgtctgcctcctgctgccatcaacctgctgtctatagctcccatggcacccaggctgttcatgccaaagggtgcctgcaggcccacggtaagctgccttcagcccctcctcagtctccctcccatgcttgtcagcacccaaagtccagagggggccaaggtggcagggggctggcatgtcagtgctgccccaagcgcccgcacacccggccaggtcatgacagcacccagcctcagccacaactttgctctgaaatcggagcctgcagacgcaaggggcttcctggacccctgagagcacagggatgcccaggtctacagccacagctgggaagctgcagctgtgggagtgcgggacttctgccccaccaactcagaagggggcaggactcccgcctgttcctggctcctgccagctcacagagcatgctgccccagctgcacctcccctgctgcagctgccatctttgcagcagccactccagatgggccgctgctgccatcaagaccactagtaaacctgatagaaaagtaagaaatatactggaaagaattgccacaagcctggctcttgtgttaacctgtgttaagctaaagaaaatcaaatgattgtctgtgagcatgtaggtatatatgtatgtgagtgagtgatacaacagaatttcattcattttacagatgttgactgagcacctgactatgtgctaggccctggggatatagcactgaacaagatttcccctgcccttgtggagcttatagtctatttggagagatagatggtcaacaaattattacataaataattcatacagttgtgataggtactacaaagaagacgtataagttgctatgaaagtttataataggggaattttacgtatcctggaaagtcaaggggtgcttccctgaggaagtggtaataggggacggcccgctgaaggatggaggaagagctttccaagagagggacaacatgagcaagggctttgaaatgagaaggctggatgaactgcaggcttcctcagtgagaatgctgctggtattttggggggcacagttctttgtgggactttccctcatattgcaagatatttaacatccctggcccctcacccactaaatgccaataatggctttaaggctttgcaataatcaaaaactcctccatcctagttatttccaaacactccccggaagggaggtgctatccctagttgaaaaatcactgtgttaacggaactagaagttacattggaacaaaagggcatagggctccaagagggatatctgtgtaaggaaaaaacaaacaaaagaactgagagattacctgatgtggttgagctctgtcagagcatttcaggataaattagtcatagataataatataaaattcatcagtggaaaaaaatgaggcagttttccaaagaaaacaaaaacttgctcaaaaaagcaaatgtaattatagtatattctggctatagcaaagtagtttagttgtgaatattatttgcatagtgagaatataaagctgaatttaatataaggttatggcactgggaagacaggaagagttacatttgcgtgcactaaaggatgagacctaatgctttatcttctctataggaggtgaataagtacctcaaattaaaacatcaagttatggcacaatgagcatgctacttataattaattatggaggtaaataccaaaagggatggctaaaagagtttaaggtaggaatgagtatcagaagtgaggagggagggggtagaaaagggactgctgttttcatttataaatcttattcttatattatttcataaactccaaaccagagaagattcaggtttttggagatctggataataaaaagaatacaaaactatcaatacaaaattgtgagggctctcccagaggaagccatgcaaggaagggccctgaagcttacaagctttacttattcatggcaaatctacttctgctctgaacatgtattacttttataaaaaatgaaggaagaataaaagtactttgaacttcacttatatattttaattatttttaatgtatggaagttttttaagactatcatgctcaccattttcaatgagattgatagtcattataatgaaatgactggcccataaagacattcactccccgctcctttcccaatccaccctccagaatgaagccacttttataattttgtcaccaaatccagggatgagtgccaacagttaggaagctttcagttgcaaaagataaaaagcccaactcagttgccttaaacaaagaagaaatttattctttcacgtgacaggaaggcctgaggtgtaggcatttgaaatttgtagggttggttaatttggtggctcagggatgttttcaagtagcccaacttcctactctaccatcactagtttataggcttggtcttcagcccactgctcttcgtggtcatgacagctgtagttctaggcatcatgtctagataaggcaacattcaggggtagaaggggactgtttattttttcctttagtctctcttaaagagtgagaaaaattttcccaggaatcccggtggactttgcttcaccactcataggttcataccaagttacaaccccacaaccttagagcttttgttaggaagaggcttggtgggattaccgtgcttggcttggcttggtcaggattcaccaccagagtcatgtgggagggggtgggaacccaaacaattcaggattctgccctcaggaaataaaggagaaaatagctgttggataaactaccagcaggcactgctacagcccatgctttgtggtttaagggccagctagttacaatgacagctagttactgtttccatgtaattttcttaaaggtattaaatttttctaaatattagagctgtaacttccactttctcttgaaggcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaagtatgtgcatttctctatgttgcaaagtcatggattcctttaggtagctacattatcaacctttttgagaataaaatgaattgagagtgttacagtctaattctatatcacatgtaacttttatttggatatatcagtaatagtgctttttttttttttttttttttttttttttttttttttttttgagacagagtctcgctctgtcgccaggttggagtgcaatggtgcgatcttggctcactgcaagctccacctcccgggttcaagtgattctcctgcctcagcctcccaagtagctgggactacaggcgtgcgccaccacgcctggataatttttgtatttttagtagagatggggtttcaccatcttgggcaggctggtcttgaactcctgacatcatgatctgcctgccttagcctcccaaagtgctgggattacaggcgtgagccactgtacctggcctcccttcagactttttaagttggcattttacagcctgaccttttggcatttattttataaagtaaaagatttgtttttttaattgttccagtaagccttcatggccgtaatacatttgtctacaaaaattttattaatatgtctcactctgctgtagagagatctgtggatttgcatgatacaaccttgtacattattattccttttgttgacaagtgctatattttattttaaagaaaatcaaagggatttaggatattggcagaaatgcaagtatttcttcagtgtctaagatgtgttgccacttgatggatttaagttaacacttagggcttcttaggaacattatcagccactaaagccctttggttagggctcagtcatctcttcagttagtcttagagatgtggttcattgaataagactttagcatattttccaaccaagttatttttggttgtcttgtttttgcaagagtgaaacttgattaaaacattacaacaagaatattaagtagttttaaggaaacaaacacctaggttccttagcatctttaatcattagtcactaattattatgaccttgacatatccatcagtttgaggagaacactttttacaccttgtcctcagttttttaactgagtcagaactttcactgggcatgttcatgactttactgcttggctgagttttccagatatcaaagcccagctgcagcctgtgactttcacactcctggaaaagtagacgtatctgcctgctcttacagcaggctttagcttgcctttgctgggactttgttctgccctcagttaccacagtaattaggttgcctcttctactttcctcttttctcacaggcaccaggagccagaggaaataacataatagttgttgaccagagcagcagcataattctttcatgactgccttttctaatttgacgattccctctcctgagagggctctttgtgtcctcctcctcttcgtctccaacttttaaaaaaaaaaaagtgaaactatcaagtattgctcctgctaacttcagatcagtattttctttctctgaagccaatgcaaagtaataacggacgtgcttcatcatcttagcattcagcacacgtgtcaccatctctgatggtgtgagcatgttaaaccagacttgtgggtacttaccaaaaggttcagttgacactataggtcagttgctaaaaggcacaaatgtcttctaaagcaatctgttaaaagtcaacatttaacatttaattagaaaactgatcaaaggatctgaatgtttagttctcccaagaaaatgtaaaaatgatctgtaaacacataaaaagatactcagcatcattagccatcaaggaaatgcaaatcaaaaccacttcatactcactagattggctataataaaaaagatagacaataacaggtgttggtgaggatgcgaagaaactggaatcctcatacactgctggtgggaatgtaaaatagtatagtgattttggaaaacagttcggtagttctttgaaagattaaatatgacccggtaattctactcctaggtatatactcaagagaattttaaaacatatgtcaacacaaagacacatatacaatggtcatagtaatattgttcataacaggtaaaaacagaaacaacccacatgtctattaactgataagtggataataaatgtggtatattcatacaatggaatattacttggttataaaaagaaacaatctatcattagtacacttaggatgagcttgttactggcatgttggctgtgggaagtatatcttgaaattcactaaaagaccaactattgctgggcgcagtggctcaagcacctgtaatcccagcactttggaaggccaaggcaggcggaccacctgagatcaggagttcgagaccagcccaaccaacatggagaaaccccacctctactaaaaatacaaaattagcccattgtggtggcacatgcctgtagtcccagctactcaggaggctgaggcaggagaatcacttgaacctgggaggtggaggttgcagtgagctgagatcataccattgcactccagcctgggcaacaagagcgaaactccatctcaaaaaaaaaaaaaaaaagaccaactaccttcacaataaataaaaatgtcttacatttctaattaaaatttttgttcagttttattattcagctttaaaaaggaagggaattctgacatgttacaacatgaataaatcttgagtactttgtgctaagtgaaataagctagttacaaaaagaaaaatactgtatgattccacttacatcagagtagtcagaaagtagactggtggttgccaggggttaaggggaggggaaatgaagggtcgtttaatgggtgtagagtttcagttttacaagatgaaaagagttctgtggatggacgatggtaatggtagcacaatgatacgattatacctagtgtctttgaacggtgaacttaaaaagggttaagatgttaaacttgatgggtatcttaccacagttaaatttttattatttttttattttttgagacaatttcgctcgttgcctagggtggagtgcagtgctgggatctcagctcactgcaactctgcctcccaggttcaagcgatactcctgcctcagcctcccgagtagctgggactacaggcacacatcaccatacccggctaatttttatatttttagtagagacaaggtttcaccatgttggccaggctggtcttgaactcctgacctcaagtgatctgcccacctcagcctcccagagtgctgggattacaggtgtgagccactgtgcccggccaaaaaaattttttttaaataccgttaagaagtggaaaataaggccaggtgtggtggctcacacctgtaatcccagcactttgggagaccaaggttggtggatcacctgaggtttggagtttgagaccagcctggccaacatggtaaaacctcatatctactaaaaatacaaaattagccgggcgtggtggcgcatgtctgtaatcccagctattcgagaggctgcggcaggataattgcttgaaatcgggaggtggaggtttcagtgagccgagatcacttaaaaaaaaaaaggaaaataagctaccagctgagagaaaatatatgcaaatcatattgaagtcctgttaaaggacttgtatttaggatatataaaggatgcttacaacttaatacgaagacgatagcccaaatttaagatagggaaatgctttgactagacattctaccaaaagagatatataatggctaaaaagcacatgaaaagatgctcaacatcattaatcagagtggctagaatgaaaaaggctaacaataccaagagctggtgaggatgtgaaaaaactggaactctcaattgttgctggtggaaattcagactggtacagccagtgtggaatgtgatttggcagtttattaaaaagctaaaaacctaaacttacatagcccagcaattgcacccccaggagtctacccaatggaaatgaaaacagtccgtccccacagagacatggacataaatgttcatagcagcattattcagaatagccccaaattgaaaacaatccagatgtccatcaactggtaaatggataagcaaaccatataatggaaaaccattcagcttccaataacttccaagaaactgtagacacatgcagtatcatggttaaacctcaaaaacattatattaagtaaaataggcgaggcatgtattgtatgagtcatatgaaatgtctagaaaaggcaaatttattgagatagaaagcagatcactggttgcttaaggcctagggtaggagtggggattaactgtaaacgggtacaaggtacctgactggggcaatggacatgtggattgtgatgatagttaaattgtacagctctctctatatatagttgtacagctctattaattttccacaatcattgaatcatgtcttccagttttatgaggtaaatcatagtccaatgaagcttttttaaaaataagatgataggccatgcgtggtggctcacgtctgtaatcccagcactttgggaggccaaggtgggtggatcatgaggtcaggagttcgagaccagcctgaccaacatggtgaaaccctgtctccatcaaaaataaaaaaattagccaggcatggtggcatgcgcctgtaatcccacctactcaggaggctgagacaggaaagtcgcttgaacctgggcggcagagtctgcagtgagccgagatcatgctgctgtactccagcctgggccacagagcaaaactccatctcaaaaaaaaaaaaaatattaattaatatgataaaatgatgcctatctcagaattcttgtaaggatttcttagtacaagtgctgggtataaactatatattcaatagatgacgattattacttattattgttattgataaataacagcagcatctacagttaagactccagagtcagtcacatagaatctggaactcctattgtagaaaaccaaaaaagaaagaaaacacagctgaagcctaattttgtatatcatttactgacttctctcattcattgtggggttgagtagggcagtgatatttttgaattgtgaaatcatagcaaagagtgaccaactttttaatatttgtaacctttcctttttagggggagtaaaacttggattgggagatttcattttctacagtgttctggttggtaaagcctcagcaacagccagtggagactggaacacaaccatagcctgtttcgtagccatattaattgtaagtatacactaataagaatgtgtcagagctcttaatgtcaaaactttgattacacagtccctttaaggcagttctgttttaaccccaggtgggttaaatattccagctatctgaggagctttttgataattggacctcaccttagtagttctctaccctggccacacattagaatcacttgggagcttttaaaactgtaagctctgccctgagatattcttactcaatttaattgtgtagtttttaaaattccccaggaaattctggtatttctgtttaggaaccgctgcctcaagcctagcagcacagatatgtaggaaattagctctgtaaggttggtcttacagggataaacagatccttccttagtccctggacttaatcactgagagtttggtggtggttttgcatttaatgacacaacctgtagcatgcagtgttacttaagacagcaagcatctagtgagaggagctggtgccatgcatgaccccacatagatcttgctgatagtgctacagcatgaaccctgaagctttcaaaactatgatttttttttttttttttttttgagacggagtctctgtcacccaggctggagtggtgcaatctcggctcattgcaacctctgcctcccagatttaagtgattctctgcctcagcctcccgagtagctgggattacaggtgcctgccaccacgcccggctaatttttgtatttttagtagaaacagggtttcaccatgttggccaggctcctcttgaactcctgacctcaagtgatgtgcctgcctcggcctcccaaagtgctgggattacaggcgtgagccaccgcacctggcttttttttttttttttttttttggagacagagtcttgctctgtcgcccaaactagagtgcagtgacattagctcactgcaacttctgcctcctaggttcaagcgatcctcctgtctcagcctcccaagtagctggaattacatgtgtgcaccaccatgcctggctaatttttgtatttttagtggagatgaggttttgccacattgcccaggctggtctcaaacttctgacctcaactgatctgcctgcctcagccgcataaagtgctgggattacaggcatgagccactgtgcccaacctgaaaactatgatttaagtaaacaacccataaaatatttcttgctatttttactaaagatgtgttatcttggccgggtgaagactttctagtgtttccgtaactagggtaaaaaatgaactctattatatggcttgtacatgtgtttacaagaaagcagtgtactcctcataaataaacttttagtttattttattttttaaacactgcagcctcatcatgcttcacggaggagcctgtgcgggaagaatgctcccacacagcataaagaatgctcccgcacagcatagagaatgcccccgcacagcatagagaagcccccgcacagcatagagaatgcccccgcacagcatagagaagcccccgcacagcatagagaatgctcttcacctctgggtttttaaccagccaaactaaaatcacagaggccaacacatcatttaagatagaaatttctgtatcttttaatttttttcaaagtagttttacttattttcagattctatttctttactagaattaagggataaaataacaatgtgtgcataatgaaccctatgaaacaaacaaaagctaggtttttttcatagctcttcttccagattgaatgaacgtctgttctaaaatttaaccccaaaaggaaaatattcagttaactatgttaaaaaccaagacttgtgattgagttttgcctgaaaatgctttcataattatgtgtgaatgtgtgtctttcccatcttctccacagggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagcactttctgtcctggtattttgtttttgcttttgctacacagtagctcagaatttgaacaaatagccaaaagctggtggttgatgaattatgaactagttgtatcaacacaaagcaagagttggggaaagccatatttaacttggtgagctgtgggagaacctggtggcagaaggagaaccaactgccaaggggaaagagaaggggcctccagcagcgaaggggatacagtgagctaatgatgtcaaggaggagtttcaggttattctcgtcagctccacaaatgggtgctttgtggtctctgcccgcgttacctttcctctcaatgtacctttgtgtgaactgggcagtggaggtgcctgctgcagttaccatggagttcaggctctgggcagctcagtcaggcaaaacacacaaacagccatcagcctgtgtgggctcagggcacctctggacaaaggcttgtggggcataaccttctttaccacagagagcccttagctatgctgatcagaccgtaagcgtttatgagaaacttagtttcctcctgtggctgaggaggggccagctttttcttcttttgcctgctgttttctctcccaatctatgatatgatatgacctggtttggggctgtctttggtgtttagaatatttgttttctgtcccaggatatttcttataagaacctaacttcaagagtagtgtgcgagtactgatctgaatttaaattaaaattggcttatattaggcagtcacagacaggaaaaataagagctatgcaaagaaagggggatttaaagtagtaggttctatcatctcaattcatttttttccatgaaatcccttcttccaagattcattccctctctcagacatgtgctagcatgg

SEQ ID NO: 13314 - DNA, 75212 bp, Human; identical to SEQ ID NO: 13313

SEQ ID NO: 13315 - DNA, 75212 bp, Human; identical to SEQ ID NO: 13313

SEQ ID NO: 13316 - DNA, 20030 bp, Human
ggtggctgcagtttgcttgtgacatgggcgtgtatctgagtgtgaaggaagctggtttttgtgagctgcctcccgagctcagaggtgacagtgggcactttccccacagagacccctgaagttgttccttggagaacaaagtggtgaggggcggggattccagaccttgaggcagaagctagggtctggtccactgttctgtggactgggcagtggccctgggaggtgccgtggcctctgtggcctgtttcctggggtggggtctgtcttgcgctttgtctcttgtgggtgcagactccccttcctctgctgtggagccggcagatggccccggagccagatcctggtgcctccctgtccacatgcagctcagtcatttgctcttggtcccttcctatgaaatgcacggccacacacagccagggtttctcctgggctccccagagggagagtagggtgcagcctgcaacagtgcagggtccccaggcctgtgtgagcccccaggtggggaggtgggtgatgcgcatgtcagtgctacctcctgccacctcctctctgcctgggcacaggctttctcctctgtttgctttttatttcctatgtattcaggaaccatgtgaaattgccaatgcttggttttgtcctacaaaatggccatttcatttggttcaacctgatattgtgtctacacacacacacgcacacacacacacacacaggcaaatactttttaaaacaggattattctattcacagtgttctgtagaaatttgtgttcagtctttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcagtctttttaagacagcttactgtactgatgccgcacagatcttttttttttttcgagacagggtttcactctcgcccaggctggagtgcagtggtgcaatctccgctcactgcagcctccacctcctgggtgtaagtgatcctcctgcttcagccccccaagtagctgggcccacagggcttgcatcaccacacctggctaattttgtatttttgtagagatggggtttcaccatgttggccagactggtcattctttttgagatggagtctcgctctgtcgcccaggctggagtgcagtggcgtgatctcggcttactgcaacctctgcctcccaagttcatgccattctcctgcctcagcctcccgagtagctgggactacaggcgcccgccaccacgcccggctaattttttgtatttttagtagagacagggtttcaccgcattagccagggtggtctcgatctcctgacctcatgatccacccgcctcggcctcccaaagtgctgggattacaggcatgagctactgcgtccagccggaagatttaattttttaattgtcaaatccattctctctctctataaacattttacattttatgataataaaataatttgtgagcccacggccccgtttccctgatgcctgaggtcttcctggggcggcatgggagggctgaattcaggtgcggggtcggccccagggcactgagcgcctgggtgagtatctggaatgaggaaaacaaagcttggctcccgccaaggagaaagaaactcaggatgcggggctcaggccaggacctcggctcagccgccatttctggagcacaggccagcttcgtcgtcctcccgaggggtcctgaccagggcttcccaggagcggccgcccactctgtgtgtccctttccaggtcgccactgggacactgtgaaccaggagtgagtcggagctgccgcgctgcccaggccatggactgtgaggtcagaggccagatcccctgcgggtgccttgtggggggcggggtcgaggggtaagggcctgcgtgtcccccaccacgcatccctgagggctgaggctgagcccgcctggcccttaccacagctcggcacagacgaaccccgcccagccccttcactgaagcaggcgggagccgggaagtcctacctttccctgtcctgcgccttcctcgcactccgcttgtggtgcagcccctccacaccgcgcctggggctaactgcaagggcgagggggctttgggtttaagaccatttaacagccataggctgtgggtcccagcactttgggaggccaaggcaggaggattccttgaggccaggaggtcgaggctacagtgagctgtgattgtgccactgcactgcagccctgtccaaacaaacacgaaagagatttaagaagaagaaagggggcattagataagcacttcatataattctctcaactgtaaaagcaagacaatacttaccttgtctaaccaatgccattgctatgaggagcaaataaatcaataaaggtcaaataaaagtactgtaaactgtaaggtgtttcaaaaattttttaacccactggatttaaatttcccttcatagctgggcgaggtggcttaggcacataatcccagtgacttgggaggcagaagcgagaggattgcttgaagccaggagtttgattgagacaaacctgggcaacatagtaagaccccgtctttataaagataaaagcggtggagttctgggaggggagcccggagcccccgccttcagcaggacgctccctggatgcttccttgtctctccttccctttaaatggtctggggagagaaaaatcacagcacacgggtgctctctcccacccgctgcatcacatcctcctcccctccctcctgccgaattctgcagcctctgggcgcctcacgctgtcctggcagcctctgggaaggcatctgcgaagtctaatgccttggcacttagtgactgtgtcgcagttcctgagcatggagagcacccggcacccaggaggttctcaagctgcccctactgggggtcctttccaaaggtggggacggtgtggatttcagcgtggtggctggagggctgaggcagtggctcgagtttgatgttagttacataaacagaggagattgcaggagctcccccggccctgatccaggcttgttgtcagtgtccaaaagaccactctgggtgccactgtcccttcccacctgccgctgctgttccggcttcgcgctctggcggcctccgcaggtagaacaccaccgtcacccgcgcagcgccctgactcgccggaggaggcgcctgccctcccgcccgcctctccccggccccctcagtgagggagggtggacgtcgccactcccctttcttgccttcggagtgaggaagcggaggcagcagtacggcagcccgcccagggccacagagctggggtcacagcgaaacactccgaaactttcttttcaattatagggttcagccttttttcccatcataactttaattctgtgtagatacttctattttttatttttatttttttttttgagattgagtctctgtgtcgcccaggctggagtgcagtggcacgatctccgctcactgcaggctccgcctcccgggttcaggccattctcctgcctcagcctcccgagtagctgggactacaggcgcccgccaccacgcccggctcattttttgtatcttagtaaagacggggtttcaccgtgttagccaggatggtctcgatctcctgacctcgtgatccgcccgtctgggcctcccaaagtgctgggattacagatgtgagccaccgtgcctggccttattattattatttttttgagacgcagtcttgctctgtagcccaggctggagtgcagtgatgtgatctccgctcactgccagctccgcctcccaagttcatgccattctcctgcctcagcctctcgagtagctgggactacaggcgcccaccaccacgcccggctaattttttatattttagtaaagacggggtttcaccgtgttagccaggatggtctcgatctcctgacctcgcgatctgcccgcctcggcctcccatagtgctgggattgcaggcgtgagccaccgcacctggctaatttttgtatttttagtagagatggggtttcaccatgttgcccaggatgttctcgacctcttgacctcatgatccgcccgcctcggcttcccaaagtgctgggattacaggcgtgagccaccgcgcccggccagcaccatcttttcctttccactggaactgatcttattatttttgcctccattagatcatttttgtaacatgtcttgcaggatttactgtcttgatcgtttctcttaacatatttttttcctgtgatctaaaaagataaaaaactatcaattcttttatcaaaagtggatctagaggctgggcatggtggctcacgccagtaatcccagcactttgggaggccaaggtgggcagatcacctgaggtcaagagctccagaccagcctggccaacatggtgaagccccatctttactaaaaatacaaaaattagccaggcgtggtggcacgtgcctgtaaccccagctacttgggaggctgaggcaggagaatccattgaacctgggaggcagaggttgcagtgagctgagatggcaccattgtactccagcctgggcaacagaatgagactctgtctccaaaaacaaagtggatctagaagatcaaaaaagggcatgattccatattggcacagcacaagccctattcttggaattaaatggcatccatcttccgagcccactcctgtcctgcagggccggcccagcctgtccctgaggcactggtccagacaggagcctgtccacacagctgtccactcagtgggcccagtgcttggcttcacggtcacttgcggcacctagacctcctctggcaggtgccattctttcctctccctccctgccgcctcgagtctttattttctgtgggatcttgagtttgataacctgacctgctgtggtggcagcgccgctctgtgtccagattctggatgccaatttaccaagcgcaggtcaaaaagaagtccttgggcagcggctgcctgcgttagcttcttggggctgctgtaggcggttccaagcaggagagtggctttaaacaacagatgcggatcccctcccggttctagaggcccaaaggctggaatcccatgttgcccggctgcttccttctggggcgctctcctggctcctgtggctgcctctgtcttcacatggcgtcctctctgtgtgtctctgcttaaatctccctctcctttctcttacaaagacaccagtcattggatttagggcccaccctaatccaatatgacctcatcttaacttgattacatctgtaaaaaccttattttcaaataaggtcacattgacaggtacttggggttaggacttgcgcttttctttttgggtgacacagcttagcccagcactaactgtgtcaccaggactgtcgcttgaggcaggaatgaagcacatcctgtttgtaagctgtcttgtgccatgcggctgctccgtacaagaattgttaggaattgatgcagtggaattttgcatacagtttttcctctcttcagaaacaactttggagaagtaaaggctgaatagcaatacacaagcaccttattttattttattttagattcaggggcacgtgtacatgtttgtcacatgggaatattgtgcactggtggggactgggcttccggtatcgcatggagagggactctttctgcgctcccccgcccccgcctccctactgtaaagtgcccggtgcctgctctctccatcttcgtgtccatgggcacccattgtttagctcccacttataagtgagaacagtcagtatttgattttctgtttctgagttagttcacttagggtaatggcctctagctccatccgtgttgctgcagaggacatgattttattcttttttatggctgcagcaatacacaagctccttatttttatttatttatttatttatttttgttgtttgtttgtttgttttgagacggagtctggctctcgtcccccaggctggagtgcaatggcgcgatctcggctcattgcaacctccacctcccgggttcaagcgattctcctgcctcagcctcccaagtagctgggactacagacgcccgccaccaggcccggctaatttttgtatttttagtagagacaaggtttcatcatgttggccaggctggtctcaaactcctgacttcgtgatccgcccgcctcggcctcccaaagtgctgggattacaggcgtgagccaccgcgcccggccaagctccttattttaagcattttttttttcttttttgagacagggtttcactttgtcacccaggttggagtgcagtggtgtgatcatggctcattgcagcctcaaacttctgggctcaagtgaccttcccgcctcagtctcatgagtagctgggactgcaggtgcatgccaccttggctaatttttattttttgtagagatggggatcttgttgccaggctggtctcaaattcctgggctcaaacgatcctcctgcctctgcctcccagagtgccgggattacaggcatcacctagcaaagcattaaaacaatttgctgctgggtgcagtaggtcacacctgtaatcccagcactttgagaggccaaggagttggggggagttggggggcgggcggatcacgaggtcaggagttcgagaccagcctgaccaacatggtgaaacctcgtctctactaaaaatacaaaaattagccgggcgtggtgatgcacacctgtaatcccagctactcaggaagctgaggcgggagaatcatttgaacccaggaagcggaggttgtagtgagccgagatcacaccactgcactccagcctgggtgacagagcgagactccatctcaaaacaaaaacaaaaacaaaaaaacaatttgccctgtaagaactgtcctctaaaagtttttggtttttctaatgaaaaatattatggacttagagaatagaaataaatttctgcctacacttccatcttccctcccacccttctctggcagcccaggaggtctttttgtgtgaatctgcgcagatctcagcgtccctgcccttctttgtgttttgttctctcttccaccttaggtctttctctggtctgggcacacccagctgcagggctcacctttgcctgtaagaatacagcccccaaacacagtcagtaccccaagaacagtccctgccatctctggcggcacagatgctggccaagctgcagctgccagtgctgcccagggagctggagagctgccggccaagagcccagcccctctgggtagagcaggagccagtgccaccactccctgtgggattcggattaaggacacacccacccaaagtaaaccaagcttggccaaaggcaggtgcccagctgtggtcaccactccgcagtagttactgaaaatcttccatctgcccaataccctcctgagcccgtgaaggagatgagcggaaagaggctccgcctgttggaagcacagccaggaaaggtgggctcagattgctgaagcctgcaggggaacttgaagaaagcgtgccagcacaggatggcggatgatgcccgcatgacactcgctcgcctccccggaacagcctgtggccttctcacctagtgggaagctccccagccgcgtgtttcaggaggtccagcagattcctctgcagaggaatccctttctgcagagtcggggctcgctccctgccatctacgggcagtgctgcttaaagctgtggctgcagaccttgcctctgcctgttgagacctcctgcagggccctccagcccacagggtccctcagctctctgggacctgtgaggctctttgggccagctgcaactggagctctttgcaggaggggcctctggcctggctgaagtcccggcttcctgactcccctttcccctcaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcaggtaggcggccggccccacctccttccccaaagctgggcttctctgtcgccagtaacattcagggagcctcagggctggaagggacccccgggatcactctgcctctgcagtttcagctgccacgtacgctggtatcacttaatcacttgactggtctctacttgattccctccagtgctgctgaactcactgcctaccatttttgggtgactctgttagaaagttcttcctttctgttgagacagaatctcatgtactggtcttgagtcccttgtctggaccaacatagaatggtgtttttatccaattttccaaatgtgattctgatacaaagattgcagaccacttgtctggattatataacccaaggggttctcacacttggccttgtatcatttcaaggacctggagctttaaatgctggtgcctgcatctcacctccagagattctgattggttggtctgggcattgctgggtctgggcaaagcccccaggtggcactaccggtgcggcccctgcctccccaagcaggcctggctgactgtcccattgattgaggcccactggtttcacagtgacttttgcactgtctatacctgacatatttcctttcatacattatgctccgtgattacctatacaagaacacagaagtatttggaacctcatttccaggtgaggaaacccaggtccagcaaagggtaaatgactagctccagatcacacagcttgtggccatgttaccactgggacatggggccaggccccttcttgaggtgggcctcagccgccctcccactgtagggcactgactccaggtcaccatggtttccagactgttcacctttcctgttgctgatccctgcactctcctccagcctccagctccactcccctttgccaaggggctgcttctatggacaggggctgtcccgagtggaggctgggggcgagtggaggctcacccacttccagatccagccctgcgacgctggctttcagtagtgtgcacattggaattacacgagaaaccttttccaaatgcaggccttgggccctactccagctgcctgcatcaggctgttttagggcgggagactgcccagaggattctgacgcaggtagaatccctgccctgaaagcctgcagggatccccggaccctggtccaggccttccaagctcaagggttgcactgccctctggtggctgtgggggagaccaacagctgacccagccttctgcctcccacctgtcttagatcaggtgcttgaggacgtggctggagttccccactagaccggggtgggggtgggggtggggggtggggggaggtgtctgagaatgtctctgccttctaatccagccagcatatcttctggctcgccctgaactgaggagaaaccccagatccctttgggaaggtccaggaagggcaggagtggacaggcacagctctgctgtcagcactgctgtgggggtgactgtagccccagtctgccctggtgtttttctctcgctcttctccatgccggcctttgcctctagactgagaaaccggggttgactcaagtggcacctgcaaaagtgatcatggcagttcacttagcctgcaggtgacagggactgtgaatctagtccctggcgagcctggaaagaggggcaaggtagaggctctggctgccggggtttctttggtgagtccgttcactcggctggacacagacggatcaggaaagattcctgttgctactcggctggtggccagagggagagaggacgtgtccgtaactgaagcaaggtggataagcttcgggaacgagcgaggcacagattctgtgctgggggagtgatgaggtgctggaggagctgggtgctctgctctgcagggaatcaggaaaactttggggctgcagctccaattgagctgggccttgggggttgggtatgtttggttccttggaaactgggaagagggaatggccatcttttaagcaaaagcccagcggctataaatgctacagtgaggctgggtgcagtggttcacgcctgtaatcccagcactttgggaggccaaggcaggtggatcatgaggtcaggagttcaagaccaccctagccaagatggtgaaaccccgtctctactaaaaaaaatatataaaaattagccaggcggggtggcgggtgcctgtaatcccagctacttgggaggctgaggtagagaattgtttgaacccgggaagcggaggttgcagtgagctgagattgtaccactgcactccagcttggggaacagagtgagactatgtcttgaaaaaaaaaagaaaaaaaaaagctacagtgagtagttgagtttgcctaggaagcgtggaagttaagtcagacgtactttcaggctgggtcatgacttgtcacttaagcagagatgagcacttgagaggttttgaagagaagtgatgtggcagccttactgcatgttccatggacagactccagggaggccgtgaaacccccagagcacagcttctaagaacgtgcccactccttagcacgtcacttctcccaaccctgccctgctctgaggtctgtgctgtgaaggtggccgagtagactggacggcagggagtggggctgtcatcatcagatgagagctaaggggacccccaccagggtggcggcaatggcagagggtaggcaaaacgcttgtatttgcaacataaggtgagatttgacagctgaccgagggtgggagcagcagccaaaaccaaaaaagccagagggaagttgcaagcacagaaaaaatagaagatttaatgggagaaataacaatagctggcatctattgaacacttactgggagctaggtacagggcccattcattcattcatgcaattaaaactttttttaagaaacggggtcttgctctgttgcccaggctggagtgcagtggtgtgatcacagctcactgcagccttgaattcctggcctcaaggagtcctcccacctcagcctcctgtgtagctgggattataggtacgtgcggtacacctggctccctttaaaagttttttgtagaggcagggcacagtggctcacacctgtaatcccagcactttgggaggccaaggcaggaggatcacaaggtcaggagttcgagaccagcctgaccaacatggtgaaacccgtctctacttaaaatacaaaaattagccgggtgtggtggcgggcgcctgtaatcccagctactcaggaggctgaagcatgagacttgcttgaacccaggaggcgaaggttgcagtgagccgagatcgcgccactgcactccagcctgggtgacagaacaagactccgtctcaaaaaaaaaaaaaagtttcttgtagaggcagggccttgctttgttgctggtgcaatcacggctcactgcatcctctaactcctggccttaagcaatcttctgtcctcagcctcccaaagcactgggattacaggcatgcatgaccacacctggtccctgccattgtttattgagcacctactgagtgccatgtattaagtgctgggtatttgtcagtggacaaaacagattaaaaaaatcacagcccttagggagcttaccttctggcaggggcgtcagacaataacacagcaagtgctgaggaagaaacggaggcggcagggagcgtggcagttgagcgtggccttcatggagctgcgacagtggtactcgggcaggggcagcacggaggctgtgcgccagaggaggaggactgaggggcaagggggagagctctggttggaaaggcaggggagattctccagggccttgccggtgccagtgacaactggggttttcctgagacgggactgcgaggaatgggggctctcaggcttgagagggcaaaggtgggtctgggatgccgtctgcccacagagccccttccccaacggctgcccaggccaaggccaaccctgttgggttgtgtggtgtgagccatgaagccgctgccaggtttgtacctcaggcgtggtcgtgatgccccagcttcaccggccctgcctgtggggacgtggtgcctgtgtgcgggagcctgggcctcagccgaggccctgagctccggcactgcccagaacccagctcagcgctggtactcagcccgcccgctgtggccctggtggagtggagcacgtgcccagtgggggctggccttgtcccatcgcggacctgtcctttcccggggcagggtggtgtgggagagggtatcagggacattttctgagtctgctctgtctctgccgcccctgcccgaacacagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggtgagtgagggcctgaggaccgcgtgggcgggcaagtgagccaagggggcctgtcccctgcctctcaccaggcagcccactgtcccgtgaggccactcaactcgtgactgtcaggtccagaactctgacgaagtaactggacgtagggcatggttcattgccttgcagatttcagctggttgacatcgaggaaacctgaaccttaaatcagagtaaagagtttaggggtaaaagcctctaaaagatgaacgaagcatgtttggccaacagaagaaacagacgcttcctttggttgtagggagtttaataatggtgccagtgagaaccgtaagccctgggagtggtgcctgctgctctgctgagctccttggttggaatccacacaactttctgagctctaccatctgcttggcactgttggggatacaagattggtccggggcactgtgtccccagaacacttagcggaaagaactacatcctcccaactgccaaatgcaggcctgtagcggtaggagctgagaggagagaaagttccactttttcgactctaccagctgaaaatgcaggcgtcctcacctcctagaaatccaatcatgcttctgttcagtggggccagcctgtgatgtcccagcagctgcctagaacgcaggagtggctggcgcactcccatgtaactctgcatgtgcgccgaccgcctgacggtccttgccagccttgtagtctgtctagtgtcccccaggaacccccttcctcctgtccattcagctaggtctgcaccaataaaatgggcctaaggcgtcgcaggtggtcactagttctggactcgaagtgccttgggcgcagggatgacccaggcttcttgtatcccatcaccgtctaacagtgggcacatgggctcaccacacatgcgtttgcttaccgagccccctgcagggagtgatcgcagtcttccctttccattgcctctcagaactcaactgtttctcattctttccgcccagcagccctggatacttaataagtactttgaagtgcttcttcatactggggactgtctttcctttgagagggaagagtattagtaaaccaggttctgtgtgcccctctgtgcaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgtaagaacccttgaggtcagctccttccctgcctgccgcccatgcccttttctctggaaggttgagaagcccagcggggcccctgcctctgatgccagcacaagggttacaggctgtcctgctcgggtttggttttgctgttgtgagctagaaagctgtgtgtaaaggtgacgaagagcacccagagtcctttggagctttagcagcttactattggagacatgctccattcagaggggtggcaaaggctcacgtcacactcctggtggggtcctcaaggcacaagcaggtacagagtggaaggaaggggctggagggctcacaatgagcttttcagacctctcaccttgccataaaaaataagtgtaatgtggccagtgcggtggctcatgcctgtgatcccactgctctgggaggccaaggcaggtggatcacctgaggtcaggagttccagaccagcctggccaacagggtgaaagcccgtctctactaaaatacaaaaattagccgggcatggtggcgcacacctgtagtcccagctactcaggaggctgaggcaggagaactgcttgaaccctggaggcagaggttgcagtgaactgagatcgcaccactgcactttagcctgggcgacagagcaagactccatctcaaaaaaaaggtgtaatgtgaaccaaaacgagtagtcaaaaaagggggggaactgtctgaaatcttttccagagcacatctgtcccataaccaggtattacaagtcacagtctaaaggctgggcatggtggctcaagcctgtaatcccagcgatttgggaagcagaagcagtgggattgcttgaggccaggagtttgagacaaaactgagcaacatggcgagaccctgtctctaaaaaatttataaaaataattagctgagggccaggcgcggtggctcacgcctgtaatcccagcactttgggaggccaaggcaggcggatcatgaagtcaggagttcaagaccagcctggccaagatggtgaaaccccgtttctactaaaaatacaaaaaaaattagccgggtgtggtggcgggcgcctgtaatcccagctactcaggaggctgaggcaggagaatcgcttgaaccctggtggcagaggttgcagtgagccgcaatcacgccactgcactccagcctggatgatggggtaagactgtctcaaaaaaaaaaaaaattagctgagcatggtggcgtacgcctgtagttcacgccgtcatggaggttgaggcagctcctcaggaggctggggcagaaggatctctttgcttgagcccaggagttcaaggctgcagtgagctgattgtgccactgcactccagcctgaacaaaaacaagacctgtctctaaaaacaaacatacagtgttcacaatgctgcccaagaagggccagtttttgcagctgcccccatgtagcaaaatctggtgcttctgtttcatagacccaaatggaaattaagtggatgtgtcttatttgtaaatttaaaaatattagcgaatgtttgggaatttttttttttttttttgagacagaattttgctcttgttgcccaggctggagtgcaatggcacgatctcagctcaccacaacctctgcctcccaggttcaagcgattctcctgcctcagccccccaagaagctgggattacaggcacacaccaccatgaccggctaattttgtatttttagtagagatgaggtttctcccatgttaggctggtctcgaactcccaacctcaggtgatccgcccacctcggcctcccaaagtgctgggattacaggcgtgagccactgcgcccggcctaatgtttgggattttatgacatgtcagaagcattacttcaggctttggtttttaagtaaaatagcatctaatcctctactgagaactcataagaaaacattccttatatgctgtggtcttcagttatacaagcattttaaaaacaggagaatgaatataaatcttaaatcaggcattaaacccagctgaattgttggaaggaggtaagcctgagaccattcctggacagcttttaccaacacccatgtaaagggggaaagggtgggcaagacgtgtgcagcagtctgtatggacagcttaccagagactgagggctgaggcagaatcgtgattcctctgacccagcaggggcctcctgacaccgtcagtgccttggagatgtgaatacccacctcaccgcctgaacggcctgtttttgcagttgcccccatgtagcaaaaagtaggatgcacggataggacttcagggctctggagaacgtgtttttgcataaaccccagctttgctctactgtggcacagagctctggagcctggtttgtgaatgagcctagctgattctggctttttctcctttcttgctctaggggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttgagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccttaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaa

SEQ ID NO: 13317 - DNA, 40548 bp, Human
gctgaggcaggagaatcaattgaacccgggaggcggaggttgtggtgagccgagattctgccactgcactctagcctgggcaacagagcgagactccatctcaaaaaaaaaaaaaaaaagaaaagaaaaagaaggccgggtgcagtggctcacacctgtaatcccagcactctcggaggccgaggcaggtggatcacgaggtcagcagttcaagaccagcctggccaacacagtgaaacctcatctctactaaaaatacaaaaattagccatgcatggtggcaggcacctgtaatcccagctgcttgggaggctgagggaggagaatcacttgatcccgggaggcagaggttgtagtgagctgacaccatgccgttgcactgcagcctgggcgacagagtgagactctgtctcaaaaaaaaaagaaagggttataaagtacattgatggattgatgggacaaaggaatttgttttttttttttttgtttttttgagacggagtctcactcttattgcccaggctggagtgcagtggcacgatcttggctcaccgcaacctctgctcctgggttgaagcaattctcctgcctcagcctctccagtggctgggattacaggcacacaccaccacgcctgttaattttgtatttttagtagagactggggtttctccatgttggtcaggctggtctcgaaatcccgacctcaggtgatctgcccacctcagcctcccaaagtggtgggattacaggcgtgagacaccgcgcctggcccgggacaaaggaaattaatgttcagcctagtaaactaaatttcctgaatttgctacatcctcgttcttatgacacactaaaataggaagtgtgtgtgtgtgtgtgtgtgtgtgtgtgtatgaaaataaagtgttaatgtacatgtagcaaaatgttaacaattgttgaatctaggtgaagggaggtcaatgcagtattcttacaagttactatatctcaaatttcttcaagataaaaagctaataaaaatggtgggtaaccatagcacagtaaaaagaaaaaagtgggtgtaccatttgacctcttattctactattaggagtcagtctatcctaaagataaaggaattttcaaaagtttttgcctttgggattttggggaaaaaaacgggcttgaggtaaatccaaataaaaacaaatgagcctggggggatttctgtcctaatattcctctaaatgggacctgggaaggcttttgaaaaatatataggctatctcagaaaagttccaaataaattatgtagctgctccaccctaataaggaagttgagcatagcttcccactccctaggtgtgggctttgtatagtggcttccttcctaagactacagtatggaaagggggttaaaaaaggtaacttcagagtggagaaacctacaaaccctacactttattcaggtaatcaaggttgacatgaatagtcagaaatcatgtatcccccttttttttttcttttggtagagacggggttcctctatgttgtccagcctggtctcgaacttgaggtcaagcgatacacccgccttggtctcccaaagtctccggattgcaggcgtgagccaccacgcccggccaacaatcatgtacccctaagcccataaccctgtgtaattatgcgaaaaattccaataaaggcacattctccaatatacctaaccagtactcctcaaaacagcccgactaatttcagatagaggaactccttatcttttcttcctcctacccaagatcccagtttaggaaaaaaataccggtcaggtcacgagtcagcgacgtagaaggacccgaggacgcgcccacaggccgggacagggcgggacttcctgggcgtcgctctcttcccattggctgagaagggtcatgaggatgaactgtgcagtcacctggcaggaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcaggtgaggggcttggttgggtcttacgaagccgcggcggcagtcccggggagtgggctggagcccgcctagggaaggccgcgggccttgagccgcccagatgccgcaggaaggtcccttgctccaagtcaccagatccaagaggtcggcctgaggacggagatttgccccgcagctcatgtgacttttgctcgggtcttgggcactgcccgcttgcctgcgcgctgccttcttgaacgccctggctctttgcctcccacctcagcattccctgttttccaagggtattcactgtgcctagtcggacagagatctgtgcaaggattgaaaacagccttgtggccaggggcagtggctcacgcctgtaatcccagtattttgggaggccgaggcggccggatcacctgaggtcaggagtccgagactagcctggccaaaatggtgaaaccccggtctctactaaaaatagaaaattagccggacgtggtggcgcgcgcctgtaatcccagctactcgggaagctgaacccggaggcggaggttgcagttagccgagatcgcgcctttgcactccagcatgggcgacagggcgagactccctctggaaaaagaaaaaaaaaaaacaaaccagccttgtcactttttttttttttaaccctgagggaaatgcttaaggctatatgataggaaacagtgcggagggaagagacctgcttccaaccagtgttttgacaaggtcgttcactttatgaactgtgtttttttctttttttcttttttttttttttgagacggagtctcactctgtcgcccaggctggagtgcaagggcgcgatctcggctcactgcaacctccgccccgggttcaagtgattctcctgcctcagcctccctagaagctgggattacagactcgcgccccaagcccggctaatttttgtattttttttagtagaggcagggtctcaccatattggcctggctggtcttgaactcctgacctcaggtgatcttcccacctgggcctcccaaagtgctgggattacaggcatgagccaacgcgccaggcctgtatgtactgttaatcttcattttggggaagtcccctctatcataatggattgtaatgattggtctcccactaatgtgtgtgttaacatttgtgagatacaggctggggccgggcatggtggctcacgtctgtaataccagcactttgggaggctgaggagggcggatcacctgaggtcaggagttcgagacgagcctggccagcatggtgaaaccccatctctattaaaaatacaaaaaattagccgggcatggtggcgggcgcctgtagtcccagctactcgggaggctgaggcaggagaatggcgtgaacccgggaggccgagcgaccctgggcggcagagcgagactccctctcaaaaaaataaaaaaaaaaagattgtctgggcctagtggggtgcgcctgtagtcccagctactcaggaggcagaggcaggagaatcgcttgaacccggcaggcggaggttgcagtgagccaagattgtgccactgcactccagcctgggtgacagagtgagactccatctcaaaaaattttaatattaataaacacaaatacacgccaggtgtggtggctcacacctgtagcccccagcactttgggaggctgaggtgggaggatcgcttgatcccaggagttcaagaccagcctgggcaacatagaccttatctctaaaaaattttttcttaaaaaataagccaggctgtctgggcatggttgctcatgcctgtaatcccagcactttggaaggccgaggtgggcatatcacctgcggtcaggagttccagaccagcctggccaacgtggcaaaaccctgtctctactaaaaatacaaaattagtggggcgtgctggcatatgcctgtaatcccaactactaggaggctgaggcaggagaatttcttgaacccgggaggtggaggttatggtgaggcgagatcacaccattgctgcctgggcaacagagcgagactgtctcaaaaaaaaaaaaaaattgccaggtgtggtggggcacacatgtgctcctagctacttagggaggctgatgtgggagaatcatttgagcccaaggggtcgaggctgcagtgagctatgatcatgccactgtgctccatcctgggtgagagagcaaaagaccctgtctctaaaaatattaaataaataaacaaaattgtgtcaaatggaagaccgctttttcttttctttctttttttttttttttttttttgagacgaagtctcgctctgttgcccaggctggagtgcagtggcatggtctccgctcactgcaagctccacctcctgggttcatgccattctcctgccccagcctcccgagaagctgggacttacaggcgcccgccaccacgcctggctaattttttctattttttattagagatggggtttcactgtattagccaggatggtcttgatctcctgacctcgtaatctgcccacctcggcctcccaaagtgctgggattacaggcatgagctaccgcgcctggccaggaccccttttgcttacatttaggagcctcaatgcctaacggtgtttggcaccaagtagatgtatcagagtttatgggaaaaaattgttgtggaagtcgtgaacccacatcagttttcaaagtgtaatcagtcctgggaaactttttttttttttttaagtgccataccttcaagtctgtaggtattaagaattttgtcatgcaaaagactctcaggggaatatagtagcagtttataagcctataactaacaaatcagaatccttgcatttagtaatcatattgccgatagatttttcagagaaggaagtttaaggctgcagttttaatttgcacatagtttagagaactaagtccttttttttctgaagtactgtgctaggaaaattctcttactaaagcacactcactgtcttatgaatcttctgagatgagcaataaaattttttcctggccggctcacgcctgtaatcccagcactttgggaggccgaggcgggcagatcacctgaggttgggagtttgagatcacctgaggttgggagtttgagaccagcctgaccaacatggagaaaccctgtctctactaaaattcaaaattagccgggcgaggtggtgcatgcctgtaatctcagcaacttgggagcctgagacaggagaatcgcttgaacccagaggttgcagcaagccgagatcatgccattgtactccagcctgggcaacaagagtgaaactcggtctcaaaaaaaaaagtttttcgttggatgtttccatttccttgaaagtgtcttttcattttattcttaacctaatatgcactaagacgagtgggtatttcttcttcattttgtggttctgctaatgccaaagggtaaatagagatgacaaaattagtatctatggagaagtttaagaaatcatacaatattcttacagaaccaaagggtttttttaaacctttttcactgcttcttctgttcactgcttcttctgcttctttcaatataggaaaagcttgatgcagtggaaaagtaaaatgccctccatatactcttagtggccacagtgctaattctctccctcttgttccctttcttccctccttgtcataatatattgaagactaaggcttccataggaaaagctagtataaagataaagctatagttccttggaatctagatcaaaatgattttttttttttgagatggagtcttgctttgtcgcctaggctggagtgcagtggcgcgatctcagcttgctgcaacctctgcctcctgggttcaagcgattctcctgtctcagcctctccagtagctgggactacaggcgtatgtcaccacacccggataatttttttgtatttttagtacacatgggaattcgccacgttggccaggctggtcttgaacctccgaagtggtgggattataggcgtgagccactgcgcatgagttattttttcttttttttgagacagtctcgctctcttgcccaggctggagtgccatggcgtgatctcagctcactgcagcctctgcctcccgggttcaagcgatcctcctgcatcagcctcctgagtacctgggattactggtgcccgccaccacacccagctaatttttgtatttttagtagagatggggtttcaccatgttggccaggctggtctcgaactcctgacctcgtgatctgcccgcctcagcctcccaaagtattgggattacaggtgtcagccactgcacccggcctattttttatttatgtaaaattgaaagaaggaatcttgtctatttcctataatccttcatgctacatgaaagctcgatgaggacagtgtgtgttgtttactgtattctcataagtaaatagatgaagcaccaagcccatagtagatgcttaataaatcctgaattttctgacttctccattgcatgaaaatatttgtgtatatttgcttttttcctggggagtatggtaatttatttcatcaaatttacaaagaaacctgactctaaaaaccttaattactgagcaggaagaagaaactgtttttttaaaggtcaaattttctgccttaggggtggagttaaatgtccttaaagggttgactatatctcttcttggaactcttaaaagaatatgatcatgttaactgtaaataggcttctgacctgggttagaattagcgcagtttgctctaggctgtgctggtctggtcaaatctggtagccaagggtgcagcagagtgctaaaggcagataatccaggtccgaatcagggttcacctttagaggccaaacttgtagcatttataaacaccggttttgattactgtatttagttaaatgactttttttttttttttgagacagagtcttgctctgtcacccaggcgtgatcttggcttgctgcaacctccacctcccaggttcaagtgattctcctccatcagcctcctgagtagctaggattgcaggcacccgccaccacgcctggctaatttttgtatttttagtagagaccaggtttcaccatgttggtcaggctggtcttgaactcctgacctcgtgatccacccggattggcctcccaaagtgctgggattacaggcgtgagcccggctagttaaatgacttaaaattccagatagaataagttcagtgagacttcaaactaaacttgtagacaccattaccatgacccctctccatactcccaaatttgtggagctgatcttttaagcaaggtcagtgatttcccacacatctaggtctggattaggtaccccaagtatttcaaggctcaagatattgtaagtaccatgttatctataacataggtttgatcatcataactttttgtctccttaaaagtaggattggaaacacgatggtggccacagaagttggaatccactgagtgtgtaacaactcacctgccaaaataagaaaaaaaagaaaagtagggtggctccaagatttttgataaaacaaaaaaactgtcccttctaaaatcctcctatatgttttttgtttcattttgttttgttttttttgagacggagtttcgctcttcttgcccaggctggagtgcagtggcacaatctatgcctaccacaacctccgcctccaggttcaagtgattctcctgcctcagcctcctgagtaactgggattacaggcatgcaccaccacgcctggctaattttttgtatttttagtagagatggggtttctccatcttggccaggctggtctcaaactcccaacctcaggagatctacccaccttggcctcccagggtcttgggattacaggcatgagccaccatacccaggcagtagtgttttcttttctttcttttttttgtttcattatactttaagttctgagatacatgtgcagaatgtgcacaggtttgttacatagtgatacgcgtgccatggtggtttgctgcacccatcaacccatcatctacattaggtatttctcctaatgctatccctcccctagctccccacccagtagtgctttcttaattcgttttggtacacctatgtatacttaagatttatgatatcttgtgttatatggagaagctgctatggggattgtttacagattgttaaaccctaaaaagtacctgggataccttgtattccttagaagtcttgaaactcccaacagatttgcattcattcacaaatttttttgagcatctcctatggtggtggttgttccatgttctgggttcacactggcataaaagacaagatccctgtactcagtggtgcttaccttttagtgggataattaataaacaaaatgaattaatgacctaaagatcctacgtcaatttttagcttttttttcctttttggatttcatcactcccttaggaaatgaagctaccattgcatcccacaaccagtgagtttgatgagctgtgtcggttggatttttacttgggtatattttatatctgccacaagagatgatacttcatttatgagtctaagttggattattccccaagccccattcggaagccttcattggactttattctccaattgtagccggtgatctaggaacctttaacaagttcctagcctcatagttcagttgaggatagggacaaataagcaacaattacaagtttaggtgccatgatagaggaagtacaaagtactctaggtacaggaaagatttccctaaggaggtgatagttatacaagctgaggcccaaaaagttagaaggaagaatgttccaaatggaaggaacagcatgtttgaaatcttggagatgagaaagaatggtgagctcaaggaactgaaataagtttagtatggtaggaactaagagtctgaagatggtgagtagtgaagggtttgttgtttcatatgatgcttgaaaggtaagcagtgggctgagtacggtgactcacacctgaaatcccagcacttcgggaagccaaggcaggaggatcgcttgagcccagtagttcaagaccagcctgggcaacatggcaaaacccctctctacaaaaaatacaaaattaagctggacgtggtgacacgcacctatggtcccagctacggggggatcgcttgagctgtagaaggcggaggtcaaaatgaggcgggattgtgccattgcactctagcctgggagacagagaccctgtctcaaaaaaagacagataagcagtgataagatcctgtaccttctaaaatctttatcttaagcgggggtagagtgttacatgataagataggcattttgaaagcatctctctggtggcaatgtagagtcgattagaaacaacaagaatagcggcaggaagacaaatttggaagctgttgtagtagtttagctgagaggagatgatggcaaggactatggtagtccctccgatgatggagcgaggtgggcaaggtaaagaactatttttttttttgagacagagtctcgctctgtcgcccaggctggtgtgcagtggcgcgatctcggctcactgcaagcttcgcctcccgggttcacgccattctcctgcctcagcctcccaagtagctggaactacaggcgcccgccaccacgccggctaattttttgtatttttagtagagatggggtttcaccctgttagccaggatggtctggatctcctgacctcgtgatccgcccgcctcggcctcccaaagttctgggattacaggcgtgagccaccatgcccggccggtaaagaactattaagagagaattaatagaacttggtgattgcttggatataaggactgaggtaggaggaatagtcacagttgggtgttggtgctaatccctgagagagagctcaaagtgagaagtggggagaggagtggtgagcagttcagtattgaatgtgttgaatttaaattactatgagtaggatgttcaaaaagagctgtctaggaggcagagtggaagagtatggccccaaaagagtggaagagtatggccccaaaggagactggaaaggagaacaggaggaagtcacggacgcaaagggaagattgttaaagaagggaaggttgctcgccgtgcgcggtggctcacgtctgtaatcccagtactttgggaggctgaggcgggcggatcacagggccaggagatcgagaccatcctggctaagatggtgaaaccccgtctctactaaaaatacaaaaaattagccaggcatggtggcgggcgcctgtagtcccagctactcgggaggctgaggcaggagaatggcctgaacctgggaggcagagcttgcagtgagccgagatcatgccactgcactccagcctgggtggcagagcgagactctgtctcaaaaaaaaaaaaaaacaaagggaaggttgctgaacacatcaactgatgctgaaagatcaagtaagaaaaggccaagatcaaggggcgaggagatggtcactttatgagagaactgtcagtggagtacagagaagggtgcaagtgagactgcagtgttgagagaaaggtagtaaagttgaaagagtaagtatagatagctcttcagcatactttcttacaggtggagaagagaaagggagggtgctggctaacttgtattccaagttccttgagaggaggatgaaggtcctatttatctgtgttattgagtattgtatctggtctattttcttgaacaaattttagatcctaagtttcctgagaataggaatgatctcacttatccttgtactcagagcctagcacaatatgcattcagtaagtgattgacttttttaaatttttagtagagacggggtatctgtgttgtccagactagtctccacctcctggcctaaagcaatcctccctccttggccccccagagtggtaggattacgggcgtgagccactgcacctacctatgattacttgttcaatgaatcagaaaagatatttccatatttttgaactaaaaaataaaactttttttccttatagataaagcatatgatggctttcattgaacaagaagccaatgagaaagcagaagaaatagatgcaaaggtgagattcattttctagttttaagaagttatcaaggtttccatattgttttgctttgctaaataatattgttagtaaaactgcttaacaacagattgcatcggactgataaaaatgtctcttccttccctccttcccctccttccttccttcatttttttttttttggagaccgagtttcactcttgtcgcccaggctgaagtgcaatggcgcgatctcggctcactgcaaactccgcctcccaggttcaagtgattctcctacctcagcctcccgagtagctgagattacaggcatgtgccaccaaacccagctaatatttgtatttttagtagagacggggtttcaccgtgttggccaggatggtctcaatctcttgaccttgtgatccgcctacctcgtcctccccaagtgctgggattacaggtatgagccacagtgcctggccccttctttcattttgagacagtctcgcttcgtcactgggactgcagtgcagtggcctgatctcagctcactgcaacctctgcctcccgggttcaagtgattctcctgcctcagcctcccaagtagctgggactacaggcaggcaccgtcacacctgtctaatttttgtatttttagtagagacagggtttcaccatgttggccaggctggtcttgaactcctgacctcagatgatccacccgcttgggcctcccaaagtgctgggattacaggtgtgaaacaccgtgcccagccctatttatttacttttttttttttttttttttttttgagatggagtctcgctctgtcgcccaggctggagtgcagtggccagatcttggctcactgcaagctccacctcccaggttcacaccgttctcttgcctgagcctcccgagtagctgggattacagacacccgccaccacgcctggctaattttttgtatttttagtagagacaaggtttcaccacattagccaggatggtctcgatctcctgacctcgtgatctgcctgcctcggcctcccaaagtgctgggattacaggcatgagccaccacacccggcctttatttactttttaatttaaattttaccttaataaattcctcattggaaatgtctgtatctttaacattaaaaaataaattttcctttctaatggttgtgatgccaataagtgtcctgaaattttatgttagagggtagaaaagtaatgtatgattcattttctcatggaaaccaaaattcagatatttaacaaccgtggcgaactgtgataggtgactagagaaggttgtagtgtttcattgtttagcttttttgttaatctgtgctcattgcaaaaaagtaaagtttgggctgggattggtggctcacgcctgtaatcccagcactttgggaggccaaggcaggcggatcacctgaggtcaggagttcaagaccagcctggccaacatggtgaaaccccgtgtctactaaaaatacaaaaattagctgggcatggtggtgtgtgcctgtcatcccagctcctcgggaggctgaggcgggagaatcgcttgatcccagaatgcagaggttgcagtcagcagagatcgtgccactgcactccagcctggacgacagagtgagaccttgtctcaaaaaattaaaaaataaaaaataaaaagtttggaagtatatagggtataaaatgaaaaccccacccattacaaaggtgaccttccatcagcatttagaagttttatatatatttccagttgtacattgcttatgccaatttatattccttaacagtatgtcaaaatgttcttttcccaaggtataatcataacacgcattttttaaagcttgccttaaaaatattaccaaaatatggccggggcggtggctcacacctgtaatcccagcactttgggaggccgacacaagtggatcacctgaggtcaggagttcaagaccagcctggccaacatgttgaaaccccatctctacaaaaaatacaaaaattggttgggtgtggtggtgcacgcctgcagtctcagctactcaggaggctgaggcaggagaatcacttgaacccgggaggtggaggttgcagtgagctgagatcgcaccactgcactccatctagcctgggtgacagagtaagactctgtctcaagaaaaaaatcagtaaataaaatatgaccaagatatattgtttaatattttcattgtccttttagtacagccttaaatttttatgtgcctggtactctagaaataaaactctctgaaaccttgggctatttgactagtttatcatttgaagaagaaaagactattttccctctcactaatacataacagctgataggatattgcttaatattgttttgatggtgatagtttcttgtatgactcttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacacccggctaattttttgtatttttagtagagacggggtttcaccgttttagccgggatggtctcgatctcctgacctcgtgatccgcccgcctcggcctcccaaagtgctgggattacaggcttgagccaccgcgcctggcctcttgtatgactctttctggatcaaatacagaagtcctatttcagctattatttcaggaaatgcatttcttttttttttttttttttgagccggagtttcattcttgttgcccagactggagtgcagtggcgcgatctcagctcaccacaacctccgcctcccgagttcaagcgattctcctgcctcagcctcccaagtagctgggactacaggcgcatgccatcacgcccagctaattttttgtattttagtagagatggggttttactgtgttgcccaggctggtcttgaactcctgaactcaggcagtccacctgccttggcctcccaaagtgctaggattactggcgtgagccaccacgcctggcctcagtaaatgcatttctgtctcaaatatttatttattttatttagttttgagacggagtctccctctattgcccaggctggagtgcagtggtgcaatgtcggctcaccacaacccccacctcctgggttcaagcaattctcttgctttagcctcctgagtagctgggattacaggtccctgccaccatgcccagctaaattttttatatttttaatagcgatggggtttcaccatattggccaggctgctgtggaactcctgacctcatgatcctccagcttcagcctcccaaagtgctgggattacaggcgtgagccaccacgcccggcttttgtttgtttgtttgtttgtttgtttgttttttgagatggagtcttgcactgtcgcccgggctggagtgcaatggcacgatctcagcacaccgcaacctctgcctcccaggttcaagtgattctcctgcctcagcctcctgagtacctgggactacaggcacctgccaccacgcccagctaattttttgtatttttagtagagatggggtttcaccgtgttagccagggtgatcttgatctcctgacctcacgatctgcccacctcagcctcccaaagtgttgggattacaggcgttagctaccgcgccaggccaatttttgtattcttagtagagatggggtttcaccatgttggccagactggtctcgaactcttgacctcatgatccacccgccttggcctttcaaagtgctgggattgcaggcgtgagccacctctatcgcccaggctggagtgcagcagtgtaatctctgctcactctaacctctgcctcctgggttcaagcgattctcctgccttagcttctgggtagctgggattacaggcgcctacccaggcccaggtaatttttgtgtttttagtagagacgggctttcaccatgttggccaggctcgtcttggaactcctgacctcaagtgatccgcctacctcggcctcccaaagtgctgggattataggcctgagccactctacctggcctgtttacgtataataaaataatgtataataaaatttatgtataaaaaaattaatattttttttggatggagtcttgctctgtcacccaggctagagtgcagtggcatgatctcggctcactgtaatctctgcctcctggcttcaagcaattctcctgcctcagcctcccaagtatcttgaactacaggcgcccgccaccacgcctggctaatttttgtatttttagtagagatggggtttcactatgttggccaggctggtcttgaactcccgaccttgtgatccgcctgcctcagcctccgaaactgctgagattataggcgtgagccatggcgcccagcccataatttatatttttaaatatatgcgacacttacccatgagggaaaaaaaattttttttttttttgaaacggtgtctcgctctgctgcccaggcgcgatctcggttcactgcaagttccgcctcccgggttcatgccattctcctgcctcagcctcccgagtagctgggactacaggcgactgccaccacgcccgcctaattttttgtattttttagtagagacggggtttcaccatgttagccaggatggtctcgatctcctgacctcatgatccgcctgcctctgcctcccaaagtgctgggattacaggtgtgagccaccgtgcccaggcaacttttttttttttttttaagagttcgcttttgttgcccaggctggagtgcaatggcgtgatctcagctcactgcaacctccacctcctgggttcaagcatttctcctacctctccctcttgagtatctgggattacaggcatgtgcccaccatgcgcggctaatttttgtgtgtgtgtgtgtgtatttttagtagagatgggatttctccatgttggtcaggctggtctcgaactcccgacctcaggtgatctgcccgcctcagccccccaaagtgctgggatggcaggcgttaggccaccatgcctagcctttattttttatttttatttttttagatggagtttccctcttcttccctaagctagagtgcagtggcacgatctcggctcactgcaacctccgcctcccaggttcaagcgattctcctccctcagccttccgactagctgggattacaggcatgcgccgccacgcctggccagttttatatttttagtagagacgaggtttctctatgttgatcaggccgatctcaaactcctgaccttaggtgatctgtctgccttggcctcccaaagtgctgggattacaggcgtgagccactgcgcccagccaactttttaatttttttaagttcattttacaagagaggacactaagcctgaggttactcgaccacattttatgggcagtaatctggatctttgtttttttttgagacagagttctgctctgtcgcccaggctagagtgcagtggcacgatctccactcgctgcaagctctgcctcccgggttcacgccattgtcctgcctcagcctcctgagtagctgggactacaggcgcctgccaccgcgcctggctaattttttgtatttttagtagagacagggtttcaccgtgttagccaggatgatctcgatctcctgacctcgtgatccacccgcctcggcctcccaaagtattgggattataggcgtgagccaccgcacccggccaggatcttctaaactttcaagttctgtgtcatatttattggcccaccagtaagctaatggattaagtttcgaacgtgtggtaatttttttcatgagcagaatattctacccaattatatcctttagtaacttgtcggttactgttacccttgacgaaatttttagtttcctagtacgtcatttataatgaaaattgctgatctttccttttgaataaattagaatccttgaaaatgaatcacaataaattttctgttttatatatgaaattagtgttcataagcaagtaacgcaggtcaccagctgtttaaaactgttaatcaaaacttgatgtaatgaattaatattgactaatttccctctaggcagaagaagagttcaacatagagaaaggtcggcttgtgcaaacccaaagactaaagattatggaatattatgagaagaaagagaaacagattgagcagcagaagaaaatgtaagtagatcctggttgcagtattaagctaagaagttttctgaagtcatgagcaggcgctttggagtcaggcatatataaattcaggtcttaactcgaccacctactactaatctgacaaattgtttaacttctctttcttcatttgtgaaaattaaagcctgacaggattattcaaagattaaactgcaggctgggcaaggtggctcacgcttgtaatcctggtgctttggggaggccaagggaggaggattgcttgagcccaggagttcgaattctttctctacagttttaagttgttactaatgctatttttcaataccgttttgcagtcagatgtccaatttgatgaatcaagcgagactcaaagtcctcagagcaagagatgaccttatcacagtgagtaattagcccctattagttataaaattattacatgtttattcatttccctgttgtaaattactagttaacattaattaaggagttgattgaataatctttagagagaaaacattccaattattataataaatacaaaagtgaataagagccaaggcctgtattgaaggaccttctgatctaaagagcatgtaagactctcctggattatagcacacactatgggtggaccgcacagtagtacatgagggtacagggaccagtgagaccagaaccataggatggttaatacagaggccatgagtgtgaggctgaagagcttcacctgttttcaacagaaagctgtggaaacttttgtattattttgtggagaatatcataaataaggctcatgatataagcgtgcaggctaaatttaacagggaagaggctggaaaaaagaaaaccatatggaaagtattatagtcctctaaggaagagggcagaaaccttcagaagcataccacttcattgagaaagtgtagagctatttggattatattcataagccaaacagggatgcctgctgtttccactgttactcattgtgactgtggaggccctagattccttatgagttggagaaatgagagttacataaatattgggatagaagaaacgaaattaccatctttgcagatacggttattcaagcagaaaatataaggttcaaaaaacataagatcctataactaatccagcaatgtgactggctacaaacacaataggaaatgaatagttttcctgtatgccaacaataaccagtttgcaagtaaaataaaaagtagatctctctataatagctactaaaattattaaattactaggagtaagtcctatatgaaaacagctataaaactaaaaatatagaacttgaaaaaatggaagacatactgttttcttagatgagaaagaaacacaaaccagtattccaagttgtcagttcttattaattgatggtggcagtgagaactgagtagcagtgttagtgttgatggattttacaggaagactttccagacattcattgactctgccttttcttccaagtccatcactaaattctgagtatcaggtgtggatagactaggagaatggtggatccattaacaaaaatgggaagtcaagatgctgaaatgtttcgttaagaaaaataactagttcttttttctgtttgtttgttttggcatccctgggtgggctggacttttggacatgtttgagggaccaagaaacctccagatgtaagtgtcagtgaggatgttaagtgtaaaggactgatatttaggacaccatagagatgatttactaatataactcctatattacttcaaataataaaagttgccccaaatttaagtgctttatctgctttgaaactccaggaatgtgggaaaatacaaaatctgttgccagtttatcttgccacatgggattagttcatcccctttaaaatacaaaagaaagagtcaagagtttcctggggaaatgttgcctgcaaaatgttactagctcaggacaactgttattttgcgtcttcactaaagtgtcaataatcaggagttgatttccttccaggggattcaaattcctttagcaacttggattgactgaattaatttataacaggcttttacaataataatgtcttagggaaggtagtttgttgtagaagggcttggggcttaagagtcagtcagctatgagtttaaatgtcaactctgccatattcgtttgtctaaattactgtttctgaccctcggttttctcttgtattcattatctatgttatgtatattcattatgatgtttggttcagagtgcttatgagaatcgaatgagagaacacatttaagtcctctggcatgtaacatttgtcatatcgtgtttaaaaaatgttagttccctttctccaaccccatctccgtctccaccagtgataacccttccttctaataataggcctgtgtagataaaatattcttagcttattgggtgctaatgcccagaaagcctcttgactatagtcttttcattatttatgcccaaagtaaaaaatgacaactgtgacatctactgcatagatattattatttgtacaattcaaaaaagtttagaggcatgtaatgttaatgtcttggcagcattcctaaatataagtagcaagggctataacacacaaggttatagcaaaagattatagtcttagctagttaataggctttataattaggttttttatttggtttgttttttatgccacctttttgaaggttaataatattaagagtggaaaagattctgagaaagatcatctaacatattatagaaatggttttgatgatacattctctgatgctgtcctgccttagatggtataccgacctttcataactggatgtaaacaacccataggtctagtggatttgacttgacttgtaattttaacttgttatttattgcccttattttctctttgctttaattttttaatccacttgtttatattttattagttattttttctaatttgctttttaaaaaacgtaattaacgttttcattagatatacttctgtaagctgccttaaatctattagaatatataaataattactagttggcttttagaaggaatttttttttaagaggcatggtctggctatgttgcccaggctggaatgcaatggtgcagtcatagctcacaaactcctgggctcaagcagtccttcccacctcagcctcctatgtagctgggataacaggcaagagccaccatgcctggcctcagagggaaaatttgaagtggcatagataagaaaacttgacacctaaaattcagatcattcattcatttatcaaatacttcaatatcggtgcttctcaacttttttcccttctctctggaatattcatacagttattttacattttagtaacatctctcatgacacacagtggttttcaaattttgaggtggaggatattaaaagaaagtgtggggctgggcgtggtggctcagacctgtaatcccagcactttgggaggccgaggcgggcggatcacgaggtcaggagattgagaccatcctggctaacaacggtgaaaccacgtctccactaaaaatacaaaaaattagccgggcgtggtggtgggcgcctgtagtcccagctactcgggaggctgaggcaggagaaaggcgtgaacccaggaggccgagcttgcagtgagctgagatcgcaccactgcactccagcctgggtgacagagccagactccgtctcaaaaaaaaaaaaaaaaaaaaaagagcaggatgggcatggtggctcacgcctgtaatcccagcactttgggaggatgaggcggatggatcacttgaggtcaggagtttgagaccagcccggccaatgtggtgccctgtctctactaaaaatacaaaaaaattagctgggtgtggtggcgggcgcctatagtcccagctactcgagaggctgaggcaggagaattgcttgaacccgggaggcggaggttgcaatgagctgagatcccgtcattgcactccagcctgggcgacagagtgagactccgctcaaaaaaggaaaaaaaaggaagtgcagttgtatggaatgaatttttgtttgtttgtttgtttgtttgttttgttttgttttgttttttgagacggagtctcgctctatcgcccaggctggagtgcagtggcagtggcgcgatatcagctcactgcagactctgcctcccgggttcacgccagtctcctgcctcagcctccttgagtagctgggactacagacgcccgccactgcgcccggctaattttttgtatttttagtacagacagggtttcaccgtgttagccaggatggtctcgatttcctgacctcgtgatctgcccgcctcggcctcccaaagtgctgggattacaggcgtgagccactgctcccggccaatgaatgtgttttaatttcaacttaggatagttttccaaaatacagtaatccatcatattctttcagagatgggctagccaggtgccatggctcatgcctgtggtcacagcactttatgaggccaaggtgggagtgtggcttgaggccaagagtttgagaccagtctgataaatatagggagaccctgtctgtacaaaaaatttttaaaaattagcaaggtgtggtagcgcatgcctgtggtcccagctactctggaggctgagatgggagaatcacttgagcccaagagtttgaggctccagtgagctgtgattatgccactgcattccagcataaatgacacagggagaccctgtctctaaaaataataaataatagaaacaaaaagaaatgggctagagaaaaataattctttttatgaccttgaaagacaaagcagtcattcagttcataccacatgtctttcccggatttagtcactctgagtttgtctgctgactttaaaattgttgcaaacaaaattctggttttggtactcatgttatccctcagttgtcactcttctgttttcatgtcataactcagttgggttcccttgaggcactaagctgtttgaatttaacagtacatttatcccatgtgtcctgtatcgtgctggcccctctaggagtctgcagtctaataggacctggacaagataatacatctccactacagctgtttgagcatgacttgaagtattagtcatgggataggatacagaatggagagagcagtgtgagtgaaaaaccgagacctgaatttgacatgtgcgggaaacagaggtagtctggcagagtggggagtgggcagagaacaggccacatattagggtctaattagaagggccttgagtgtctgctgaagaatatggacttcatccttttggctaattctctaactttaatgggcataaaaatcacctgggggaccttgttaaaatgcagatgttcattcccatttccagagacttttatattctagtcaggagtcagcatttaaaccagcagctcagggtaatcttggtgcaggtagtctgagaaccacactttgagaaatagtgtttaatggttacatttgtgttagaggaaccccactggtgaccatgtggagtagaaacaaggagggtatggcttaccttccaggtcgagaagtagaatggtggcagcagaaagagaagacaggcctattccagagatcctaaaaaggtaggaatctgtaggacttggtgacttacagttgtgatgagtgaatgcaaaggagtcaagaatgacataagagtttgtagtctaggcaactggtagatggaatgaagattagaaatatgggaagataatcccagcactttgggaggccgaggcaggcagatcgtgaggtcaggagatcgagatcatcctggcaaacatggtgaaaccccatctctaataaaaatacaaaaattagctgggcctggtggggggtgcctgtaatcccagctacttgggaggctgaggcaggagaattgcttgaaccagggagtcagacgttgcagtgagccaggatcacgccactgcactccagcctggcgacagagtgagacttcatgtcaaaaataaaaaaaaaaagaaatataggaagaacaggtaaagaatggtgaaaaaaatcattgtgtttgaattgccttaggattccaggtaaagctctatgagtctgttaggagagaagaggagcttatgtggagacaacacagaagtccctgctggagctgtggttttggatggagaattagaagagaagcgggccaaaaaaactgagaagcatcagatttaatagaaaataaattgctaaggaaatgtgggggaaagcagttatgttggagaatacagagaagccaagggaacggcaaactcaaaatggtctctaatacagtgttcaatgtttgagagaatgacagtgggaagagcatggtggtctttggatttggcagtcaagatgtcgtttttcacatttgccagagcagtttcattggactgatgaaggcagaaagccagattgttatggcatgagaagggagaagtgcgtgtgaggtgaggagctgaaggcagcgtgcgtggcctgttcacaagctgggctgtgtgttttaatctcttttggaacaaatccaagtatactgttgcatgcaacttgaattcagtatatagcttgagcttttatattatttctctgacttataatgagaattttgagaagataaacatttatgtaatttcagttattctaaagatacttgtttcttttttaaccgcttacagtcttaacttcttgccgtcattgaaccctgtaaataagagatgtggagagttgaggaaacagactgtgaaatgataccgatcaaacaggattcaatctgcataaaagcacacatacatgctttgagtggattttgctatttctaaactttttacttctagttttatccatagaataagaagctgtgaaaggaaaggaagttgtcatgcagttagaaaaggatattgacaaaagatggaaggaaggggaaaaatacagaactggggtaaaaattaaaagaaaataggcaagttgtgtggtgctttggtctaagttgcataatcctttatagatatttgtctgtgttgatcctttttccttgcctgcccaggtgttttccaggattaagagtgcaggctttggaattcctttgaggtttaagttccgtttttaccattcccagctgctcagtaggcagatttttaaaccccactttactcctttgaacccttcatttcttataaaaagtaggagaaggccaggcaccatcccccatgcctataatccccacactttgggaggctgaggcaggaggatagcttgagcccaggcattcaagaccagcccaggcaacacagtaagaccttgtctctactaaaaattaaaaaaatgtagccaggcgtggtggtgtcccagctactctggaggcagaggcaggaggattgagctatgattgtgccactgtacttcagcctggatgacagagcaatgccctgtctcaaaaaaaaaaaaaaaaaaaaaaagagaaacatctacctaaagcttatttagaaaaaaattagatcacctaggtagagtgactagtataatgcctaaaacaaaatgagtgttgagtgaatgatagttctttattatcatttccccaaaccgcaaaacttacaagttttcttttttctttttctttttgagacggagtttcgctcttgttgcccagcctggagtgcaatggtgcaatctcggctcactgcaccccccgcctcctgggttcaagtgattctcctgcctcagcctcccgagtagctgggattacaggcatgtgccaccatgccaggctaattttgtatttttagaagagatggggtttttccatgttggccaggccggtctcaaactcccgacctcaggtgatctgcctgcctcggcctgccaaagtgctgggattacaggcatgagccaccatgcctagccataagttttcttttcttttcttttttttttttttttttttttgagatgaagtctcactcttgtcccccaggctggagtgcaatggcgtgatctcaactcactgcagcctccgccacccgggttcaagcgattctcctgcctcagcctccccagtagctgggattcaccatgccctactaattttttgtattttaggtagagacagggtttcaccatgttggccaagccggtctcaaactcctgacctcaggtgatgcacctgcttcagcctcccaaagtgctgagattacaggcgtgagcaaccgcacccagccaagttttcttttttaaacgagaataaataagcattaacatttaaattctgagacattggtactgaagtggagatttctattgctgtggttagagatgaaatagaaataaatgtctttggccgggtttggtggctcatgcttgtaatcccaacactttgggaggccgaggagggcggatcatgaggtccggggttcgagaccagcctgatcaacatggtgaagccctgtctctactaaaaataaaaaaattagcaggcatggtggtgtgcacctgtaatctcagctactcaggaggctgaggcaggagaatcgcttgaacccagggggcggaggttgcagtgagccgagatcgtaccactgcactccagcctgggcgacaaagcgagactccgtctcaaaaaaaaaaagagaaaacaaagaaataaatgcccactgactcttcagactaggcagggccagggagatatggttttgatgttgacatcataatcaggttttggtttcctgcttttgaggagcaggaaatattttcagaatcctcagggcagttaggttcagttgggcagattttcccttccaaactcataaaatacaaataagcccacatgtgaactgcagtagtttacagtgagagacacatgttgctgtggaaaagctacatgaggagccagattataaccagaaagttaattgaagttagagtcacaccagagggtgtcactgggatgttaggagcttatcacacggatggtaattattgatcataatttacctttctctcccgtggtgacatagtggacaggcatgcttcagacaagggataacacagtttatgtcaattaggttctagcctgcttagctagagtttagtttatttagactcaacgaattggccttttaaaactccttaattaccgtttccctgttttccatagtagattccttatgcaaatggctagtagcacgctccacaagttgacattacttaatttactggagtagcctcgtctccatactcaggctgtctatccctgtctgtgtgaccagtgtggatagggtgattccagcacagagaggaaaaatgttagagggctcttttggtggggaggagctaagagttctttcagccagatgtcttatagacagggtgtgtatcccttatctgaaatgtttgggaccagaagttttttggatttcagattttttggattttggaatatttgcctacacataataagatattttggagatgggacccaagcctaaatacgaaattcatttttagtagagatggagtttcactctgttgcccaggctggcctcaaactctgggtttaagtaatcagcccgccttggtctctcaaagtgctgggatcagaggtgtgagccactgcacatggctgaggctgtgctttctcttgagccttaaaaacacagtttcccaggttggagtgcagtggtatgattatcattcacgacagcctcaaactcctggactcaagggattcttgcacctcagcctccctagtacctgggactacaggtgctcaccacctgatttttttttttaattttacagagacgaggtctcactctgttgccccggctggtctcaaactgctgggctcaagcagtcctgccacctatgcctcccattaaagactgcattttaaagtttctttaagtctgggcatggtggctcacacctgtaatcccagcactttgggaggccgaggcaggcagatcacttgaggtcaggagttcaagaccagcccggccaacatggtgaaactccgtctctactaaaaatacaaaaattagctgggtgaggtggcgcacgcctgtaacactcaggaggctgaggtgggagaatcgcttgaacccgggaggtggaggttgcagtgagttaagatcaggccactgcactccagcctgggcaacagagcgagactccgtcttcaaaataataataataatgtttctttaaaataactatcatacagtatgattactttttctccatttaacaagtggtgtgctctgtttaactttatttacaattataaatgagtgaaagtatgattcattgaccaatgaatggcattaaatcttgtttgttttagggacagagtatgtattataaaccaaaatcttagaataaataaataatgtttaagtgttaaaagtttctaaagacagaaactatatttatcacttggtatttggaatctttgcatttggagcttaagaaagtcaaatggccaggcgtggtggctcacgcctgtaatcccagcactttgggaggctgaggcaggcggatcacgaggttaggagattgagaccatcctggctaacacggtgcaaccccatctctactaaaaatacaaaaaaattaactgggtgtggtggcgtgcgcctgtagtcccagccacttgggaggctgaggcagaagaattgcttgaacccgggaggcagaggttacagtgagctgagatcgtgccactgcactccagcctgggcaacagagcgagactgtctcaaagaaaaaaaaaagccttgagttttcttttagcccttaagccttattacttaacaaatgatatccagtgtgttctcagccatatgagatttgtttcctgatagtattcctattttagttatttttattatagaagccagtgtttattggagacagattagaaaatacaaactaaccaagaaaattgaggctggatatgttggcacactcctgtaatcccagcactttgggagatcgaggtgggaagattgcttgaggccaggagttcaagagcagcctgggtaatatagcaagactccatctctataaaaaataaaataatatgagctgggtatagtggtacacgcctgtggtcccagatattgaggaggttgaagcgggaagatcacttgagcctggatggtcaaggctgtagagagccatgattgtatcactgcactgcagcctgggcaacagagcaagaccctgtctcaaaaacaaacaaagagggctgagggcggtggctcatgcctgtaatcccagcactttgggaggccaaggcaggcggatcacctgaggtcaggagttagagacgagcctggccaacatggtgaaaccttgtctctactaaaaatacaagaattagctgggcgtggtggtgggcgcctgtagtctcatctactcaggaggctgaggcaggagaattgcttgaacccatgggtggaggttgcagtgagccgagattgcaccattgcactccagcctgggttagaagagtgaaactccatctcaaaaacaaacaaacaaaattgaaattattcgtaatctggccttccaaaggtagactgttcgtatttcgatccatagccagacatctgttttttttccttaaaaaaaatggggtaatcttgtataaccgtttaatagcttgcttttcaaagttacatcgcgcgcatctttccatgtcagtcacttgtgtcggtttctgaactgatggttacctgagctattctctgctaggccgtggactccctgggagcagagacggtgttacatgcttccttgtacccagcacagcccctgctttatctcagatctcagggaatgtgtgttgaatgaaaatccagcaataaaatgtgaggcagctgggcatgagccaggatcagcctcacagtgggttctgagccgactgcccagatgtgtagataacttttatcttttctaatctttgtaggacctactaaatgaagcaaaacagagactcagcaaggtggtaaaagatacaaccaggtaccaagtgctgctggatggactggttctccaggtaccctcatagaccagatctactgttgatagccacagttctgagaaaatttagaatgcctattagagaccagctctattttttcctgctttctcatttctctagtttttttcctttcaccctttttttttcttttagcttttttactttcactcttgaccatatctaaaatgtgtgctgcataggaaaatagtaaatctgtctgcttggataagacttccaggcctactactcaattatgtagtcttacatgacttaagggtcaaatttgcttgcaatggctagctttaaattcccttaatttgattttgccactaaaatacttgctttagatttaggattcagaccaaacactgtatatgttttaattgtttactgctgagctgtgaatccttattttacttatgttaattacaataatatttgtcctcagcttggttgatgtaatataagatgtctgcatgaattttgtttctatcaccaaaggtttgggttcatttatctggtttgggatagatagatctttccatggtcttatgtgatatatgccatctgttagtggaacttaccaggggaaatttttccaacctaaatgaaagaactgtagaagcatcttattttactgttgctttattttattttatttttatttttggagacagagtctcactctgtcagccaggcaggagtgcattgacatcatctctgtttacttcaacctccgtctcctgggttcaagccattctcttgcctcagcctcctgagtaatctgggattataggcacataccatcattccaggctaattttttgtatttttagtagagatggggttttgccttgttgcctaggctggtctcgaacttctgagctcaggcaatccgcccgccttggccttccaaagtgttaggattacagacctgagccactgtgcccgacctgtttctttattttatagtttgcattttctactgactgtatctactatttcttccagggtttgtaccagttgctggagccccgaatgattgttcgttgcaggaaacaagatttccctctggtaaaggtaaagaacttaggataattttttccctccctccctcccccctccctttcttccttcccctctctctttcttttccttccttccttccttttcttttttttttggtggagtctcactctgttgtccaggatggagtgcaatggcgggatctccactcacctgtaacctctgcctgccgggttcaagcgattctcctgcctcagcctcccgagtagactagctggaattacaagcgtgtgccaccatgcctgactaatttttgtatttttagtagagggagggtttcaccatgttggccaggctggtctcgaactcctgacctcaggtgatccacccgcctcgtcctcccaaagtgctgggattacaggcatgagccaccgcgcctggccgtaaaaacccacttctatcttttattccagggatctagtttcctttttttttttttttttgagatggagtttcgctctcatttcccaggctggagtgcaatggtgcgatctcggctcactgcaacctctgcccccccgggttcaagcaattctcctgcctcagcctcccaagtagctgggattacaggcatgcaccaccatgcctggctaattttttgtatctttagtagagacagggtttcaccgtgttggccaggctggtctcaaactcctgaccttgtgacctgcctgtctcagcctcccaaagtgttgggattacaggtgtgagccaccgtgccctgcctttcttttttttttttaatggtggtaaaatacacataccattttaaccatacattgtgccattaagtacatttacaatattgtgcagccatcaccaccatccatcttcagaacttttccattttcccgtactgaaactttgtgctcattaaacactaactctccattatttctcttctcttctcttctcccccattcacctcatataagtggaaacattcagtatttgtctttttgtgactgtttcatttcacttagcataatgccttcaaggtccctgtagggtgggtcagaatggccttcctttgtaaggctgaataatattccacggtatggatgccccacgttgtgtttatccgttcatctgtcactggacacttgggttactcccaccttttggctgttgtgaataatgctgctgcaaacatgggtatacggatatctgtcctgctttctatccgtttgtctgtatacccagaagtagaattgctggatcatgtggtaattgtgtacttcattttttgaggacctattatactgttactttgataagaaccatccttatgggtatggcatggcactgctgtttctggtgcctgctgtctccccctcatctgcaactgccagttgaagctcatgccagcagccaaacttctcttccctcccttctctccttacctacccccagcttctaacactctcagctgggggaataatgtatcttcctcctgctgatccatgtttcaaatgtaataactgcctctggtgtgtttaatcacctgccaagccctgttaaatcttgacagaaaccattcgcatctcttccctcctgtgtgcagactgtcatttctcctcagtggccgtgccgttttacattcccaccagcggtgcctctgttcttttacctgggataaatggaggtatccttgcttgtatagtctgttgagtttttggatacttgcttcatagttcctagtgacacctctcattgtgttctatacttccaggctgcagtgcagaaggcaattcctatgtacaaaattgccaccaaaaacgatgttgatgtccaaattgaccaggagtcctacctgcctgaagacatgtaaggagtattcctgctgctaacagctaccttctctccctgggagagtggcctttataccaggccttttttaaatggtattttcaccatttaaacgcactcttagacacaaggctagagctgtggtgtattctacttgcagccgttcctgttgttctcgcagtgctctcttgctctcccttgttggctggctaaatatactctaaaagtctagtttggccaggtgcggtggctcacgcctgtaatcccaacactttgggaggctgaggcaggtggatcacaaggtcaagagatcgagaccatccttaccaacatggcctagggagctagactccctatcataccagtccaccctctgctcatagtccagtcctgtctctactaaaaatacaaaaattagctgagcgtggtggcgcacgcctgtagtcccagctacccaggaggctgaggcaggagaattgcttgaatccaggaggtggaggttgtagcgagccaagaacacgccactcactggactccagtatggcgacagagcaagactgcatctcagaaaaaaaaaagtctggtttatggtcactgctttccttctgcggggaggtggcccccagaatgaaagctaggaccagatctctgtattggatgctgaggtagatactcccttcttctaagtaatagttatcaaaacaagaattgtgtatgcctggtagttaggttccttagagatagaattgcaagtatgagtggtatttttatgactgtgaggaaatgacagaacatttctgggatcagtgttcctaacaagctttgtgtagctggggtaggcagtagaaactcctgacaaggggagagccagtgtcattttctcgatttcactggcctgtctgaggccacctagccacactactgactaacattgaagaaagtaccttggacactttttttttttttttaagacaggcagtctcactctgtcacccaggctggagtacagtggcatgatcttggctcactgcaacctctgcctcccaggttcaagcgattttcctgccttagcctcctgagtagctgggactacaggcgcctgccaccacgcccagctaatttttttgtatttttagtagagatggggtttcactgtgttagccaggatggtctcgatctcctgacctcgtgatctgcccgctcggcctcccaaagtgctgggattacaggcgtgagccaccatgcctggtgccttggacacattttgaagttagctgattatcacacttaggaatgtaagacctagatttgagtcctatcttggccttttgctactatgggacctggagactgaattcatcatatgtaaaataggatcattgctttttgcttttttgtttcatgcagtgaagaaaaaaagatgagatagtacatgtgaaaatgctctgtaaatggaaaaagtatataaactcataagatatgctgtcagagttgggttagattcctgattctgccacttactacctgggtaatcttggactcgtttattcagtttcattgagtggtgtcgtccatttagtgttgctataacagaatacccgaggctgggtaattcatggagaaaagaggtttatttggttcatgattctcatggctggaaagttcaagattggacagctgcatctggtgagggcctcaggctgcttccactcatggcagaaggtggaaggggagtgggtgtgtgcatagagaccacatggcgagagaggaggccagagagcctagggaaccagactccctatcataccagcccaccctctgctcacagtcgagtcctgccggagctagaatccaggccctcgccacagttcattgcctcgggatctgcccttgagccctgaacacctcctactatgctccacctcccaacactgccacattgagaatcaaatttcaccattagtttctgagggaacagactcaaaccatagtagtgagccctgattcccttatctgtaaattgacgtattagcactaacctcatagcattttttatcttatttatttatttatttattttttgagacagagtctcactctcacccaggctggagtgcagtggcacgacctcggctcactgcaagctccacctcccaggttcacaccattctcctgccttagcctcccgattagctgggactacaggcacccgccaccatgcctcgctaattttttttgtatttttagtagagacggggtttcaccatgttagccaggattgtctcaatctcctgatgtcgtgatctgcccacctcggcctctcaaagagctgggattacaggcgtgagccaccgcacccagcctctttttttgttgttgttgttgtattttgagtaagggtctctttctgtcacccaagctggagtgcagtggtgtgatctcggcttgctgcaacctctgcctcctgggttcaagcaattctcctgcctcagtctctcaagtagctgggactacaggcacgccccaccatgcccagctaatttttgtatttttagtggagacaggctttcgccatgttggccaggctggcctcaaacttgagtttgggagcacctcggcctcccaaagtgctgggattacaggggtgagctaccacgcccggccagcagtggcatcttttatcagacacacatgcagtcgtgatagggcctcatcagtaatgagcaggattgggcttaagaaaacattcagatgaggattgagtgatttgcaaactgagatgaaatcctctctttttcattttgttggggagggctggctgtgataattaaaacaggttttgtaacataaaatcaaattgacacaggctgggcgcggtgactcactcctgtaatcccaacacttgtggaggcagaggtgggcggatcacctgaggtcaggagttcaagaccagcctggccaacatggtgaaaccccgtctctacaacaatacaaaaattagccaggcgtgatggcaggtgcctgtaatcccagctactggggaggctgacgcaggagaattgcttgaactcgggaggcagaggttgcagtgagccaagatcgcaccattgcactcctgcctgggcaacagagcgagtctcaaaaaaaacaaaacaaattgacacatagtgtcacttggtaaatgacagttattgagatgaatacagtcagttctctgtatctttggggtccacacctgtgaattcaaccaactttttcttttcactccctaaacactacggtataacaaccatttacatcgtattagctattttaagtgctgtagacatgatttgcaatataggggaggatgtgtgatggttgtatgcaaatactacgctgtttcatataatggacatctaggcggggactggggtttcctgaaaccaactgtgcgttacatcttcagaagctttttcagttcctttcaagcctgttgcttaggttgcgcagtctacacaccaagacaagggcattcctctgcgggagtaaagggtaccatgtatctttctcaagtctttgaaaatgattatttcctgtgcttttttttttgcagagctggtggagttgagatctataatggagatcgtaaaataaaggtttccaacaccctggaaagccggctggatctcatagcccagcaggtgagtgtgggggtacttcttggtagttggtctgctgttactttgaagtgggacagagaacacgtgtccattcactggtatttgggatttgttgctgtctttccagttttggacattttctcaaaaagaatgagaattgggcatgtagtagcatttgctgaggtggtaacatttacatgagggtgaatttggggtcagaacaagtgttttgttgacctaggattcgaatatgtacattttactacatgtaaggtgctgacaagttctttctctaacaggagtgatgggaactaaagcaaatacttgtgtttttttgttttgttttgcttttttgagatggagtttcactcttttttgcgcaggctggagtgcagtcttggctcactgcaacttccacctcccaggttcaagcgattctcctgcttcagcctcccgagtagctgggattacaggcacctgccaccacacccggctaattttgtatttttagtagagacggggtttcaccatgttggccaggctgttatcaaattcctgacctcaggtgatccacccgccttggcctcccaaagtgctgggattacaggtgtgagccaccgtgctcagacacaaatacttatttaaaggaattatcataaagctgctggcttttcagatgtttccagatttgtacacaggaactctaggaaacaagccaggaaaattccatttgttctaaaatgctgggcatcttctagacttctagtgggagtctattgctgtggctgccaacctagttattccctgacctagatatgcagtttactgtttatgcagatacttgtcttataactaaagcactttcaccttgattttttcatattctggtaacttaaacctcagaacattgtttcctagtagccactgtcccatccagtatcatagccactactcacttacggatatttaattaaaccgaaaaattcagtttctcagcacacaataaccatctgtagctaggactgccctgttggacagccgagccttggaagtccagggttaagttctcctaaggattcatcagtggctgtagcaagtgcttccagcctaagctggcattggaagtgttctttgcagctgctgtggccatagtaggcactcagtaaatgtttgttgaagaaagagtgtaggtgacccagcatattgtggtgagatgattatgatgagttaagtctgagatagtagtgactttaggtttttttttgttttgtttttttttaatgtgtcccttttgtaagcagtctgaaccccagatttgggatgagttaagtttctcaccaaggaatgtgttacttgcttcagggaaggagagggtggctttgatgtgcgtggctttgtgagtccttcccagccacatagaggttcatggctttccacctgtggttaagatgtgcagcactctggccaggcttggtggctcacgcctgtaatcccagcactgtgggaggccgaggcgggtggatcacgaggtcaggagatcgagaccatcccggctaacatggtgaaaccccgtctctactaaaaatacaaaaaaattagccaggcatggtggcaagcacctgtagtcccatctacttgggaggctgaggcaggagaatggcgtgagcttgcaatgagcggagatgcgccactgcactccagcctgggcgacagagcgagactccgtctcaaaaaaaaaaaaaaaaaaaagatgtgcagcgctctacaacttcttcagctgacattgcgtatttattacactttctctccacagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactacaaatttaggttttgacagagtcaaattcttactgaggcacctagaaaagaagtattttcccaatccccgtggcacttgatggtgacagctgtcagcacctggacccgttaaccctctgggggtcccctgggctgttgcccgttgttcccagcccatcaccaggagcattctttccacccttgcaatcttccacacaccccacatggctcttcagcgtgacgtgcacaactttattgaggaaatagttttattagtgttgcccgaatgagaaaaaccaagttgtttgttttttctttttcttttttttttgagacggagtctcgctctgttgcccaggctggggtgcagtggtgccatctcggctcactgcaagctccgcctcccgggttcgtgccattctcctgcctcagcttccggagtagccgggactacaggcgcccgccaccacgcctggctaattttttgtattttttggtagagacggggtttcaccgtgttagccaggatggtctcgatctcctgacctcggatccgcctgcctcggcctcccaaagtgctgggattacaggcgtaagccacggcgccagacccaaaaaaccgagttattttggagcaggtcactgtgtgctggaaccagatcctttcacagaggccctgttcttccttccctgtcccatgttttatttttccgtaggtgacgactaagagctgcccagggccttgcagctagtacatggtggagctgggacttgaactgaggtctgtctccagggcccatactcaaatgcagttctcataacagagagtgaggcccccagggctgaccatgttagcaccatcctcttccttgttagcccaggtttcacagtagatgggactattgtaaacaccagctcctgcagcaggtgctgattttcttaggacttggccctgctgctgtgacattatctctcctgtagcagcctttgggggaggaatcgaggtgcgtgaggagggctctcacagcaaactcagctcctcaagacgattcacttatgaagggatagaatcaaggcttaaaacccagtgtcactaacaagcagatatttccctatggctgtgttcctccacccccacaagtaacagtttgaagagtgacgggggtctgcttctatgccctttttaatgtttggttttgaaatggacgtagaaaagtagatggtgatagcattcactgcagcctatctgctgtacccactgatgaacagatgagattttagccattcacctttatttcagagtgttccttggttacagggaggggtgtgcaagagcctgggctctgggggaggggctgggctgcccagtcagagccggcctcagccccctcagccatccagggattcgaaagggtgcttggtctcaaactaggtgctgactctgagggctttcacggtcccttgaacttctgatcctccttttcctcaaaatcagtgctaggactcataagttatggagtccaagattaacaatgctaaatcctcaagctgactgaagaatgccgagtttgactgtgaaatagaaatgttaaaatacagaaacaacccttctattgtgactacctgttaaggtcctgcaattaatacaacgaaagtaccatttttgttgaaaagtaggtggttaggggcttccaaaagcccctggtagctgtgcccacaaaggaaaacgagtgtagacacgaaggggaagaaggctgtgctcaacttgttagaatatagggctgtttctcccgagattgaggtagcactacaacgcagaggaccaggcaggccagagtggccccacctgcccttgccccctctaggctaagtgaaacagctagagagagggcggcaagcgcagggacttgacctccagctctgtctagtcaaaacactttaagatgcgctctccaatcccaataaaatagaccccttgagcaatcccaaagagaggtg

SEQ ID NO: 13318 - DNA, 24942 bp, Human
acaacatggtgaaaccctgtctctactaaagatacatattagccgggcatggtggcgcctgcctgtaatcccagctactcaggaggctgaggcaggagaatcgcttgaacccaggaggcgaggttgcagtgagctcagatcgcaccactgcactccagcctgggcaacagagcgagactttgtctcaaaaaaaaaaaaaaaagaaaaagaaagtgataaatactatggggctgggcgcgatggctcacgcctgtaatcccagcactttgggaggccaagatgggtggatcacaaggtcaggagattgagaccatcctgggtaacacggtgaaaccccgtctctactaaaaatacaaaaaattagccgagcgtggtggcacgcgcctgtagtcccagctactcgggaggctgaggcaggagaatcacttgaacccgggaggcggaggttgcagtgagcctagatcacaccaccgcactccagcctgggcgacagagcaagactccatcaaaaaaaataaaaaataaaagaaatgctatggaagaagtaatagaatatgctatgggagagtttggaagagaaatacacatagagttatactaataaccaaaatcctttattgaccatttatcatgtgcttggcacaattagcttaatcctgagtcttaattgtcaggatcttacattataagatagacaaaaattcaacgcatgctttactaagtaccgtttgtatcagtgggtaaagcactgtgtttggtactctctcaaatgcaaagatgattacgacacatgtactatcgtttatgaatgggtggccaacagaacagattgccgcataggtaagcagaaatctgctctcattctctattggccacaagcaggcatgtcttaggagcagaagggtaggaagatctctaactgtgcttggaaacttggggagttaccacgtctggctaaagtggtattgtcttaaggaaaacctatgaatttgcctgcgttggcttggtgctgaggaaagtggaagagagaggctggggtacacctttcaacatgaatggaactgaccactggagggaaagaacaagaaacagcagtgagaacaaggaacaaagaccatccagcccatcacccacctggggggaagtgaggggagatgggcagggtgacaacgtggccaacatctaaagtgtgaagaggggcttttaccaagtgcccaccccttcccgagcagggggcaaccaacagcatctggcgggtcttactactgggcagaggcaggggaaccctggtatgagttctggattacataggagatgtgacttggacacgtttggggcttaaaagtaggaagggatcaaggggggagatttgaaaatcccggtggaggtgcgaggtatccggggagagggtaaaaacgggaacagtcttcagcacctgcctgtaccaggagctctgtgtatgccatctcatttccgtctccagcaaccaggcgggccttggcggcaggaggcacaggctttgggagcagaggccctgcagcttgccaagcacacacggccctagggcgcccagctgagacggcaccttggcacccgggcccgctgcagcccgctccggtcagctgcaccccagtcaggagcctttccagcgggtcggaggagaacggaagtttggggagacccgcgcgattcgcctggctgcattttacatttctttctccggcagctggggtcacgaaggctgctctcgccggcggtgttggaacgtggacacgtgcgctttggtaatagggcagcctcccccgcgggcgcagtccccgctgcgagcgcccccggctgctgaggcgggaccgaggacccggagatttgagccgcgggtgggcggggaggggcctttgtgacctgcccgcccctccccggcactgtgatgccggggggcagctgcgggcccggcgcgcctgtccccggcgtccccccctcccggtgtgtcacaacggcggaggcggctgtatctggagcagtcggggcgggcaggcccagctgagaggtgcgcgggcgaggacagcggcagcgatggtgaggcttcccggggccaggcgggctgcgggcgcgcggcaggcgtaggaccgagagccgagtctacgcggaggcgcacggacccgtcttcctggagccgcagggctcaaggccttctgggggtggcagttcagggtcgaggagtccgcaccctcgggcgggaacacccggtgccctttatcgtatgggggaaatagagaccaggggccagttgttccttaaagggacctaagggagctttgcgtgcagacgagggggagggaggccctggggagcccgacggagaagggggcgagattctggggtccccagatgggcagcctgtggacagagtggagagaagggcgagtccggggattctggatgggtggtctgggccggggcgactggggggccagatgcagtcacgtctccgaacccagcctaatgtgacagggcccggaatgtgacagaggacctagggcgccacggtccccccacgcgtggaggtctttctcgcaagcctggccagcggcttgggtttgctgcacgcacagccccagcgcggcggggtcctccgggcgcactcagcagctcccaagtctttccagcggtcagagtcgaaggactttgggagtaagaagtctctgcttccaaaggccaggggaccttcgacctgtttcctaccctggcttagggggatcgcggctgctcccttccctgcccccgcccctggatcttactgaggggcggctgcaaacactcagttcctctttctagggtccccctctccgcccccagtgcccctggtggttaacatttgcccccagtccactttcccaaagcccagaatcccaggaatccctcctggacccctgatctttcagcagtagggagatgggctggaaagattgggggcagagtgagggcagaataagcctatgtcatggccaaggtcgggttccctgggcaggcttgctccaggtgtcagtgatccagaaagcaggcgagaaccccctccgccccgccctgttacgtttggcccgtgcccagggcctcctggctcccccggagctctagccttccagcttcagttttgtcagcaccctccctcctcctagcgggctcccagacacccctgggaactgaaagaacttgggaatattagggagggtggccacaggaacctatttctgcctgaggaccctggtatgaggccacacaaagggcccggagctgccagttcagaattttgactcctggctctgcagctagctgtgtgacttcaggaaggtcacttaacctctctggatgtgtttgttttacctgcgaaatgaagagggttataattcaaatttccaagactccacttagatttcattatttttaaactttttatggtagggaatttcaaacatatgcaaacggagagcaaatggtataattagcgattatatacatcatctaagttcaataattaccaacttctgacctgtctcacttcatttattccctccctccataattttgaagcaaatgctaggctgcatactctagaattgatatttaatatttataatatctagcaggtagctagtgttttaggattttccaagtgcttcccttgcatgctttaatttggatctgaatgccattgtggtacagagtggagcccagaggatgtttacaggggcgtgtcgaggatcttaacccagccctgtgcacaagcttgaatgtgtgatccacagacgtgtttctgacaatgcctggtaaatcaacaattcaaacagcaaaactttattttgaacgtgcttaagaatttgggtgtttagctgaaaacctatggttaaatattttgaaatgcgaccacctttcatttattttgaaacactcaattttgtctagtaggttctatctagaacatttaacttgtgtgcgttgcactgtcttgatggctaatattttttgttgaacattttacactcacagaaacttttaaaatatcatttggctcatttgtaaaaggctaaaatgacacatctataaacctagacccctagaatctcacccttacaaaaatgactgtatttcttctaaggattaagtttcaggctgctgtcctgtccccttcacttccctccctggtgggggtttgggggaggtgaccttggtgttaaggagaattcgatttggaatttctgtaggctctgggcaagaaaagtgtaactaatccttaagtgtatttttaaatgcatttctctagctgctaggcagatgagcatttttcctctgtgaacttacccccaaccccttctccccagctacccactgcacggtaccaccaataccctttagcatttctgtcctggagcctaaagtgacacagctggtaagaagctgcgtaggggctggagtttacatctgctgggcaccagagcctctgtcctgagccacctgcccgtgctgggaccggcaggctactcccacagcagaccattcccatccattcccagtgttctagcacgcagctctctgggaactcagactatgacaccttttttgggaagtggtatggagaatcctggccaggtgccctaagccaagcccatgccaatgataccagggcacagagaagttttctgtggtttatggggaggtgggaacatctgcaacacggcttctttaactccattccgttaggactggagagcacgaaggagcccgtctccctgcaaaaatgggcagttagagggttctgggggccaaatggacacccttctgcctgcagccttctgcagtctccccatgtagacaggcatggccaagctctgtggatttgataggtgtattctgacctcagagcactgtgtgggctcccaggggctgcaggtcactgctgcctcctcctcccctcccatcacaaaaggcaggtttcccgagaagcactgggcgcatgcctccgagtgaggggccttggctcacagggcagcggctggggcagagctgctggattggtgagtccattgggagcccccagccttgggtcaggcccatacagagcttggggtgggggttaatgccactgttgaatgtgctttctcctagtgaccttcaaagggagatgaaagttaaaaataattttggtgggggaaatagctggtggatagcgggccagtgatgggggtgggcaggaggatgtggcactgtcggggggaggaagcagaccaaatgctccttttccctcaagccgcaagggacggacagcactatctgtggcctttgtggttggcatttcccctgcagtgtcttcctgttaggagttctctcagataataagctgcagaagagagcaggagatggagcaggcactgtgtgcatcggattgaaactcctaagtgtctcttgcacctgccccagtgccagccacagcccaggccttcaacgccctccggcctcttatgctggaagtctccttagcagatggcctcatggccagagctggcctcctgtgagctctgttgctgccctaactgcagtgcctatcatctgagcccctctcgcgagccaccttcactcgctaaagtgaatttaggccgactttgtttttgctgtgtctggcttgctatctattctttgttatgagtgatctcaaatatgccctatgatcgaagagttctgagcagagagaattcagcagcccttcaggagccacatctgtccttactttaattacccctctgtgacactgtgggcctgcttttcacttgccatccctgacctaggtcctaaaatatatgtgatctattatcccagcctgacaactagagataattcggtgtaatcacatgcttcctgacagcaactggggcatgagagcacaggtggtcagggagtgtgggtggtgccaggctttcacagggcacacactgtggtccacgtcggcccctctcccagatgatatgccacttttactgtcttgtgatacttggaaatagtatcacaagacagcctttttaaggcttcaaagtctccttttgccaaggatggtgattagcttatcttagtcctctgagaacaaagcaaaaggaaatgactactattaaaatagaatataagaatgatgtaaaaaaaaaagggcttcttgcagcaaaattataaaagggctgcaaagttctagaatttcttttattgatgctctgcaaaacacaggcactgggctcatgcctcccagcgaggggccttggctcacagggcagtggctccccaggcggagtgttcacaggtggcccagatgtctcattggccctgcccttcctcagcctgcgctccggacagactgggcagtgtgcgggaaccaccctgcgttttactgcctcttgttcacactgctcctgcatccacctgaactgccccagatcatcttggccggctgccttcttcagggtccctgcgaatattcctcctttaggaaaccaagctagaagatgtctccttctccttggaactccctctgcacttgacccgtacacttcttaggccctggccgctgtccttgttggatggactgcagcccctcagggaaggttttcattccagtcctccctgtgttaattgagcacctgctacattcaagcaccgggctcggtactggggattccttgagtgaaacaaaggttccttgccctcacagagcttacgttctctactagaaaggtgcgaaaatgaacaggcagctataatacggtgtgatgattacaatgacaggaatgaaggggatgggggagcacatggcagggccctatgctggcttggggttttgcagactttccttaggaagtgacaattaactggatacctgaaggatgaatgagagttagcccagtaacctcacaatgctgtctcgaatgcaaccacacaaaaagatttgctgtagaaatgagtaggtgccttttgtagctatcccagcgtgaggtctgtgtgagaagtggcatgcttttcatgaggaagggacctccttggtccctccacctccctcctcttcaccccccagaagaagttgggtgggacaggcttctgcagcaaacaagggaccccctcccctcacagggaccaaggaggacagaacttgtctgagctctacaagcccagattgaaaatagaactgagagagacaggagcagtgtgagtgacaggcatgtgctctgattggctagacagaggaatctgaaatatgagtttggagcgggcacatgacttaaatatcctctgctgggtcagcttccccttgcccccaaccccagctgcacacgtgggccctgagaagcggacttctggttctgtcagagaaagatgacccattttcaaagaggccgccccatgagccattcgccatttcgctctgcacaagagacatttcctgtttggagttctgctatccgaacttggtcttgcattggcgcagatgtgggcacaccccagggccctgggagttcagagctgcaagtgaggcaggaggccatgtggcctaaaagaaagaagtcaggcccgggtcagcagccctggattctggtccaggctcttttgctgctgcagtgctgtgacatactgaatttgtcccttttcctctctgagctcagcagtttcatctgtaaaataatggagagggaatcatattaggtgatccatgaggctggcccagctctggtatcgtaaatgtttgtagccaatacaacatccctggttatgatagaaggatgcccttgactggcccagctctggtatcctaaatgttcggagccgatataacatccctggttatgatagaaggatgccttttcttagacgtgaggatgcgtcccacgggcttcagcactgggtctgctctgtggaacttccaggccgaaggctggggagggtaatggggcagcatggctgcaggagtcgagctcagtgcctgagccgggagctcgatgcgggagctgtgggctgctcctcctccctgctaggagcaggtgcaagaggcctgcagagtgctggggctgggcacggacctcacagtgccatgaagcctcgtgcagctttgaatttcacttgtgatttcttcatggaacttcaaagccctagcaatgtaggcgcgtagtcaattattatttgagtaagtgactgcgtgcaatggcccaggataagggggttctggagagggcagtccgtgctcctattctttctctgtcttctttattatgatttttgctttttactatgaaaaattttaagccttcagaaaagtagagtgatatgccacccatatacctattatctagatttaagaagaagaatgatttttccatctgttatttgctgtgtttgggaaggattttaaagtacagacgtcatgacattttacctctaaatgcttcggatgcaactctaaaaaataaggatgttttcatacttaaccacatttttatgaatacgctgaacaaagcaaatcagtttatttgtcccccaaatattttgatttgttcaaacaagaattcagtcagagtccccatgatgcgtgtggtggtgcttggtggtgccttagttcctttgacatgggacagcccctcccagctcttcatttctcatgagttgaaaaggctgggccaggcccgatggctcacgcctgtaatcccagcactttgggaggctgaggcaggtggatcacgaggtcaggagatcgagaccatcctggctaacatggtgaaaccctgtctgtactaaaagaatacaaaaaattagccgggtgtggtggcgagcgcccgtagtcccagctacctgggaggctgaggcaggagaatggtgtgaacccggcaggcggagcttgcagtgagccgagatcgcaccactgcactccagtctgggcgtcagagtgagactccgtctcaaaaaaaaaaaaaaaaaaagaaagtaaataaaaaaaattaagaaaaaaaaaggctggaccagctgccctgtaggatgtctcaccttctggattgattttgttttctctgatatcactgaacttaattaaccctctgatccctgtgtttcctgtgaagtggaaactgaatctacagggctcagtgatgagggctgagtatttttgagaagaagtcctcactggtggtgtgtgtgtcacattgcgtcccatcaggaggtcctcgatgtcgggttggcccacagttagcgatgctgagattgatcgcggccttaggctggcgaccctggtagttacgtccccccttgtgactataacagtggttctttggctctcggcgaagatccagttccccatcagtctttcacctaatggtgttggcgttcttgtccaaatcaatcacgtaattagaagatggaatagggcaatatttgataatctattattcggtccacattgcttagcagacattcttcaattaaagaaaaaagagccttctctaactaacggggctgtctggatagggacaaatgagtttttctctgggggttttctttgaggacttgtgggttttcatcttgcatcctgcttcactcaaatgctgccatcagtacttgtgaggctcaggttgtctcatcttaggcagcaggagcctcttcaggtgcttgggcagccccttggttagcctccgtgcctccaggcgctatgcgacattccaggctcatctagcacactccccaccctggacctggacgcctccgtctctccaaggagcccagttcctgttagcagggatcttccttctctcttgattggtgtagctacttttcacttttgggagcacctatgaatctgtcagtcatttctgagtctattttatgcctccaattattcttatgagctagttcaataggaaaaatagctctttctaaggggtgtgtgtgtttgcacgacgggggcgggggagagagaaagagacagacattttgtaaaagactggcatatgtattagtgtgagattaatgagggcattaaaagaggctaaagacgttgtcaccatgctagtggttttcaggtcccccaaatccttgactcttcctcccatgatcttcgattttcccaaaatatccctgcgtcctccctggaaagccccagaatgttccagaagtgagagcaggctgggggccgggcagcactgtaggcaggactagagggtggtcgggatgcggtggtggtgagggggcgacagacccagaaggctgagggttaggaccacagaggacactgtcacttagaaggaaaatacataggatcaggcccccctcgggcctctccagtgtcccctcagcttccacacctccctgggaagtcacagccacatgctgaatgtgacgccgtggtctgggtggataactcgctggttgtgggtggtttctggatgcagatgctgctttccttaggcctgaattgagccctcagatggaggcagagaatagaccccacaataaaggagagaggagcagggacctgagagctccctctacgtgtgctacttcccggtgcagaaaaatgctaccaggtagtaccgtaatgaaaatgataatggcaagacagcatcaacaactgtggctaacttacacttttcagatgaggagaggctcagtaactcagcccaggccacacagcacagcaagtaaattgagaaggcaacatgggaacctggggccgtgggcagctctgtgggtgaatcccctccctagccaccaggctcacggagatccagcgggttgcgacccccgtcgggctgccccacgctcacccctgtgctcatcctccctcaaggcaaggaccaggtgtcgctcagctgtagcacagagacaggactagagtgggggcacagttgtaaaattgaactagggggcaatggtcctgatgctctgaccccgcaagatgctactcagggcagctgccctgctctccatgcccagaatttcttccacgtctccaggagccccacactttgacgtggactctactggcttctgtgcccagccgtgccctctggaggctctgcccctggcttgggttacccggagctggaaaatgccagggcaggtcatgggtaaaaatagaaacccacagacctggcacatgcttcctgctgggctcaggcggctgccccaggcacagtgtcgccttgtgtgggccactgcttccccagggcagggtgtgggtgggaggatgagtctatcacgcctacgtgtgcacgtgcacacacacacacacacactgtctctctccccacccccctttttctttaataatttcaacttttattttagattcagggagtacatatgcagatttcttacatgggtatatattgtgatgccaaggtttggggtacgattaatcctgtcacccaggtaatgagcatagtacccaatagttagttttccaatctttgcccgcttcttccctccccgctccagtagtgcccagtgtctactcttgccatttttctgtccatgagtacccatgtttagctcccacttataagaacatgtggtatttggttttctattcctgcattaatttgcttaggataatgacctccagctgcatccatgttgctgcaaaggatatgggttcattcttttttgggggctgcgtagtattccatggtgtatatgaatgacattttctgtatccagtctaccattgctgggcacctggttgattccgtgtctttgctgttgtgaatagtgctgtgatgaacgtgtgagtgcaggtgtctttttggtaggatgattttcttttggatatatacccagtaacaggattgctgagtgaaatggtagttctgagttctttgagaaatctccaaactgctttccacagtggctgaaccaatttacattcccatcagtgcactccccatcttaagctgttagtacgaataccaatcaggcaattgtggcttcacatcagctttacttaacacttggcctggcataggcaaggggcaggctatggggctgcaaagattttccaattgttcagcgtgcaggaagggcctaatttataccctccccatcctctcttggggtaataaataatcctttatttctacattggtaaccatgatactactgacagccatggcgcatacttccagagcatgttcctttcatgagtgctcatttgctctgtgatatcctgagactgtgtgtgtgcatgtgtgcacaatgtcagaaagtcagggtcaggagcagctgtgaatgctgccttgtgtgggcgtaggctgaaggagagtttctgccatgatcgccagttcttccttgggccttcttcaccagtgcaggaatcttgtggtttggaattagccccttgcttcatctttgcaaccaccctccttttttctttcctggtataaaaggtcaaccctgggaagcaacctttagagcaaagcacaaaacagctgtgtcttctttggatctaagtcctggtccagctgctatagagctggggcacctgcagcctcaacgccaactggcaatggggggctggggcctggctggcctgcaaggtgaatgttatggggatgtagggcaaaggcatgctgggggcccagactctctgacctcgttgcttccctctccccacagcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtgggtgagtgggggcggagttcccctccacagagaacatctcgaaactgcagaggcattggcccacagtagctaaggaagcagcgtctctagctggaaggtggggatggtgcaaccgcagcctcccaccccacgtgacatctgtcagctccttggggtccccacagtctcggggaatctcatgacagtgatcaagactctatgcagaacaaaatgcctcccacttcaaccccaaaacctgcggcaccaggtcaaaatggtcacatcgctactaaatactaaggataagaaaatccaaataattttagaaattataagacacccctaagtgagcaatttccctaagtataggtttctgagtctgccctcggggtgggtataacctcacagcatcttacacacaaaggggcctatcacagcaggcacattgcttcacagccaggggccgctggagttctggaatgaggttcattcaggtttaggaaacacaggaattctgccttgtgtctaggcagatctccccttcccacactatcccccagtagtgccacttcccctgtttctgacccctgggtcaactctcagttgaatatcaggatttccccagctccaagcctggctcctcaagccagagatggacagttctgcaaagaggactgggcacgaagtatatgcctggacaccaatgtctaggggcaacagagggcagatgctccaccccctggatgctttgcaccaatgcacaaagtgcaggttacctcctgggccactgcacagatgatttttctgcagggagtagaggaaccccgaagagaagaggtgacatagttggggcctgatgtgtcttgatctgctctgtatccgctttgtgtggacccttggaagtgagcagagaccccttaaaggcctctctagggctcttgctcctctatgacttggaacatagctttgcttcccattattctaaaatatgtctaatgcctgacatatattattgccaccatgaggtggagttgaggggtgggacaactcttgggggtctaggttctgggcagatcatcctgaatctttctccatgtccctagaatattttaatgcaaaaggacttaagttaaattgttggtacaccttggcccggcgcggtggctcacacctgtaaccccagcactttgggaggccgaggcgggtggatcacgaggtcagaagatcgagaccatcctggctaacacagtgaaaccccgtctctactaaaattacaaaaaattagccaggcgtggtggtgggcgcctgtagtcccagctactcgggaggctgaggcaggagaatggcgtgaacccgggaggcggagcttgcagtgagccgagatcgcgccactgcactccagcctgggcgacagagcgagaccccgtctccaaaaaaaaaaaaaaaaaaaaaaaaaaaattgttggtacaccttgcagcatgaaagaaaaaacaaaagggaaacctggaggagtcaaggtggaagggaggagaggcaattggcgttggtgttcgatgagctttttttttgtttttttgtttgtttgtttttttgagacggagtctcgctcggtcgcccaggctggagtgcagtggcgtaatctcggctcactgcaagctccgcctcccgggttcaagccattctcctgcctcagcctcccgagtagctgggactacaggtgccggccaccacgcctgcctaatttttttgtattttcagtagagacatggtttcaccatgttagccaagatggtctcgatctcctgacctcgtgatctgcctgccttggcctcccaaaatcctgggattacaggcgtgagtcactgcacccggccggcccaagttttgttgctgttgtgttttttttggagatggagcctcgctctgtcttgttgcccaggctggagtgcagtggcaagatctcagctcacctcagcctctgcctcccaggttgaagagattctcctgcctcaggcctccgagtagctgggactacaggcgcacgctgccacacctggctaactttttgtattttagtagagatggggtttcaccgtgttgcccaggctggtcttgaactcctaagctcaggcaatctgcccgcctcggcctcccaaagtgttaggattacaggcgtgagccactgggcccggcgatgttcgatgagctttgtaaagctaagtctttttagggttctagccagcagggcagcctgcttctcaccgcccacatgagccacaggccttggctctgttagtccctgagctacccgggaattctcttagccttttgcagattcattacgaggtggtctggcttcaaacctccatggagttttataggtaggggagaacggaaggggtcctgcggtagtgtggtagggagggaggcttctcccctgggcagtaggacctaatggtcttcctctcttggaagatgaggttcgggcaggaacctaccgccagctcttccatccagagcagctgatcacaggaaaggaggatgcagccaacaactatgcccggggccactacacggtgggcaaggagagcattgacctggtgctggaccgcatacggaagctggtaagatcaggagggcaggggacgggtgggtcaggctggagtggacaggcttggccccatgcctctttgatcaggctagggagaggcatctgacccctggctataggatggagctcctaaggtttgggaatttctgcttaaattctgtaagaagcatgcacaggggtgatgccccttcctctgtgttggcatcatagactgtgttccaggctgaggccctactcatactcattgatactctctgttagtatctggggaaggttccgggtataaggcaggatgaggtctctgctggtcggaaacacaggttaacaaagcatttaacttggaagaggagaggaagagattgttgatacatttgggcacttacaagtgccattacagatgttaagcacattccttcatttaatccttaataattagacttaggaggtgtccttcctgtgctttacagatgaagaaattgagggccagggtggttcaatatcttagcctgggtcacacagctaaaaagtggcagagctggggtttgaactcagttggactacaaagctcttgagttgtaggttgtgtcactttatttatttaagcttccatttgcttatctgtataatggaaaagcttggacctgatcacatgttctttccctgggaggtaagggtgccaaacttttgcatatattcactttttctgtttagaggagggcttgtcagggtcattggcctcaaagctgtctgtggtccccaaaagttcaaatcacacccagtgggaaaatcctgtgattctatgaattctctggtgagagctgacatccgtgcttacaacgtatcaggcccttgctcagcatgttatgctattttatttaattgtcacaataaccttatgaggattttctattgtccccattttcactaagaaggaacagaagtggccaggcatggtggcgcatgcctgtaatcccagcactttgggaggctgaggggggtggatcacggggtcaagagattgagatcatcctggccaacatgttaaaaccccatctttactaaaaatacaaaaaattagctgggcatggtagcatgcgcctgtagtcccagctactcaggaggctgtggcaggagaattgcttgaacccagaaggcggagtttgcagtgaaccaagattgcaccactgcactccagcctggcgacagagcgagactctgtctcaaaaaaaaaaaaaaaaaaaaaggaacagaagtttggagaggttcagtaacttgctcaagttcttacaaccaagaaatggcaaagttgatattagaactcaggctttctggctccatgtacctttctgaaattggtgccctgagtcaccttccaaggttgggttgaagtgtgtcggcagcagttcccacaaaatcaaatgacaagagcagggaaagtgggcaaggagttggggccctcaaagggcaaagtcaccatccactgtggttctgaaactctcattccctgttcaaccaagttactgggctgaaaccttcatgtacctagaggcgtgtgcccctgcagcttgtcatcctattaaaaaaaatagagacagagacttgctctgtcatccaagccagagtgcagtggtgtgatcatagatttctgcagccatgagctcctgggctcaagtgatcctcccacctcagcatcccaagtaactgggactacaggtgtgcatcaccacgcccagttaacttttaaaattttttgtagatgcgaggtctcactatgttgcccatgctggttgtgaactcctggcctcaatggatcctcctgcctcagcttcccaaactgctgggattacaggcattgagtcactgtgcctggccccatcccatattttagccactcctccaaagatcaatacaactccttttgtttccttacttcttcaaagctgttttgatttcatccacaaaaaaatatgaggcagacagagtgggcggtctggcttttttactgtggggtgttctcggaaacttgtcttcatgatttcttctcatgtcctgctctccctagacagatgcttgctctggcctgcagggcttcctgattttccacagttttggtgggggcactggctccggcttcacttctctgctgatggaacgcctctccctggattatggcaagaaatccaagctggagtttgccatctacccagccccccaggtctctactgcagtggtggagccctacaactccatcctgaccacccacaccacactggaacattcagattgtgctttcatggtggacaacgaagccatctatgacatctgccgcaggaaccttgacattgagcgccctacctataccaacctcaaccgcctcatcagtcagattgtgtcctcaatcactgcttctctccgctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgagagctgatgacttaggaaggggagagaggactagagaagcagagggaggtgaccaaggatatgcaattccatgggcgcttcaggctttatgtgatgataaggggagggggacttcaaccaaatgtaacatgaatggaattcagctttggttgagacacaagtgctgtcaaagttttgtctgtttaggccattttagaaaagtttggtgctattttaaattgattaattggttaatcacctttggttttgtttactgagcaacaagtaatgatttggtattggcccaaatctactcacctgaagtacagtgcttttggtgttcatgatttggttcaatttgcctaacgttagttttgtttttttttttttttttgagacggagtctcactctgtcacccaggctggagtgcagtggcaccatctgggctcactgcaagctccacctctcaggttcacgccattctcctgcctcagcctcccaagtagctgggactacaggcgcccgccgccacgcccagctaattttttgtatgtttagtagagatggggtttcaccgtgttagccaggatggtctcgatctcctgacctcgtgatccgcccgccttggcctcccaaagtgctgggattacaggcgtgagccactgtgcccggactttttttttttttttttttttgtgaaacggagtgtcgctctgtcaccaaggctggagtgcagtggcgcgatctaggctcactgcaagctccacctcctgggttcacgccattctcctgcctcagcctcccgagtaactgggactacaggcgcctgctaccacacccggctaattttttgtatttttagtagagacggggtttcaccgtgttagccaggatggtcttgatctcctaaccttgtgatctgcccgtctcggctgggattacaggcaggagccaccgcgcctggcctccaacctaaagttagttttaatggatattttacacttctttgtacagcatgattttgtggccattttaattttagagttaaccaaattattccagttgccagaggagtatgatgcctctctctaacaaaaagctgtgttctcccaatttattttgaaaacttaaaatatctatcctgcacatcttaatcaatttggagtaataagatacttttatagttgttctatgattgctattttccattgccattaaccaggagtaagcaaaaaccagcaagccgtgtggctggtggtaaccaagtgcccgcagtctggaaaatgccaggctcagagagtcagtggggagatacaaaatagcgagggtagaccctggggccccaggaccaggaatgctgaatggtagaagtcacccctctgagctggaccggcaggcaagcagcctggctgtgcacatgaacagctcagccactccacccatggtcttttgtcagattctgccatcataacagctaccacattcacattaactactgccctgtagtcaggatttctttttttattttttattgtatttttcccctgagatggagtcttgctctgttgcccgggctggagtgcagtggtgcaatcttggctcactgcaaactttgcctcccgggttcaagtgattctcctgccttagcctcccaggtagctgggattacaggcatgcaccaccacgcctggctaatttttgtatttttagtagagatggggtttcaccatgttggccaggctggtctcgaactcctgacctcaggtgatccacctgcctcagcctctcaaagcattgggattacaggcgtgagccaccaagcctggcccctagtcatgctttcaatcattcagaggttttactggtacctattgtgtgtcagggtttgtctcagttgctggaggtgaagagatgagcatgcctcagttttcttggcgggagttacaagtgtgaggcaccagctgcgtgctggcctcatagctgccctgcatgggtctgaggctttgacctggctgttctgctgagtgaggagtgtagcattccttttcactgctatccttctagctacatatataatttccccccaagactatgcctattttttatgtgacagttctaatcatcctggcaaaaccagtcaaggtcttccaaaaaatgaaattcttttttctttttcaaatggaaacaaacaaccagctagtaggagaatgaatggggaaaaaagagaatgaatgagagacatggtgggtgatggggaaattaacaaagcggaaatgtcccctcattctctctccttaaagcagaagctctggagttatgtcctgaaggatcattatggtagcattagcataagctaagaaaagtatgttccctggagaggatgctgctaaacttcatcttcttgcattctctccaacagtacttgtccccacttgactcaggtcaagagatgttagcacttagaggagaacaggttggcccaggcacaaggtttatggcagtcggctcagttctagcaatgtatgtgatgtggccaaattcatatacattgcctttcccttccccactttgcccctctcccagtatcacctccacctccaagatgccacctgtgcctaagaggaatgacggctgctgtgggtccagtggctgcctggctacccatgttgccacacagctggctgccattcccacaccagcccctcaggaggatgtgcattttaaagctatggatttaagagactggcgattaaaatgtggtggtctcagtgggagaggtggctgaggacatcactatagttctcataagtaatgtcacggtttgccacattagacttgtcccagtttcccatggttcctggggttggctttggtttgggacgtgtgttgggaagaagagagatttccaggatagcagcaccactgtaagacgggtctgggctgagcctgggagacctgccatgctgccagaacttggcaagaccttcaacaaccttcttggattggagaccctgcttttcttctaagaagccccaattcccaaaaacctagagcctggttaacgccaacaccatcccggggcctttcggctctctttatttattgctctggaatatccctgtgacctcttccaacagttttcactcttggcagggaaacttccttaaatttactcgcaacacaactaagaggaacttcagatgaccacttgggagagagtacacttttgaacagctttgaatctagaatgcgtttccctgttacacatacacatgtaccagacacctcccacccgctcctaatgtcgctcgtgactctcatttgcctacttgctgagccccctataccagccctgtcctccttctctagcctttgattgcccagcccttccccatctacttttttttttgttttgcttttaagagacagggtcttgctgtgtccctgccactggagtgcagtggaaccactgtagctcactgcagccttgacctcatgggctcaagtgatccttccacctcagcctccctgagtagctgggactagtaggcatagccaccgggcctggctaattttttttttttttttggtagagatgggtttttgctctgttgccctgcctgcttccactttctcttcagcttctcccttgccacctgctggcttccccagtcccatcccgcctgttgcatcccatagccccactcccacgcccctgaccatgacttgaagccatgccaagtgaccaagatgtcccatcctgagttatcctctggctgacttgtatcttcttctgtggctcctcctctttctgtgtccctcaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaatgaaggggaggaattttaaatatataccttccccttggctgtgtctctttatttatgctgtgccattcaaagcacatgttcaagagaacagaacactctccccgccccagcctgattcctgccttacccaggaggagggtgcctggccccagtacccagggtggcacgactgggctaagtggacactgagcttcatcaggccctccctgggtaggagcagctttgtgtcactaaagaaagtgagggccactgtctccggcgggtgaggctgcagcccagtttcacatgcgaggaggcctaatcaggagtttcaattccagatcgggctgggtccagccccaaaacatggcctgctggctggggagtgggaacactcagagaaaggggagatctgggcctgggaagattccggggcaggggtgagcggacgttcacatgagtgggtctatagcccgctccgggcatcatctagacttagcatgcattcactcccccatcacatattccaatacacaccctgtcctaggcactgagagctggagagttggtgataagcgagacgaacacatttcctgccctcatacacacataaataaagtgaatgagatcatgtcagctggtgtcaagtgagagaaagtaaaaagcagtggtgagagagtgtctgggcgtgctcctgtggactgcgtggtcaagacagcctcatggaggcctgggccgtgcaaaaggatgctaggtgcagggagaagcaagtgcaaaagctaggaacaagcttggagcgtctgcagagcagaaaggagattgtttcctggaggatggtgagaggggaagagtcagagagacaagacccaggagccaggcagggccagagagcatccagccttacaggccatggagaggagtttagaatttttttctaagtgaaacagaaggatttggaaggtttcaagcaggatatgtataccttatttctatattcatactgaccttatatccaatcctcccaacagtctcaaaatggatattctgctcattgtgtagatgaacagactgggatgttttaggtgttggagacagtaggaggtagagctgagatgcagggcctgcctttcctcctgtcctgtccaccctaactacaatgtttccgtgtttgtttgtttgtttgtttgagatggagtctcgctctgttgcccaggctggagtgcagtggtgcgatctccgctcactgcaagctccgcctcccgggttcacgccattctcctgcctcagcctcccaagtagctgggactacaggctcccgccaccatgcccggctaatttttgtatttttagtagagacggggtttcaccgtgttagccaggatggtctcaatctcttgacctcgtgattggcctgcctcggcctcccaaagtgctgggattacaggcgtgagccactgtgcctggcctaccctacgccatttctaacactgtgtgttcgtgccaggttccagctactgcctgataaaatgctggatggagagaggcacaatctgtatcatttgcaaaggagggggtggttacctgctcctcttccctgaagtgggcaactctggcggaatctaaggagtaatcaaaaggccatgaaccagctaggaagatacctggggctgggcccatggtaggtccctgggcattaagtgcacacttctttacgtgtggatgtttctgtcctgtattccttggaagctctaagagaaacagagtaaaatgtcccacggaaaggaagattagacatgaggtgatgccagttacttctagaggcccagatctgttgtccactgtgaccgctcttgccagaggtcgtgcctgcaccaggttccatgggaactggcctggacacacttagccgtggtagagaatcagggtcaggagctgtcagtcccccttcaggaggatgcatccttctctctccataaagatgagacctactcagataaccttgaaaggacttcctgcatatgtgagtatgccctgttagggggagtatagcacacctgctaggcagggcttagggagggggcaaagcttgtgtgatatgttcctttcctctagattaacacaaattaggttaaaaattaggttgaatggcaaagtcacaaaagtgctaagaggcatgaatacagggagatgggtcagcagggaagtttgggatgatacacaagggccttggatgtatccctgctcctcccaactgcttctcctctcccacttctcctcctttgcttgagtccctgtctaaccatggggactgccagccctgtcagcttcagtggttctgctgatgaagcaggagactgagttttagaactggggacaagggatcctagaaagagggtgagaatgaaagtgggtggctctctacgattccccaaaataagtagttttgtaagtctttccccagcatgggattgcctagagacttaaacttgtaaagcaaatttggtgaacactagggaagagatgggaatcagaaaagagaattgcacaatggcctttggcagggagcttggtttctctactgggctgaacaactagataacccggtcctggaatcccagtgcagctctcttgggacactct

SEQ ID NO: 13319 - DNA, 103750 bp, Human
attggggtttcagtaaagaaagaaattttaatctgaactttcaaaatttagaggctgtggtggccaaggttgagttctctttcagtggaagtttttgaaaaactagatggcagtccagagagggcattaaacattgttagttataccagatgacatttttttttttttggatgacaagattcaatgactttagttgtaaaaatccgacttatcacattaatcctttagataggtatattatccaagtggaatgggtggttaatactgtttataaaagccaatgaagagtttaagctcacaagaatgtttagtaaactcatttattcatctgttcactaaacatttattgcatttctactctgtcattcactatgttaggcacaggataaaaaggtgtgagacagacatgcgcccaaggagctcatattggtaaaaactttctccttaaatttaattttatatattattttcattgaaaactagatcttgttttgttcttggtaaagcctgttctagtttttctttttctttttcttttactttccctttcccttccccttttccttttcctctctcctctcccctcttctttcttttctcctttccttgtctcctttctttgcttctttcctttccttcctttcctcctctcttttccttttccttccttccttccttttttctttccttctttacttccttctttctttccttctttctgtctttccttctttctttcttttgcaggatcttgctctatcacccaggatagaatgccgtggctcactgcagcctcgacctcctgggatcaggcaatcctcctgcctcagcctcccatgtagctgggacaacagccatgtgctgccacacctggttaattttcgatatttagtagagatgggagcctcactttgtcgtgagcaagtctctctccttgacttccctaattacaggcatgagccactgagtccagcctactttgtctttcttaagttgccatttttctcatgtcaagtaattccaactccatttaacatccttttagtattaagcttttagtatattttaaaattaatattgcctttctgtccttcatttgttattgttttattctcattcttttagttattcattcacttatttatttattcattcactgaacaaatgttttgtgccaggcactattctgggttctgaggattcagtgaacacgacagttgtgtttagtaagggaagatagataagtaattatacataaactaaacaaagtaattaaacattatgaaggaaataaataggttaatagtatcagtggagaccaaggggataacttggttgctgtctttaggttcttctttaatttccaactttgtggttgagtttggttacatctacttctgagatatctttctcatatcccctctccatcctagtatggaggaaattcaacatggtggtaatggatggcactggtccatttccctaatggaggccaagacttgacatatctgagaattttgcctgcatgctatattttctcccaaaggtttgtgcacttaatgaggcttatattatcttatagctgtgcctacataaaatcagacccaatcatttgaaaacaatttactttcaaatatcctataattcccctctacttagttgtttttccaagatttaaatctctgacatctatatcccagaaagctcttggatatggatgatttcccaaaactacacccgaggtttaagctagatgaataaaaatggaaatttcatctttggtcaaggacattttgaagtaaacaacaaagaggtagaattaggaatctaaacagaagcataaagatgaatgcattgtggatattgtcttgttacagagatttaggcaaattaactatcagtggtggtattcaaatatataaagtcctggcaaaacactgaaattagcaggcaagaatttatatgcctctaaatgggactaaaaattatttgtgtttttcaggtggcctacaagcagaaacatgatgctgccaaaggattctcagattatgcccacatgaaggagccccctgaggttaaacatgccatggaggtcaataaacaccagagtaatgtaaggaagcgcatttctcatgattttctagcgaactgtagttaagtcatattagggcttatgtttattttgctgaaatttaaacattacaacagccctgttcaaaaaagactttaatatttcttatcagtcagaggtacatctgaattattctatccacagtcattaacaccttgccgaatgcctttatgttgtcaggcactttcaggcattggaattttgctttgtacaagacaaatgtagatccttcagacctattgggttatcaagcatttccagagcttccttgacttgatgctgaagctcatggcttctaagtctagaatcacagaagaactggaagaaaggccatcaggaatcaatggcccacagaaggatcattcatgaacaccagctatattgtacccactactgttttcttttcttttctttttgacacagagcctcgctctgtcacccaggctggagtgcagtggctcaatcttggctcactgcaacctctgcctgccgggttcaagtagttctctgcctcagcctcccgagtagctgggattacaggtgcccgccaccacaccggcctaatttttgtatttttagtagagacggggtttcaccatctaggccaggctggtcttgagctcctgactttgtgatccacctgcctcaacctcccaaagtgctgggattacaggcacgagccaccgtgcctggcctattgtttcttttaggatgtttgtaagaacagatggtccaacctaagacccatggggaatatgacagcaatagatgcctaatggctgactttaaagccaaaacggaggaagtcagtcagtagaaaatcagtttcttttttggtaaaagttagcagttgcatcaaggtttgcatgcatttgctcgattaccaccaccatcctggtggcctagaagagtaatttcttcctggaattgtagggaaagcttttttttaaaatctcctcatcctgacttctctccaggaggaatgtgtgaactgttggtcaggttctttatgcattaaaatcagttaagataaaatgcctatcttttttgggtcaagaaactccctttcttggaaaagtacctgaagtacagttgccatctcacatccagtctgttctgtcacttagtccctttatggaatggtgcttggctgaccatgtgcccccatagtcccactgtgcagagtgttttccgcagaacggcaactgttatttgatattaaattgcagtaagcaaatgtttaagtaaaaaagtggaatgaggttttacgttttaacccaaatatacaaacatatgccaaaagcagagcacttttctaacatagtttaagattgctaggagatgaagaggctacatgtctgtaattattttaggggggtgctttataagaactgtttgcttaaggatgactgtaataatcataataactaccacttactgagcacagccatgcaccaggaactatgccaggactttgatcatttccgattctcatgaaaaccctgtactgattcttattttgtagatgaggaaaatgagactaagaaatcaaactcctgagtctgctctttctgttccactttgctgtctccaccttaaaggttactgtcaattagtcaaggttttaaatgcagtttttaaaaatggggagcaaaataggttatcttcagatttcaaacgcactgcaggaaagaatgacagagaaatcccgagtttccagtattttgacactgaagagacgaaattcacacaaaaggccacgggttagaaggtggtctggtgatctggggtgaggtctggtgttacacggatccccgggaggctctttccaactctataattcaatgaaattcaaatacggaagttccttatcatagaactgggcttattattttaactctgccttttcttctaaaaggtctttgattgagggattgagggaatagagtataaagcccttttctccttcattcaatactgtgtacttacgggagaaggctgtgtttacttatactcctctgccgacttgactcaacctttgcatgcaaagtttgtacatataataggatttagaaagtgtttaagactatttactcagatttaaagtgagaatgatatttgtattctacctgtgaagtagttgatattcctctggagtcaagccacttagaataatacatttgttgtccctacaatatgaaatttaaacataggtcttgaaagtacatctcttggttcagtgggtggatctatggaatctctataaaagacaatctcccataaacctgtctcctgtaaaagttcagccaaatgaaactcattgcagagaatttactagtggaattaccctttcataatgcagactgtcactttgcactatggctataaatgacttcatttaatttaaaataaaagtgtgtcattatatgtgtatctgattcacctgaaaacaatggaagtcaacatctttgcctaacttttttatgtttccaccaaaatcaagtcagatttctaatatcttttagtgaaccaagatgtctctctcttgtgcctttagtaatgtgagtaagcagaaaagaatgagggagagggctcatgtgactgtatggatgaatttccacctctgagtaatggagttcccgggcaagagttttctggaggcagtagtcttttgcgccaccccaaaattaaatgatctccaaacagtaaaaataagtatttcttagaatatcctctactgtagtgaagtggcatcattgtctggggtagtacctgaggttcatcgtctcatgtcaagaaaattaaggacacggacacacacaaggaatgaatttaggagtggaggtttactaggcaaaagaaagagaaaggagaacagctctctttgttgtgagaaagaggtgcacccaaatgggacttgtgcctcgtggcagagtgcatcggattttatagacaggcttgaggagtcggtttctgatttacatagggcccacagattggttggaccaggcgtgactttctacatagactgcaaggaagctgtttgctccgccctaattatattatgcaaatggggtctttgcctggcggtttccatgttgtctgctccctactgcacacatggttggaaaggaaaagggaagatggagctgccattttgaacatgtctactcccaggcagccttttcctattgtcacaactgtcaacattcacacgtgcaagcttacagctcacttgtgtatgtctgcagctcgattttacaggctgctctttgttagaaaagaaaaagactttggggctgctttttattaaaaggaaagtcttacgaaggacttccttaccctcactatctgcctaaatactttattcttaactcctatatcagtagcatatactaggaaaggaatttggagtcagacattggttaaaatgtttcttgggcacacgttgcgtggatgaccctggatgagttacttaatgtctctaaatctccattttctcatctgtaaaatggggacaacgatatctacctctgaagattctcacaagtattaaatgaaacattatgtgtaaagagcttcacagcagagcctccatcttaaaagttgctggcatacattactggttctatttcgtcctccttctacttttaaagggtgatttgggagtttagggtgatgtcatagttaatttgaaacaagtaaaggaagttcaatttataaaaggccaaatcaatgtgaaatttatgttaagaaatgtttaggtcggaagggcatatccaaaagtttcctgaacctatcttattaatactataatcagaaaatgattaaaaacagccaatcgaaatctttttgtaccttaagggacatacccctgccagttttttctaatgtaattagagaaattggagatattctatccagtgactttcccctaaagatgggcttataatgaaagccctagttccattattagttctcatcagtcttatgagagacatgaagtccaatagttctgaaataagtcaaacaaattttaaactctattttaagttttgtaagtaatgtggtctatacagacttgtgatgaaattggagtggtaagcttttccaaaacaccatattggtagtcaattcaatgtgtattagaaagaagtattcagcgtgggaaatgaaagacttactgttcttttcaagaatgatatatgtactttcttaaaattaataaaaacttatcagtaaacaatttctattccatcagaaagtgagaaagcttaaagataaatcagtaaaatgatactagaaaaacaattatggctctctgtggttccccgatgagacttacaataatagtgctttaggatttagcattaaaattagatatattagtgttttattcatctctaagacagaatagttagtaatacttattctgccttctacacaatatggtggtgataaaattaaatcatgaataagaaaataagacaacttttatcaactatagatttataaacagtgacagcaatcctaaatgataagccattctggccataactctgtattttactccttcttttggaagactgaaaactttttctctcttctgaatagtatcagaacctacttttacttatatttaaaaggcttatattctcttacagaaaaataatatttacaatttaataatttagtaggtttttatgcacagcatgcctagacaaagataagcatcatttgagatggaattagcagtccacatgcctatttgatgatacctggagggcttctctaatgtgagagttttgctaaagacaaaggttttcctgagatgggttgaaccattgcttaaagattaccactatataccagttacatgatttgcctctgttccacaaacttaaaaggttatatatcctgtctagtttcttctcaccaagaatcagtttaaccttcaaagggttctgggtcagctggatttgttttctttaaggtctgtctgcccatgcagactttagaccccatggctggctggctggctggctggctggctggctatcactcctgcaaggctgccattcctgagctgtctcaatcttctcatctccaagtgaaagtcatctccttgacttccacttcaaggagagtctgtggaggttttgcttttctctggtttattaactcacctaccagagagtctcaaatcactgttgcctgagtataaaaagcttgctggaaggccactgtgaatcctccagctgcacatgtgtctgcctatacctgcagaataaagatgtctatttcacatccactttcaaaatctcatatgcatttctcttattggccatgtctaacccagaactatttaaggaaaggtactctggaggatgtagttccagtcttaaaagggagtgttgatgtagcccagttgagtcaagacacatcagggatgaagtgaggatttaatgaattgatgcagaaaaggatagccgggcaccttggatgctctgcacgagcatagggaacatgcaaaagacatggctcttatgaaacagaagtgggaggattataaggagagaacaagctgagattaaaagacaataaaataagataaaaatatgagctcagggtgaaagtgaatatggcgagataaagaaattcagagacagattttgatggaattcaaatattcgttggaagcaacaaagaacagatttggcactgtagaaaaatgtgaggctgggtgcagtgactcatgcctgtaatcctagcacgttgggaggccaaggtgagaggatcacttgaggtcaggagtttgagaccaacctggccaacatgataaacctcatctctactaaaaatacaaaaactatctgggtgtggtggtgttcacctgtaatcccagctactcaggaggctaagacaggagtattacttgaacccaggaggtggaggttacagtgagctgagatcatgccactgcacttcagcctgggtgacatagcaagacttcatctccaaaaaagaaaaaaaatgaaaagtgaaatggaggctgtgttagaactctctagatttcgtgacggaaatctatctcaagttagtgcaagtgaaaaatgagattctgttgtgtatgtaattgacaaatccaagctatcttcaggcataagtgggctggaggctttacagtgttaccagtactcttcctctcttcccatctttgggctctgggctgtgtatgacactttcagacaggtgctttctctgtggcttcaaggtgacagctggtgtttccaaactttaatcatccttacagcagctgatctcagagaaaagaagagaagctctttctcctccagcctcagatcattcaaatgactctggccttggttgggttacgtgtctgtccgatttcattaatcatggtttccaaatggatggggtatctggcaggacagcctaagtcaacatgaaggcaggctgaacttcagaggcccaccaatcacatggagtgatgggggagctgtttccaaattaaaaaacctaggctgacaaaaaaatttaacacatgcccactacaaagggattagataggagaatgacttagataaatgagaaagaataaagagataaattcagtgaaaagaagctaagaggaagagatcaagcacataaggtaataattctaggtgttcctatggaagaaaccagaatcactattttcagataagactctatactgttattcactattaaaaggaaaaagtggatcatcttgagtacaagataaatgtataaaaatgatagtatgataatttctttgcccagtgacagacatatagaacaaaatgatgaaacttcatttaaagttataataaaatattcgaagaaatggaggaatataccaccttctcataggaaaagactgacattttgttatgatatcatttttctttaaggcattttatagattcagtgcaatgctcattaaaattacagttatttgttttgtggaattgactaaaattattctaataaaaataagaaaataaatgaaatagatgagtagtaaggaaatgaaaatttagcagatgttatgattgtttgaaaaatttcataccgtcataccttgaaaaaatgtatgagtgagggagtgaatgttaagtccttaatatggtacataatagtctaaaattgagactatcattattattattttctttttctcccctcctccttccttctttcttcttctttaatctttctttcttcttcctcctcttttccccctcctcctcctgttcttcctcctccttgtttgttctctgctatgatctgaggacagagtagggaacaagacattaaggaaaataatgtaaaagcaattattggccctcaagttcacatctctgctgagttgatgatttcttcttttccctgtccttatgcaaaacaagatttatagagcaccacattgtcatgagaagactgaagagtgaaggccagtccactgttccaatatggttagcatttagggtttgaatttattaaggaatagaaaaaaatatgtatacacacactttgaactccaagcctctcttctgctgtgttacattttttattcttcctgagctctgatggatggtagattggagcaaatacttattgagaaatgtcagatgagcttcccttaaacctagtgttacaggaaacgggtcctgattcagaccccaaaagacgttcttggatctcacacaagaaagaattcagggtgagtccataaagtgaaagcaagttcactagagaagtaaaagaataaaagaatggctactccgtagacagagcagccccgaaggctgctggttgcccacttttatggttatttcttgatgatatgctaaacaaggggtggattattcatgcctcccctttttagaccatgtagggtaccggcctgatgttgccatgggcacttgtaaactgtcttgatgctggtgggagtgtagcactgaggatgaccagaggtcactctcgtcgccatcttggttttggtgggttttagctggcttctttactgcaagctgttttgtcagcaaggtctttatgacatgtatcttttgccaacctcctatctcattctgtgacttaaaatggcttaaccatctgggaatgcagcccagtaggtttcagcctcattttacccattcccttctcaagatggagttgctgtggttcagatgcctctgacactagcaatgggttacgtgtaggaatctgtgcgagaagccatgttgccattccatatatattcagacacccttggagatagtgacatcaagagtgtcaccctcttgaatgtcccccaacataagccccctttcctatggaatattcccaaggagtgatattctggaagatctgacaagtgatcaggcgcggaagcttttttctgtgtggctccgtggtgtcctcttgtttgaatttgcagttcatgtcaatcttaatatttgttttgagtcacatatgccggcttctactttgcaatttacatggatgatggggccctattcaaagtcctgctcctgctgcctttgtgccgttcacctctcttcacgcagtcattaggctgaacaccatataattaggtaacccatgtaaagcttagatttctgaaaggttgtggttcttttcaaaaagtaagggtttccatttttaccctcattcttttctaaacaaaaagacatttcccccctgcggttttcatatgaatgtagtaacttagaaacagttagtcttgtaggtgggtgataatttgggtttgttttcacctgagagccagtttttgtttacacagcttgtatttaactcagggtaggatgagattgatttaccatcatttgtggataagcatgttgctttttgaagccaatggaattggcctgcttaaaaaaaaatccctaaagatttaaaatccacccaacaaaataactcagtttcggccttatttttatgttccttttactacctgtgtgcataaaacctacctgaaatgacttgttaacataaaacctctgaaaatataaatgtggaagaaaacagatgttctttctgaaattatactaattgtgtttcagctgtgttcacttgtcagacagattcatgattataagtgtagtttaaaaaatagtcttggtggtgaagcaaatgtaagctcataaaagagtaagtagaagtgtatataaatgtttcattgaaataaaataacataacgcacagggagcctgttgatgtattaatgcattgtcacttcttacacttgatcttatttttaaaaggagtaagaaagggtgaaatttttaattctgctagattgaaaggaaactaacaagatatatgaatattacccagaacactggtttatagcagtcagctagggaattcattaaaattagatttttgggcaccatctgtcaaaattctgttacagaggattgtggctggacctcaggaatctaaatctttaataagtacccctaaatgatgctatttcagaaaggttgcaggtgacattagaaatatttgtacacaatgtaattaagtgtgcattttgtacagatgtccagtgacacatttctgtgatctttctgtgctctgaaaaaaggaagatgggttttaagaatgtccatgactgtacactttgcattatgactttaatagaatatattttaattgccagctggtccctggggatattgccaaatagaaccacatctggcaaatattgcttcagctcaagacaaatcgcaagaaataaagaagtgagctgaccagtgaaacatgggccatcggacattatgccagttcaatttttgtctctctttccaattgtcagtcaagttaatctaaatgacgaatgtgatctaaagtacatttggcaaagtttatgtatttttctctttaaatctctacttaccatactttggtttgtgtctaacatgcattcagaaggagaatgttactcaatgtaattgtttttattttgggaggctcaagtcattccaatgatatttattgggtgataaagctctcagtaccttagatctcctaggcatgggcctttgaacatttgaagggagagaagtgtgtagttgaaagggcaaatgctggagaactacagagcttcaccacccaccatccccaaggaaataatttgcaatattcttgtgcttgggcttatcttgcacccactggggcttgagactttgtgatgggcaagttgaagttcttgatgaggatattctgcttatgaatataaatatatgcacttagatacaaagacatactcataaagtggtagatacaaagaccctttaagattggttttgtgctttgatcttagtcttatttcttaggtagcataaattcagttcaagttttttttttttttttttttgagataaagtcccactctgttgcccagtttggaatgcagtggtgctatcttggtgcactgcaacctctgcctctcgggtttgagcgattttccttcctcagcctcccgagtagctgggattacaggcgcacacaccatgcccagataatttttgtatttttagtagagatggggtttcaccatgttggccaggctggtctcgaactcctgacctcaagtgatccgcccacctaggcctcccaaagttctgggattacagacgtgagccactgtgcctggcccaaatatgttaatatcagtgagacataggtatagtataaagagttaatatagctatacaaatagatgcacaaaaagccaacttaaggtcagtaggctctctaagctattattatgagaataaataatgttatgaacactaagactagtagctatgtgaaattactaatttatttattttttaaccaaaactgtctctgatcagatttcttataggaaagacgtgcaggacacccacacgtacagtgcagaacttgaccgaccagacatcaagatggcaacccagatctctaagatcataagcaatgtaacttctctttctaaaccttgaacggaaatgatttcttacttttgtaggaggcaaagcatagcttcagtggttggatggttcatttaattagtgtaactaatcaatataaatgaatacatctcaatttccccccctaaattatctattttattatgttaattatttgggtatatgcagaaacagcccaaactcaaattggctgtggttagtgtcatcatacttttagagaaataaatactatttaggtataaattgacattcagatgtctcagcctgaaagtcagggttatcagtcatatggtcccatataatctctcccctcaccttgctccaaaggctcttgcttggccttgtttccatattgctgctgttcattgtgtacattctcttccaccaacacttacctttgtccacttcctacatggcgtaactgtttcttaccttctctaaggtgcccgctttagttaataccattttacttcaacatgctgaaaaccctggttggaaatgatgatttaacttgaaccaaaaattttcataacataggctaaattcaccctaaaatcaatcattactgtattcaactgcatgtcaatcaagtatggccagaacagttcctgagaataaacgaaactataaaagctacctatatggagagtacagggtctcaattccccagaaaatttccctaatattttgttttagtatttatatataattacaaacatgatgatgactgaacacttagcctcaaagttagtaattattttactgcaaaaagttgagtttgttcatgtaagcacaggataaaatcaatttctgctttagcagtcaacattttagtgtttgatgtgttgtaaggaatattaatgagatgaaggtctgttatttttttttttttggctaatgtcaatgtagttcatcattggagggtagaaatatttaacattgtcttatttattcattttaggcagaatacaagaaaggacaaggaataatgaataaagagcccgctgtaattggaagaccagattttgaacatgccgtggaagcttctaaactttctagtcaagtaaggctttagtgatgattccacaatgactttattcagatattttgtttctaacagcacaggagaatattgcattttagataatatctttaattgcaagaataaacagagataatgtttctgaacccagttcagatgggcttgcaatcattatgaatttcagtaaaggaaaaaaattaagtctaattttaagcataaaacaaagttttcttttctccaggcataaatctgaacatttttcaatgtctctagccatgttgtcacatttccctggatttccagaagtcattaatagtcatactaaataattgtgttttaacctacacacacacacacacacacacacacacagtttttaacttagtaataaaaatattaattttcccaattttcaagtgcttttgtttaatcacaaaatttaaaaagggagatgaaaatgaagaaaactttgaagtcttatcaaagagcataaaataagatctgaaaaagtataaaggcattttatgtttttggctgaaagtttcaatagataaagatgtcagttctttcagaattatataaacgtcatgcaacttctgttagactccaacagcgttttttttttttttttaatatagataaaatgatcttaaagtttgtgtggaaagaaaataccagggaatagcctttaaaagtatgaaaatgaagaccagtgaaggggaacttaagttatgagttactataagttaatagaaaaccactgaaattaaatcaatatgggattggtgtagtgagagattaaataatcagtaggatagaatagggagtcctgaaatagattccagtatgtataagaatttaatatatgataaaagtgtcgattcaagtcagtggggagaagttggattagctaataaatggtgctgacataacacaccgtctgtcatgggaagagcaaaattggacccaaatcttaaaccatatacaaaaatgaattccaggtggattaaaaatgtgaatgcaaacaataaaataattttaaaatcttcaaagaaaatccaggagactctatatactacataaggataacagagttgttcttaagcaagaccagaaatccagaagctataataggtaggcacattaactatgtaaaaatgaaaaactctctgaatgaaaaaggtaatgtttgcagagtcaacaataatgttaacaaacagtaagttttacacatttatagtttttttgactttgaaaatactcatttctcaagttgcagaagtcttacttgaattacatttcaaagtggagagatgtaaatgatgaaaggtatgaagtctgattgaagagcataaaataagtcccgaacaaatgaaaagacgtactattctgttggtgaaagagccttgatactaaacatcctaaaaaatgttaactctttcaaagttaatgttaaaagctctatgcaattccaattgcaatccaaaaagagggtttaaaaaatttaaatgaaatgaaaaacttgaataaattaaataattcagagtttatacagagaaggatgtgtctgagaatagttttttaaaatataaaaaaagagaagtcttcaaatacttggaaaagtacttctaatgcatttgatgagaacattttaatattttaaatataagatctatagtgtacaatatctataatatataaacattcttgaaaaggaatttatttttgtatatagtttaagatttgggtccaatgttgttcttaccatgaatgaaaaagattaacggctcagtagaaaaaggggtcagtgaaatagataattcacagaagagcaaacataaatggccaatcaacaggtgaaaagatgcccaaatttattagtagaaagggaaataccaacaaagtgaaagcaaaatgtcttttacacccatttacacccatcacaatgtgtcttgttagtgtggagaagaaagacgcgtccttagaaggttcatgtgtaggaggtagattttagctaatttggatttaatgggagaagtaaactctactcaaggggaaggccccaaatacaggctgggagtatgcctgccaggggacagaaatctgatggcagagcctctgggcaagaggatatagttgtgcacgtataaaaaggattttgagaagagtttagatattgtgtgatgatgaatgggtcaatgtgtattgattttgagtataagccattgcttagagaacataataggaataatgtgttcatatatgtaatttttccccatttttttatcgtgataagatttatataacataaaatttaccatctgaaccgtttttaagtgtgcggttcagtggcattaaatgcgtttgtaatgttgtgctaccctcaccaccatccatctccaggactcttttcatcctgtaaaagtgaaactctatacccgttaaataataactccccaacgcccccttcccagaatggtgtgttctatgaaaaaataatgataaaaaagtgatttcagagcgcaattataggaagcattttagggttcaattccaaaaagtaaacatcagaactactttttgccatgttaactgtagtctctcagggaagaaagaagacatcactgaagattttgagcaaagattgattgtgaagaaaacacttagggaaggttaacatggtgacactgggcaggaaagtctggctcacaaatggtgaacctcccagaagccagctgggctgtgacagtggtaatctacacataaagtgatcagtacctgaatagactctgtgacagtaggaatgaaaatgaagtggacacaactgctccctgggagaggcagacatgagagatgcccaaatgcaattgtgactcatagtaattgttttacagttaacaagggactttcacttataaagcgactttataactcaggaggctactgatgtgcaagaggttggggacatgtctgggtgacacttgcattaaagggcggtgactctaagctctacatattcccagtaatgctagttgaagagacaggggatatgggcatcacttcagatttccagcatagctactggcctcttacaacttcgcccttttctggggacaaagattccccatcagttacacaggagacaaagcaaatcccggagaagcagtatggtttggtctagtggttaagaaaatgtaccctggagctgggctgtacctgggttaaactcctggttctgttgcttgccagcagagtgatcttggacaaattgcttcatttctctatttttgtttcctcatttgtaaaatagggatgacagcaacagtatttacttctcagggttgctgtgaaggttaaatgagttactgtgagtaaaacacttaaaatggtgcctggcccatagaaacatgacataatttcataggaataattttactttaggtattcaaaatagttttctattctacatttttagatgaattcatgcacagagtggagaaggaatatgaacactgtctgtgagattctggccttaaattcattccatcacaatcctatttgagagcccttagaagaaagttttgacatttgagctttattttcacatttcaaattcaatccacaaaaattcccccatgtgatccttacttggacttgaaagcagatttttttccttcaatctcaaattatttagcaactgagtgatcagattcttaagcagattttaatttttaacttacattatagctatcgtattcattttttcatgtcatataagattttataagctgtataaaactcacaagaaaaggggaaagctgggaaaataaataataggaattctgggatgaactcagtgtattccatttgtattttcaggtatatcaattataacagaaatttgggcagcaagtttagtttcttattttcactgacagcattaaagtttttagtttgctcctaaactaatgataaaggcacataaatacatagaaggcaaatgatttagggatttaataacagggagatgagaatggatagaatgcagggagaaaaagagcaccacagcaccagaagcattgtaacagagaaggcaatgacaaggcaatggtcaaagtatgtggagataagacctgtctgatgaaaggatgggaacagagagtgaatgggcaggattctcaccttttatctgtaaattgaactctgtgggattttacccaggaaaggtagtgggaacacataccaaacccttcttatattaacttctacaatagctttgctcccgtagttgtaaactttccctttttaaaatttgcaatatacatacaattatggccaggttattttaaaaagtcattaaaaaactaaaacaaaaatctcctatgcgaagatgaagggattggtgcatatgtatctcagatttaagtacagtaactgttgaagtcattgactttaaaaattctaagagtagtttattaattaatatatccatagatcatcttgttacttggaatttgtctatatgatgaatagattccttgttcagttttataacctcaaggaaaagctatgtatttataataattagcattgttttaaaattgcattaatacattgataagaatgggttttaaacctaaaaatcacattataaattgccatgaaaatttagtagtaagcagtggccttaaattgcaaggggtattaattggtttggggaatttaccattctcccatcctggcaagcactccctcctccaacctcatcacacccaagtatcagctcaaatgtcatgttcctgactcgccaatttaaatattgctctcctcccctttattctctcctcttctttacagttcttaatacgatttgtagtagttgcataatatatacgtgtatgtgtgtgttttcgaaatccatttcacttcccacaaggcaggctccatggagacagggctcatatgcctttgatccactattatgggaaaacagattaggctgccaataggtgtatggagcctggttaaaccaatattctctggatcattaacatttggtgcaaagtcagtaagacgttattttgcaaggaaaataagagcagagatattgtgttgtgtaaaattaagacttaaagatattattgattttatgatgagttctatgtaaaaatctgtcctgtcttccttgacagcttttagtttgatttcatccaagattgctggggattgatatctatagatacgtagtattgtgttatttgcttacttttcattttcaatgataattaaggtacacttatcaagctatttctttgctaaaatgtgtttatgtggctatggtgaaacaccttcattcagggtctgcttttttgtgcctttgctggctttttgcgattctgagtcacagatgatgtcagtgtaaagttttgggtttgcgtgttagacttcacacatacccaggtgcagttatgaggatctggatcctcatatgaggatatgcagatgtaacttctcatttctttatatgagaagttgtgcagttatggggagctacaatgccgtcactgtagcttaacagtatccgtgttttctccaagtgtgagcctctgaaaatcctgctgtctcttataattctttaaaaaacatctaggagtttgatcctatatacctatacagtattttttcaaaaggtgttatttccctgatgtgattattatgcactgcatgcctgtatcaaaacatataatgtaccccataaatataatacatacacctactgtgtacccacagagattaaaaataaaaaaaattaataaaaaaaggtgataaatattgggaccactaggcacactagtcataatgtaaataaagccagtcatatggagtaacttcatttgtttccagaataattatgtaggtataaggagtaacattgtgtcttaaaaccatggcaaagtcactccaatacctgttcctccctttctcaaatgatcttaaaactgaaagggttatgccttgttccatggttggataacaagttatagtcaaggaaaagcatttcctggatctctcagaagatgcaaacctgcatgaggaggtagacacacagatgtatgaactctagattgaaaatacaatagaatgttgagtgtgtctgtgtagttggcgagtgaacaagtccgaaggtgagtgatgtgactcactgcaaccatttggtgatcttagttcattttacctgcattccttacagaaagagcgaggttagaaacaattgggtgtcagtgtctggtccgtgcatttttttatataatgtagttatgttactattgtggttcattaatgagggaaacttgtgtttttgttccttaggcatcttgaatcaaatcactcactgtactgaacgttcaaacaagataaatttcacaatacaatgcttattattacatttaatataaatatatgaataacagattgattattgtttcttagaaatgcatagatggtccctgacttctagtggttcaatttaagactgtttaaccttaccatggcgtggaagtgatacacatttagtagaaaccatacttcaagtacccatataatgattctgcctttcactttcattacagtattcaacaaattatatgagatgttcaacgtgtgtaaaacaggcttgttattagatgattttgcctagctgtaggctaagggagttgttctgagcatgtttaaggtaggccaggcgaagctgtgatgtttggtaggttaggggtatatggtgcatttttaacttacatttttaacttacggtgggtttactgagatgcaatcccatcataagttgaggaaggggtgtctgtaacatttacttgggagagcatatgcaaggtttaataacaaaggaatttatcagtatcattttcaaatactctagtgtaattatgctggaaacctcagagtttgcaaaaacagtatgatgggctctgtgtgtgcaaagatcatataacctacttttaccatttagctaatacagtgttaatgaatctggctgagtcagaagtgtcattccagcggaaggctgttgaagagtccaccatctttgttcagtgaatatcctttaggcactacaaacttaggagagacagaaccagtgacgaaaatatggtaaaagtatagcagaagggtgaagagggcaataagactgtggctgggcgtggtggctcacgcctgtaatcccagcactttgggaggccaaggtgggtcaggagatgaaggtcaggagatcgagaccatcctggctaacatggtgaaaccctgtctctgctaaaaatacaaaaaattagctgagcgtggtggcgagcacctgtagtcccagctgcttgggaggctgaggcaggagaatggcgtgaacctgggaggtggagcttgcagtgagctgagatcgtgccactgcactccagcctgggtgatagagtgagactctaagactatatatttaagggacgaccaggcagagtgaatcattgcttttgtgccacctactgtataaagtactgaaggaaatctaaatttatttcatttgtaattttgttattgatttcaagacacaaaataataaaaaaagtcagtttttctttttttaaagagttcttgctgattacttaaaatcagtttgtaaggtattgagaatatcagaaatttcttattatcaaatggaaccagaacagaaaatattccctgtaaaccatctcaaaatatttaccaaatgctgtattcccaccaagattttctctagctctctctaataggttccaaacatgtgtccctgaaggagaccatcaccctatgcatgcctaaaatatttgatgagagtcatcccaaattgctttttaataaagtcttctgcaaagcagagcctttagatgtatgaataaaggtgcattatcagaatgttgttagaaaaccaaacatggtaataattataacatcagaaaaatattatgagagaacaaaacagcttactttgacctgtgaaatcaatacaccctttcctggctacagtaagttaaagggggtatgacatgtgaatagctaggttttttttttttttttttttttttttgtagtgaacttgtgtttatattctaattagttatgacatgcattctcatatttctctatacatggagaaaaatatagtcctaccaaataagttgataatccctttttggttgttttaagagtgctttaaaaggagacaaacaatttagagagagtattggagatggttttcctgctgaatttagtggaattaaagcagagaaagttttacattgacattaagttgacccaggacatttcagaaaatgtaattcctaaaactaaatttttgagcaaatgaagtataggaaatgatgagaaaaactgtggtacacgtcatgctctttatttggaataattcccttaggaaaaatatttaaattctggggcctagaatctattttctaaatgtgttagaccttaagacatttgtggtctaggtttctaactgatcatagattatagaaatgcagaaatgaaaactgacatttaaaaatgttggtattttagtgcataattctcattaataggatttgagttcatgcctaattgcatttgtgatcaatgtagaagcagagttttttttattaaagataaaaacttttgtgcctaattaagctttatagaaggcgatggataccaggaatttacacttggcaacattcatttttaaggtagcttttattttatctacgtgaaaatcatatgtgttacttttaaatgtaaagttacatgtactatttctcttttatgacagattaaatacaaagaaaaatttgataatgaaatgaaggataagaaacatcattacaatcctcttgaaagtgcttcttttaggcagaatcagcttgctgctacactggcgagcaatgtaagttgtaattcatagaaaattattttcaaaatcttttgattcttgttttttttagaatcgactgtgttgtaattactgatacttagcttccaagtaatttgtagttgaactgaagcatatttttctaaagctttttctgagaaaaatatattattgtaattaatttttaatggttactgattactaattagttaataagtaggaatagtgttgcaaatgaagttattatatctgttcaagagtggaaatagattatagaattttgcagagaagtggtctgtattaacacaaattagtggttaggacagtagttacctcatgtaattatggctatgaaattgagtttattgtaaagtactgcctggtacatggtaatttatcatataaagaaatttttagaaattttactgtaatgcctcacaatttattttttatcccttgtgaaaatgctgtgaagtacttccttatgtgatttgttttcattctgtgtttttaaaaatcatcaaaattcattttacaagaaatgatgttttaaattcttgttagaattagagtataaaaacagcaacatcaaaaaattgattactttgctatagttgaaaatatttagatttccttctcaagtataaaaattatgtattattgatctgttgctttcttagaaatagagatgaaatatacttaaaggaacatggaacatagtgctgaaagctaaaggtttggagtcagattgcttggatctaaatcctgttttatcaagtattactatgtctttgtctttctatgcctcagttttcttatctataaaatggggctacttaaagtacctacttaataaagaggttattgtggagattcaatacttaatacatataaaggaatttagaaaagtggcacatagtaagtgtgtgatatgcttgctatcaatggtttattattactggtattatattttcaaaaagttgctttaaaaaagcctgtggtgataggatgggaaacatcaaaatcctcagatctccacaaagcatagttgaaatactgtagtaatttctaaagaataaagtggctattctctttattttttgaaagcagagttactgtgaaaattactttattctgttgacattacccttcctgaatatgtgaacaacaaaaggaattatccaagtattctcaagcccatatagaaataactttttaaaattcattcagtagtaaatcagcaccatctagtggctccttgtaaattcgtctgtccatttaccacttaatagtcctactttatgatgtatgaaaaatgcaataatgcaaaagcataatattttcttctcctcgatggtattttgttccatgttattttcataggtgaagtacaagaaagacattcaaaatatgcatgatccagtttcagatctcccaaatttgttgtttttagaccatgttttgaaagccagcaaaatgctcagcggcgtaagtggttcatctagcggcaaccgtagttgccttgtggctccaagaagccaatatgtctgcagcgttcatgtgctcacctgcttccttagaaggcctgtgcctcactcctccctcgttaactaactcattgaaaaacagtcctctgcttgcagaaatcccaccagagctgtcactttgcaaaggaggttcttgcttgctctccagtatctcctgcatacaactatacttcaaagtgtctgcacagtggcctttccatcattcttctttcccttacttcatctgtgttagattaaagccacttgaagttcaggctctcaagtcagggatattttactttatgcaggccagaccagagtgtcttgtatttagtacgccttcagtagcatgaaaaattgtcttagtctaaactgtattttctctgcaaataattcctaacagcatttatactgcattgacacatcgcttttagtcttgtcatggtttccatgttctcggtcaaggcaaccagaagagaaaggtgagttcttcatgtcttgatgaaaatatctgggtgcactgcccacgtggtcagtcctgcaggactctcactacgctgaatgctgtttcaacccatagcacatcaggaccctgacttcgctagctctcgtaactgacagccctaagacacatttggctccattttgtacatctcatggtggcaatgagctcttatttgaccataagttatttccatacctattttaataatcactttctcactcacttgctcaaaattaatcataatttattgaatatctgctttgggccaggcatagattagatgcagaaatatatgttggggaagacatgagaaaaaatgaagatagttgtcttcagttgatgggcctagacttagaaatctataggcaaaacttagtttccagacagttaaataaggagatacagcttcaggtcaattttagaaataatctatacttggcttcagtgttttgaaatgtatgtttattattttgtaagcctcctttctggaatatcactgccactgtcttccttccttaatggtattatgcatgcaaataattcatacagagtttttaaaagtttatttttttctggctgggcatggtgtttcatgcctgtaatcccagcactgtgggaggcgggtggatcacctgaggtcagaagttcaaggctagcctggccaacatggtgaaacctcgtctctactaaaaatacaaaaattagctaggcgtggtggtgggcatctataatcccagctactcaggagactgaggcaggagaatcatttaaacttgggaggttgctgtgagctgagatgacaccaatgtgctccagcctaggcaagagtgagactctgtctaaaaaataaataaatacatagaataaaataaaataaaaataaatttatttatttttttaatcattggtccttggatgaaaagcagtacattaatgttcccaggctattgaacagggaatggaggttagaggaatatctggagggcccagaattggcagtcagttccaggacacttacatcatgctggcttgcacttcagtcttcattcccacacctctttttacattcctctattccttgagtgtctctatttctgtcttttttctccacgactcatagatatgcttctaaaattgatatatttctattccctgagccccctgctttcttcacattcattctttggcatccagttttcatcatggcagtggcatttgcccttgacctttctctagccatacttaaattcaatttcctagggacatggggattcatgtgtaaataagccaataaaaatatcatggtggtaatttcaacatttggtggctggaagaaagcgtgccactcctatgcaatattgcttttcaagaacgttgacctttattttataataacagagaaaaaaatcgcagtctaatataaattgtttctatcatctcttcaacagagaaaacacagcaaagtcatacgttacttatttcatgtatcatatataaagtttagatcttcatttaggtggtgcttttgcctagaggacagatttctttttccccatagacaaattgtgattgactacttcctgggagagaaagacttaaaaatgtgttccttttgaagtgtctccttacaaagttgtgtacattgtataaagctgtatacatttgctcaactttattgtatattagaatggcctcctttatctagcatttgtgaagaaacaaagaatagcctactttaacattttaatgtaaaaaattggagttgtgttgatttataaattaaaagattgaataagattgctcaataagagatattctgccaaaattatccatttgtcatagtagctattgttttaaagacccctagatgtctttagcaacatcagagttacttttattttaacccaaactctaaagagtgatatgagtgccttaattactgtgtaaaatcattctaattaaagttttggaaaacattttcccctggaaaatggacctctggtagtgttgagtttctttcacaactttacataaattaagaaatatatattttgtgttactccgtgtatctcccactaggaggtagcagagactgttatataaggaaagacacgcattcgaagttcttttgcagatcttaattcaattaagttttccttcgttttttttttgttttgttttgttttcttaaataggagtttctgaaattctttgtaactaaaatcgataattgtgttgggaacaatatttactgaatttttcagtatatattcattattttacatatatttatatgtatttgttgtggattttaactcagtaatggactatgttgtagcttgttacattcatgattattttataaatacatattacaagataacttctaatcaaattataaagtctgtattattatctttctttccagattttaactggttaaaaaaaaaacactttttttttttttttaagacggactctcgctctgtctccaggatggagtgcagtggcacgatctcagctcactgcaacctccgctcccaggttcaagcgattctcctgcctcagcctcctgagtagctgggactactactactaggtgcaccccaccactcccagctaatttcgtatttgtagtagagatagagtttgaccatgttggccagggatggtctagatctcttgacctcatgatccgcctgtctctgcctcccagagtgctgggattacaggtgtgagccaccgcgcctagccaaaaaaaggcttttttaaaaaaacattagaggagccaaaatttataacttgtttccttccatcacgatgtactctgtgggctaggtgcagtagctcctgtctgtaattccagcattttgggaggccaaggcaggaggatggcttgaggccaggagtttgagaccagcgtgggcagcgtagtgggaccctagctccacaaaaaataaagaaattagctaggcatggtgacatgcacctatagccccagctacttgggaggctaagatgggaagattgcttgagcccaggaggtcaaggctgcagtgagccatgatccctccactgcactccagcctgggtgacagagcaagaccctgtccaaaaaaaaaaaaaaaaaaaaaagtactatatgaacattttcatgaccttcctggggggtgctttcctccctgattttattctggttaggtttgggggaacatatattgcagctccctaattgagtggaagcacctgaggccaggctccctctggggactattgctttgtcccactagaaagggtagctctcttgtggcaggccacttggtcatctgttccattcctagcactgagctttcttcctctttcactctgaaatccctggagtatcccctaagatcaaaatgcaaatttccttatggccagctctttcccgctccctttcaaatactgtttttggatccctccactctattgccatttttactggtaccccattgtctaataagcagctatctttagcttcttaagtctctgtagccttgagtctttaagagctaccatttactactaaaggtcttttccaaataaggcaaaataacaaagtgtccaatctccaatgatagaaatcatgaaataattatttttaaaattttctaatttataattgttattgatacataatggttgtatatatttatggggtaaatgtaatgttttgatacaggcatacagtgtgtattgatcaaattaggataattgaggtatccatcagttcaagcatttgtcgtttctttctgttaggaacatttcaattccactcttagttattttaaaatgtacaataaattattgttaactatggtcaccctattgtggcattgaatactagatcttaaactcattctctctaacggtatttttgcactccttaaccatctccactttatctcctctccccaccactcttcccagctgctggtagccatcattctactctgtcttcataagttcagcctcccgagtagctggggctataggtgcatgtcaccatgcccagctgatttctttattttttgtagaactggggtctcactattttagctcccacatatgagtgagaacatgtgaaatctgttgttctgtgcctggcttatttcacttaacataatgacctccagttccatccatgttgttgcaaatggcaggatctcgttcatttttgtggctgtatagtattccgttgtgtatatgtgccacattttctttattcattcatctgttgatggacacttaggttgctaatgaaacaatttttgtcatattgctgcctgttacatttagcttctttcagtggccaaacttggcatccctgttcaatttggtgtcttccaaattcaactttttgtctatatgtccaaatagtagccttcatccaattttttcaccttaaaaactcaactgactgttcccagatttctcaatttctctttcaggcaccttttaccctttccttttaggaacaatagttgcttatttctcttacattttccttgtgcctctcaatcttctttgtggtggagtctttttgtataggacttttttattccttgcctctgggtttcttttcctctgttctttttgcttttctttccttctcttcttttgaacagtattaaacatattcctgtcataagataagagcaagacaaattgcttttatttttccccactttacctttttccgcatgtcctagcgctagctttccgttgccacaccctggtgttgtgaatatcctttacattatgtttgcggttaattgtcctctgcctctcttgcgtgtttcatatgctgacctagagctggtctgtcttgcattgtctgtgtatctcagtgtcagaaacctcctacctgccagccaactgcagatggggacttggcaacagctttgcagctcttggtggcttgtaatgtgcagtttgtatttctaagtatttattgctctaatcagtctctttgattctaagttgatttccccattctgtattttagcgagaatataaaaagctctttgaggaaaacaaaggaatgtatcattttgatgcagatgctgtggaacatctgcaccataaaggcaatgccgtcctccaaagtcaggtacgcacttgcccgtacggtacctaccctccctgccagcaacccgtaaccatcctgaggcccgccgctcactgccgtgcgtcttaactgagaaagtacagttgcagaaaagaataaatcctgagaatattaacattacttttgaaaatctcaaacactatttgctgtgtaggtattggggtcaggggagcttgaaccatatttcaatctaaaggcattttgtaaaataaccgttaattcacataattaaaaagttacaagataggaattaattaaactatggtcaaaccacatgatgatttaaatttttctagtgtcttgatttgtcattttgagcagtaacgttaattttccaggtgcaaggtttattataatttcttatttcaattataagtgttattaaaagggaatacaatatgactaatgtattcttgattaatatttttttccaatatgaaattctaggtaccccctgaataaacttaaaaaaaatcttctctctagcatactttaaagtcgttatttttttttaattctgagcttaaatagttgcaaaagatgtcagttccagcatctgttaagataaaatattatatcactcttttaaatgtattctgtggaacttaaagtccataataatttcgtactcaccttcattggttttaaaaatatacgaaacagttcccctttaagtttggaaatatacatcatttctaaaaattacttattttcatttcatttatttcacaaaatttttgtttgagatggagtctcgcactgtcaccctggctggagtgcaatggcgtgatctcggttcactgcaacctctgcctcctgggttcaagcgattctcctgcctcagcctcccgagtagcagagattacaggtgcatgccaccacgcctggctaattttttttttttttttgtatttttagtaaagacggggtttcactatattggccaggctggtctcaaactcctgatcttgtgatctgcccgccttggcctcccaaagtgctgggattacaggtgtgagccactgcacccggccatttcacaaagttctatcctagtgttgtgtgttattatacttcccgatactttattgattactctatcatactctttgcaacaaaattatgtctacaaataggtattttaaaatgtgtcatatttcctgtttcataaagttctaagtttgaaaaatttctcttgggtggaattatcattaacattattattttaataacttaagaaataattgtatagatattattaaacataaattttatcaagagcacatttctgaatgaaatgaagtataaaaacttctatgagtttaattttaaacagtatattgcttaaaaagccaaccattgtgatggcttacatattattttttgttattggaagataaaaaatatcactcattttataaaccgaagtaagatgaggattagactgtaattgaattaaacatttcataatatgatattaaatattgcatagtgaaattgatataaatcatataaggtctgtgtgagtgttttactcagtgtctatgaaaaaattcagcatccctggaggacatcctcctccgtttgacagaaaaaatagagaatcatacccatgttttctttcttgttcttgatttaccaatagacatcaatgcaacctcaaggatctctctctttctcacacctgctacctatgtgtgtatgccatttgcatatacatgtataaccccatatatacgatacatatctatatattccagccatttgacaagatgctttatacaactcctagaactacattagttagttgttctaaattatttttatcccttaagatattttatattacctgtttactttccttgtatgtcattaaccaaagggaacccagtgctcaacctaaatggccagaataatatgattttagacaacaagatgactagtttagaacatatattttttcttagtttgctctgtttgtataaggactttcgatttgtatatgcttttctttttccaatgaaggtgaaatataaagaagaatatgagaaaaataagggaaagccaatgcttgaatttgttgagacaccatcatatcaagcttcaaaggaggctcaaaagatgcaaagtgaagtaggtcaattagtttgttactaattgtttaatgtaaatttgatgttttgtcatttgaaaggacgcagaatgttcagtgggtctggaaggaagagtgctgctgtgggcagattcaaggacctgctttctagacccagccacccactgcctgggatcttgtctaggtcattgagtttatctggtccttagcttctctcattggtgaattggatctcaagctagatgagcttttaaaatccccctcagttctaattttctatgataatataactgacactttcaaatgttaattttaccttttgcctttcagatattaatgtaaaactatgatgagttcataaaaactaaaaacgaatagctggttgctttatttacctggccccctttttttttcaatgaaaatagaactaacatttttaaaatacttactacatgctaggtaatatgctaagagtcttatatatgtcagctcatttagtcctcaaagtaatgatgctaggaaggtgttctctgtagattaagaatgtgtctactgaaattgtcttagatgaaattctgtatccagtaaatgttaatgttttagcacctggtcaaaatcatgaatgatttccttttctctttagtttatattttagtccattttgtgttgctataacagaataccacagacggggcaatttataaagaacagagattaatttctttcagttctggaggctggaagttcaaaatccaaggattcacatctgccaagggtcttcttgctgaatcatcccatggcagaaggtggaaagacagagagtgcttgcacatgccttagaggaggagatgggaaactcatccttttatcaggaacccaaccccatggtaacaaaaccattcccatgatattggcatcaatccattcatgaggcagagcgctatggcctgatcacctcttagagttcccaccccccaacagtgttgcgttggggatgaagttttcaacacacgaactttgaagggacacattcaaagcataggcggcgtatttgattgattttttttcaataaacaattaagagtgttttctacttacctactttattctcaacctaagattatgctaagtaacatctcgatattccccacactttttttttctctgttccagcgagacttatttgtgtgtgtatgtgtgtgtgttttccttcttaccttttcaggatcagacacacaaggttttgtctgcagcctatatcaaagttttgtgggtgcagctgggttcttaatgcaaagggatagaaatagtggatgctggtctcagtccaatacaaccttgatgcttcatgctaggcatgctcaatgaataagatcctttctgttgcccaataacaacatcaaaacaggcagaaatgataacttgtagacaaaaaaactctcaggaattttgtaagcattaactatgctatttgttgaaatgttataattcatattcttgggaaaaaggcactcagatattactatggtttactgaatagacaaaattgtttaatttcttcttcaagcaaaaaggaaaaagaattacttgtattttttgtgtcttattcagtggtctccaatctttttggcaccagggatgggtttcatggaagacaatttttccatggactggcgagtggtggtggtgttggaggggatggttttaggatgaaactcttccatctcagatcatcaggctttagttagattctcataaggagtgcacagcctagatcccttgcatgcacagttcataatagggtttgtgcttctatgagaatctaatgccaccgctgatctgacaggaggcagagctcaggcaggaatgctccctcacccttgctcacctcctgctttgttaccgggttgctaactggccatggttgatattggtccatggtctaaggattggagactcctgtcttgtatcttcttaagccaatgaagaggaatctgataaagaaatatgaagtaaccattttgattaaattagttatttgtttcaagtgaattgatactagtgaatttggtcaaagttcagaaaccctacaaaaatttacatttaatggaataaatttccctagattaccttttcttcctttagataacagtttgtaaacactgtataaagtatataaagtattttatacattcttttcattgctttactatcttccactgcagcagcacttttttctgcagcagcactttttggatggagtagagccacccaatgaatgtccctgttttgtagagataatgtggccattgtcactgacccacagcccagagaaaggtttctgttttcaggagctatcatagtgcttttgcttagtgggtcttctgaaaggttaacccatttcccatttagaaaaaaaatgtgcagtttgctgccagcactcatttaattttacataaacatgctctttggggctgaagcaaatcggacctgattttcaacgtgaaaataaaatataaaaactgttcttggagttatttctaaacagaccttgtctctaattctaatggaacagacaggtttataatgttacgttaggattagagacaagaatattcttgaggcaaaacggaaatgggttaagacagtatgaagctgttaacatacattttcactgaaagagacagggatcaaaaatcactttccttttctgagaacatttctggcagcatcagtatttcaggctggacctccttctagtttcctcccctgcccctttccctttaccccctcccctcttctttgatcctcagccctagaaacattcatgctgagcaaccttttatcattctggttgcacagtttcttaactttcttatttccttctgtggataactttcctttcactgataaatccagaaacttataattcatgattaatatattcaaatactatgtttctgtagtagaaataacagtaatttatgatttgggattttagatagtctctcttttcttcacccaacttcttctctcactcttgccaagtgagacatgttttccctgacatatattccctttaattatagtcattgactattagatgttttaggctcaaccatcatttcttgaggagagtgaaatctttcagtagaaagtatctttggacccaattcatatgctaaaggccagaaaaataaagtagctaaaagtcttagacaaagtttggtgtaaaaaatatttttaaatataggactgatgaagtaggtataaagagaatcatttgtcttagagatgtttttttattcccaagaggtaggtttgactatgagttcctcaaggaacctcttacaggtaaacttaagtatttatgatcccaagaaaagccactggtgtctttgctatggcctataattaagtttatcatactttcttccaatggcagatataggcttaatgtgtgtgttttctggaggaaatctttaaatttggcttgaaaagttctttgtcttatttcacaaatactgctttcttcaaaaagcatacccaaaaggtttttttttttctagctatatattttggctacttctagtcgtaattaacctcccttaatgacttacttcagtaaaataacttttttttccagaagggctttttgaagtgaattagctgatgtaaatgcatgcgtgaatgcatagacatatttctatttcaccatttaaagagtcctttttagcctagagatgccctagattcagccttgtaactgttatctctactaattccacataaggaagaggaaagtttctagtcgttgtttttggtcattgtatctcagttctttagttcaggatgttctcaatgcaactggttatttaactttgttagactttcagaacatcctttgtttctctccttgtggctatatccacgttgtttgttagattgctgtatggaacacatgtgctaagtgaggagacagcatgcttctcttattctccttcatggtttagagacattctttatttataaaattacctatctctataatgaataaataatcaacctggaaacagcttctctttttgcctgaataacaatttcatgcagaatttatttacttttatcatttcagggatgcaatttgaacaaaatatttggctggtaaaatctgggcccttgtttagtagatatttcacatggatggatatttttgttatttagagaggctgtctttatagtcataaagcatgcattatcactgatttttcaaatgtgtagttcaaatgttagaatttagagagtcatagccaaagagtggctcagtgttttaaaaaggctaatggtggtctgaatctaagcccccagctatcaccgtcgcatccacctttcatttcttgttgtgaactctcacttaaaggaggagttcagttataaggttcaagataaaattctcctcacagcacaacttcattcatatcaaacaccatagatggtagagaaatattctcaactccaaaatcattaaagggaaaccccctccctaaccctcaggcatcattacattttagaagtgatatttcctaaatttgcaaaagtctgatgaagaaggatgatggggacatgaacattaatgctgcttgggtttgaaggtggtttgaatggcttccgtgccaccagattttcccccagtcagtggatccactcaccttggagtaaaccaattgggggatccagtcaaatagccagtcttgttggttctcctccaaaaaatgggctgatattaatcctaggctagtaagatgttaggaagcctcacttagaatgatttaccagaggaagagtccacttaataattctcctttgtttggtagaattctaaaatttatgacaaagttgaacttatttccctgttgataggatgaccctcaggtggtagaactacctaagaaaacatcatttttgttctgggaactcttgttcaaatctcttttcaatggtcactgatatttgctaactttaaaattatgtggtcttatttaacagaaagtttacaaagaggattttgagaaggagattaaaggaaggtcatcactggatttagacaagactccagaatttttacatgtaaagtacatcaccaaccttctgagggaggtacgatcttggtgtttattattaaatattatgaagaaaagtaaagaaaaaacccaggaaatgtttacctaattctctactaattcagtgtttcagatattaaggcattactcttttttttcactttgatcttcactaataaagtgttgcattttcattagaaacaagaaagtgtgtgttaacatttcccattaaagttgcgagaagaaattacccagatttcctgggaaaacttgaaaaacagcctagttttttgttttagttgtagctcagaagctctataaatagttttatagctttatagcagtttttaaaaaaatgttttgaatatgggtggagagagcttgattctttcaaatttagttattataaaaacattttagaaccaacttttcctgtcgctttcctgcagcaaatgtctctaaaggaaggaggaaaaagaccagagttctctccctttcttgacatttgatatcagaaataagatgctcacatgtgaaggtctggataaatgctacattacttataagtagtttgtgttctaagtagggaaaaataatatatttaacatatagaatagaggaactcatgtccacttttcattttattctctgcaaaaatttccccaaaaacataatggtgcactttttgctcacaagtaatatattaaattttcttaatattaagaccttaaaactaaaaatatcatgtctatagtccacctttaaaagcttttttttttttatgttttttaaatggtcaaaaagtagctcatagcttttccaaatctgcttatatactctttatattaagggaaagtgttccctaagtataaatgtagtatatcatgtaatatttgtatatatatcttatacacaatataatatatattttatgatatataaacggaatgtatattacatacatacatatgaaatttcatttcattttgaatttttgaactgaggaaactattcctgaaggaaatctcttagaccagtgaaataaatttgagattaattgcctataggagcacatcatcatgaacttctttaataagcaaatgctaactggtcataccgtttaactggttttagaaatttaatgtgattcagtgttgtaatatgtaatgtgctgaaatagacatgtaatttctataagagttctcttgctgcactatcttttctcacttctagttcctagtaaaaatttttgaagttgaaggctaagcaaatggcaacttcctagagagtagagctgtgggtattagaggctaggacacagtggcaggaggagaggatggggagaggttggttaatcgatacaaaggaatgagctctggtgttctgcagcaccgtaaggtgaatatggttaactataattgattggatgtttttaataagctagaagagaggattttgagtgttcacaacacaaagaaatgatacatgtttgaggtgatggatatgctaattaccctgatgggatcataatatgttgtgtacacatattaaaatatcactctgtatcccataaatatgtacaattatgtgtcaactaaaaataaaaggaaaaaagagaaatagttggccataaggctttttggaagaaaaatgtttaataattatttttaaaacaatttcaaataatggcaacttcctactactgttgtcttccatttaaaaatacactatttatgttaattttttaaaggagaatctttttttaatcacttatatacaaatggcaatgtgaagtctattttgagattcataaatgactttactatgtgccattgcctttttcttttattcctgttttggagtgagtcttaatttattaattcagaatacatgcatcagggtaggaaagggctcagaacactgtattgtattggtctgttctggctgctataacaaaataccacagactaagtggcttaaccaacagacttttctcaaagttctggagactgggaagtccaagatcaaggtgctggcagatttgattcttagcgagggccctcttaccggcttgcagacacctttgtactgtgacttcagtagagggatagaactgtggtgcttttcctccttcctttagagatattaatcttatcaagggagtcccactctcacaatcccatctaaccctaatcacctcccaaaggtcccaccttcaagtacggtcacaatgggggctagggcttcaacatacgggttttggtgggacagaaacatttagttcataacgactatgatgccaggtgaaataagccaggcactgaaagacaaatcctgcatattctcacttttatgtggaatctaaaatacttgaactcctagaagcagaaagtagaatggtggttacagaggctggagggtgggaggaatggcaaggtgatagtcaaagagttcaaaatctctaaacgggaggaatactttttttgagatctagtgcacagtgtggtgaagatagtatatagtgcacttcaaaattgctaagagtaaatttcaaatgttctcgccacgaaaaagtaaatatttgaggtaatggatatattatttagattgatttaattattccacattgtattcataaattatggcaattctgtaccccataaatatatgcaaccataaattgtcaacttccaataagaattttttaaaaattaacttaaaaaatagttatagcttgtctaatttgaaaaagaggacttttggtgacttaattaaattattacttccctttgtaagtgtaagcatttagcttcaaatgaactttgcattttttactttgtggtttttacattgacattgcattagagtgttcaaagtatcattttatacttcatttcctatgatccccccattgccctttgacattactagaacaagtatttttattttcatttcaccaaggtggaaatcaaggttgagttacttaaaagtactcccgaaggtcacaccacgaaataaatgaaagaggtctgactttcactcgggtcatttgactcagatcattccaaaattataaaacagtccattccaatgtctagtaagctattagttgagcagaggacaggctaatttaattataatggatgaagggaaagtaacatgaaatgaaccctagaattaactggaacctgatttcttatcaataaaggaaatttcatctttcatctggcaagttaatcataaatgcaacttagttgaataggaataagatatttatgattttcatacgcaattaagtaagaaaacaagcaactcattagcagagaaaaataagttgtatgtaagtattcatagaaggcatttggatctacttaaaatatgacattcaaatgggtgaaattcaaactattattaatgtgtagaaaatgttttggttttccaattctttaaattgcatggagacagccttccaaaagcaaagccaatagagaaaacagaaccaagagatgaagaaagagagacatcatgtgaattccaactggacaataactcaatctttggattttctattccatgagtgattgcatctcctttttggtctaccctagtttgagttgggtttctgtcatttgcaacctaggagtcaccatcaccatcatcatcgctatcatcatcatcatcatcgtgagccatagattccatcatctatgcacatttcattatctatggatgattccattcatcatcatgaatgttgagccatagattccatcagagatagtaaagggggccttgaaatattctgaggcttgtaaaagggtaaagtaaatacctaaagtaattgtgatggatagtgcttgaagtatctgctttcaagtaccatctatcaggctgtggtgagcccaagtaattgaaactcctaatagcttactagacattggaatgggctgcttataattttggaatgacctgagtcaaatgaaagtggtttctgctcactttttaaactttaaaaaaaacctttggctacatcactccttttgattttgtaattttccattcttttgcaaccatgttcttttttggtaatgcatgttttatagaactttcaaaaatagttttaacaattaataaggaacacgtgttcttaagatcttcctcaccattgaaagagaagatgtctttaaaaaaaatccactatggtaccaaaacatattgacagaaagtatgaaaaggaaaaggctgaaaatattggaagccactctgaacttggtagaggggaaaatgaagtgtctgtaggaaaaaagcatgaatacttagctgtgtgattcattccttcctagtaatattttctcatttctgtgatctctagaaaacatgtagaatagcacactgaataaagtgattcctgctaagttttgaactgtgatattcttgtctcatagaaagaatataaaaaagatttggaaaatgagataaaagggaaaggaatggaacttaattcagaagttcttgatatccaaagagcaaagcgagcctctgaaatggcaagtgaggtgagtatgtttatttaacaccttagatgaatatgtttttagctgactttcttatttgtcaatctttctcaaaggttctatacatctataacttttatatgtaagtgattgtaaacagctatatccttgtagtcttttcttggactattaattttttttaaaatcccctttctatgtgatgtgaaaaaaatggccgtttccccactttggagaaaatccatataataaacgaaaatagtttaatgagatttaacttcatcttttaagcaggtaaaaggcagatgattgggaaggtatgttattatggtccatcagtaactgcaggtagaaagttcacatgctttgccactcataacccaactgactctcccagtcttgccctgggctgctgtttgaaccttattcagcctctttatcaaatgaaagtggtttctgctcacttttcatgcactttataaggagaactgaaatgtctctgaagtgttttcagtcctgtaatccttgtattatgtcattactttgggtcatatggtgtcactgtgcttttaagagactttggctgaatttagcagtgaaagagcttaaagccttgtccccatattttgaaactctgatgataatgatgatgatgatagcgatgacgatggtgatggtgactcttaggttacaaatgacagaaacccaactcaaactagggtaggcatcaaaggagatgtcttcactcatggaatagaaaatccgaagattgagttactgtcaaggtagaattcagatgatgtctctcttcctccatctcttggttctgttatcttcactattggctttgcttctggaaggctgtctccatgcaatgaacccacttaataaaaggataactcatatctatggccagtaatcccaatgggaagtgaacatccctttttatagttccaatcaaagtcttaggtttgaatctccttggattaatctctatcctgtgcttacacctggcataatcattgtgtctgggattgggggagtagaatgtgctgattatcctctcatggtcacccatttgttgaggtagtttaacagtgtcttatagaaaacattctaaatttttatgtgtttaaaacatgaccttaatctcagctatattcacattctttaaataaaggaaacatttaaaaggcactttagtagaattaaaaatatatgtggggactagggaggtgatggaaatcaatccttcccaagggtatggattgagagaacttagaggtcatttcccaaaaggaaatcatggagctttttgccagaaggaggaggaatggatgctggtcagccataaacaacacgtgcccctggtgaggtctgtggctaacattgtcatcacattaaccctacattagtcattttctgcaaattcttctgttgccgtgacatgtccaatccacatgcagagattgtcttgtaattacttgtcagtagcatgtgtaaaagttgttttattctctcaatggcaaagtacagacagatgcagttgaatggcaggatggcggcaggagcagcattaattaggccttattaggagaaggaagaaccggcctaggagaataagattgaaaaactggaagaaggtgtcaggtgttgatcatctcctctgtgctatgcactgtcattgatcctcacaatggatcctacatggaggtacagacacactgtggagatactatgggttcggttccagaccactctaataaagcaaatatcacaataaagtgattcgcatgaactttttggtttctccatacatatacatgttatgtttataccatactgtagtctaagaagtatgcaataggcttatgttcaaaatacatccatatcttaatttaaagtactttatttataatagtgctaatgatcatctgatccttcagcaagtggtaatcttttcactggcggagggtcttgtctctatattgatggctgccgactgatcaggatggtggctgctgaaggttgggttgactgtggccattccttaaaataagatgacaatgaagtttgccacattaattgcctcttcctctcatgaaagatttctctgtagcatgtgatgttgttgatatattttacccacagtagaactttcaagattagagaccaacctctcaaacccattgctgctttaatgacaaagtttttgtagtatcctaaatcttttgttgttatttcaataatgatcacagcatcttcacaaggatttgatcttcagaaaccacattctttgcttgtccattggaagcaactccttatccattcaagtttgattatgagatggcagcagttcagtcacattttcaagttccacttctaattctagttctcttgctatttccactgcatctgcagttgcttcctccactgaagtcttgaacccctcaaagtcatccatgagagttgaaatcaacttcttccaaacttctattaatgttgatattttgtacttctctcatgaatcactaatcttcttaatggcatgtagagtggtgaatctttttcagaaggttttcaatttactttgcccagattcatcagaggaatcaccatctatgacaggtatagccctatgaaatgtatttcttaaataataagccttgaaagtaaaaattttccttgatccatgggctgcagaatggatgttgagtagcaggctcgaaaacatgaatatccttatacatttctatcagaactgtttggtgaccaggtgcattgtaactgaacattaatattttcaaggagtctttcttttatgaacattaggttttggcagtgggcttcaaatattcagtaaaccatactttaaacaaatgtgctgtcatccaggctttgttattccatttataaagcataggcagagtagatttagcataattcttaaagaccctaggatttccagaatggtaaatgagcattggctgcaacttaaagtcagcagctgtgttagaccctaataagagtcagcttgtcctttgaagaattgaagcagacattgacttctcctcactagctatggaagtcctagatggcatctttttccaatagaaggctggtttgtctgcatcaaaaatctgttgtttagtgtagctaccttcattaattatcttagctagatcttctgggtgacttgctgtggcttctccatcagcacttgctgcttcaccttgcactttcatatgatggagatggcttctttccttaaacctcatgaaccaacctctgctagtttccaacttttcttgtgcagcttcttcacctctctcagccttcacagaaatgaggagggttagggccttgttctggattaggtttggtttaaggggatgttgtgtctggaatgttttgtctggtttgacctattcagaccactaaaactttctctatatcagcaatagggttgtttcacattcttataattcatgtgttcactggggtagcactgttaatttccttcaagaacttttccttggcattcacaactcgaataactgtttggcacaagagtcctagctttgggcctgtgttggcttttgacatcctttcctcactaagctcagtcatttctagcttttgacttaaagcacgtctcttctgtttacttgaccatctaggggccattgtagggttactaatcggcccaatttcaatattgttttgacttagggaatagggaagcccaaagagagggaaagagatagaggaacggctgatcagtggagcagccagaacacacacaacatttctcgattaagttcactgacttataggggtgcatttggtggcatctcccaacaattacaatagtgttgcaggacttcttcttggttcagctaaagacagggtccttgtcccatggccatgaaaatttaggcttgcagagagtttgaagggtgagtaaagcagagttttattgggtgtaaaggaagaaaagggggaaacagggactctctgcaaggccagagtccctgctagagtgcttcccacctcacagtttgaatcccaggttccacacaggaataggagaggccaggctcctccctcttgcaaactgccggaacttctgtggctccaccccagcgcatgctcttcccagtgcacaggccagttggagttttgccagtgaccccctcctatctgtctgtctcaatagtaacatcaaagatcactgattggccagatgcggtggctcacacctgtaatcccagcattttgggaggccgaggtgggtggatcacctgaggtcaggagttcgtgaccggcctggccaacgtggtgaaacctggtctctactaaaaatacaaaaattagctggatgtggtggcgcatgcctgtagtcccagctattcgggaggctgaggctggagaatcgcttgaacccaggaggcacaagttgcagtgagccgagatcacgccactgcactccagcctgcgcgagagagcaagactctgtcaaaacaaaaaaatcactgatcacaaagcaccataacagtttgaaatattgtattaccaaaatgtgacaccgagacaccatgtaagcacatactgttggaaaaatagcaccgataggcttgcttgacaagcagagttgccacaaaccttcagtttgtaaaaaaaaatgcaatatctacaaagcacaataaaaatgaggtatgcttgcattactaccttcattttgcagatgagtaaactggaaaggttaagaattctcagtgtcatacagctggtgaatgctctggcttctaagttcatctgttttgtacaacagcagctcatttacacccacctccctatcctccagccccaaagaaaattgtcagtgaagattttcacatggcaattgcctttgtatactaaacatttttggagctttgcatgcccttcttcagtgagaatgagattatcattctaagcagttcagaagttagttgtgagtgatcattcatagtactcaaggagctttgttacctcttttgtaaaatatgtctaactattttttttttagtatcattgactgcagatgcatgtttgcccactgagtgtttgaatgttgtaaaatgttgtcttttgcagaaagaatacaagaaagacctggagtcaataattaaagggaaaggaatgcaagctggcactgacacccttgaaatgcagcatgccaagaaggctgcagagatagcgagtgaggttagtagggtgcgtgatgcaggccttaagactcatattttggaacctaacaaatcgtattagcaacttgattactatatggaatttctcaaagcattgcagctggtttaacagtttggaatggagactattccgaagcattatgccagtttgaaaaattacagtttttgctttgctcatatccttccaatatatcaagaaagcttggtggaaggcattttaattgaacagacacacatgcacacatgcactcccctgcacaccttatttcagaatacaacagatttaatggtaatactaggctatgataaatgttttcatggtattttttaatggatcatgtgctgcttggcatatctgtatttccaaatttctgagcagaacttcatatatggacactttacatgagaacaatagtcattcctgtctgattgcatgttcttaaaatagcctttgttgacatgatcagcacgcatgaaatttctacacagtcagcattttggatggaggtctgatataacctgaacgaccatgttcattcatctgataacaccagttttttcttcatgggatacaggatattgatttagaagttttgtcttaaattctgtgacaggctgggtatcacatcacaaggttgtaggagtcagaccatatgcatatttttcaaaggaaataccctagaactttctctacacctcttgaacttccccagaaaatctgagaatataaaaggatcactggagtaaagaagctttgggatgtgatgattttataaaaagtgtatgtgaagaaaaaatcggggtgcaggtgaaggggtcctgttcacttatctcaaggttggttaggtgggggcttcagtggagtatcctgagacctgttgtgtgatctttgcacttaggaagagctgactcaggactgacaccttacaggaaatctggaaggccagaggtagctgcttagctgctagggaagttactgttgttttgaaaatgactgacatccccagagttaggcactggccagggaaatgggattgccatgattgaataagacaaaggaagtggagatggtataggtttcctgatcaataagtgttccattttgaagtggtggccaggggtggacggccaggagcatgaggaacttgaaaacctgctttatccctttcctacttctgttctcgtcctgagagatagtcattgttataagtttgttatggaaccttccaaatctattttgtgtttatatagataaacatacacatgtacacacagcgacttaaaaaaatcttaaatggggtcagaccccatttaagtggttgattgttttctcactttatattaaggatttttttccatgttccttcatataggtctacctcattcttatagaaaaattaagtgttctgtaacatggatgtgaatatgtgaccatttatcttttgttgtctgcaagggaaatgtataatgggatctcaacgttacaggccaaaactagaatccctaattttcccctaggttagctttccccaatcttcaaatggcgccaaccaaagcatagaagtcactttgattcctgtcatcagcatactttattgatgccacccccatagtggtggtctaaatccatctttcttgccaccctagtcctaagccactatctctatcctctagatcattgccatagcttcctaaccagaattctgctattattgccttcctagtagacattctttttttctttttttttttttttgagacggagtctcgctctgtcgcccaggctggagtgcagtggtgcaatctcggctcactgcaagctctgcctccagggtcctagtagacattcttaacccagcaggagaagaatccttgaggcaattaaatgaaattttgttactctcctcacatgcaattctttaatggtttccagtcacatccagtgtaaattgattcacgtggctctggtgaagtctccactctcaggctgagaatcttagtcaataaaaaccccccaaataataataataaaaatctcatttgcatataatcatagtcatgtcccattttgcctaaatgacaggctcagatcattttcaaccaatgttcgggactttgccatagtttatttttaatatcaaaagtttatttttcaaataaagtcaatggatcttattgtgacacaaatgaccctcaagagtcaagccttcccatatctctgggcttgaccatgtgactttctttagccaatgagacatcagcaaatgtgactcagactataaacacacttctgcattagggtttgccctcttggaatgtagatgccgccatgttgttttaaacctgctaagttttggtgtgttttgttatgcagacaacaaataactgatgcaaagggtgtctaatgtagtctatgtgctttagaacacatttacatttgaaagttcatattaaaaaattgttacatccttttaccatcagaccttggtggctgtctgttatcagtgcctcagtttcatcatatttgttggccttcaaatgaaacatttcattttggggctttgaacaggctgactaaaacagagtgctttttgtagacatagtaataattgaatattaatattttgaaagttaaacataattatgtaaacttttatttagaaaagtgatactgggagtgtaagtcagtaaaaacaggaaggattatgagtggaagataggaggcaaaatactccaagactgagatttttgtttaccacttacctaaatttgaggatctcctaataagcaaatcaacatttactttgcagcagagaatctacaaatctggagtgtgtcagcataataagaaataattgttttaaagcaaatttaattggctatagttaatagttttttttaataacatttttctttgaagaataatatacatatagaaaaagcaaatttatatatgtacagctttctgaattttataatcagttttcaaatgtgacagaagtccctaaagacatgtgtgtctatgtaattatgactatcttgtaagcaattggtaatccatttcccactggcttaaaaaaaaaacagagataacttatttgttgttcttatgattgaatagtagagaaattcctaggcacggcttgatctaggactcaaataatgagatatagtttcagcttgcagttcttaggtagacattcttgtttgcaaagaggcttccagcagctcttatatggaaaaaaagatgcatgcatcccagaaccaattctgcagtgtgggtgatggggtataatgatttattgagtccagcagatcccagagacttgggccagtttctggatggtttaggagtggggaacattgacttgtccagtggcaaatcagagagccagtgaagggaataatgatttatttaagcccagctaagtccagagatttgagccagtctcaccgaagctggatggtttaggagtgggaacattgagttgtctagtggcaaattagggagccaatgaaggggaaaaaaggggtggattccagagaagcaaccaacacttattcactacagagtgaaaaacagcaattttacaatcactcttgactgacacttaactaagccatatatgacccaataatatatcaagtttatcatattgaaatgttaaattttccccttggctagctgtgttttttcttcttcttaattcagattagctgaaaaaaattgttctgattactggtgaataagttatactaagtcgtattcctaccacaagtaaaaactctattattctatagaaataaaagaaataaggattcaacttcattccaaaagacatggtcttaatgtcaaaatgacatctcgatttttgagcagtttctcaaatgattggagagcactaactgtatgtttcattttctgcagaaagactataaaagagatctggagactgaaattaaagggaaagggatgcaggtgagcacagacactcttgatgtccagagagctaagaaagcatccgagatggccagccaggtaagacagcagcaagatacaaagtttaaaataaatgccgtgaatcatagctggaaagagcataagttttctttccacatgggtggctttgagattcaaacatgtaaatttcaacatcgctattaaagcttaagcaaagctctaagattattttctgttcttttagaaacaatacaagaaggacttagaaaatgaaattaaagggaaaggaatgcaagtgagcatggatatcccagatatccttcgagccaagaggacatctgaaatctatagccaggttggtcatgaatgaagatgctcagaatcgtgtattccaatgtcatgttgccatgtgctttgtatgtctctatgaatgatatctttctgagggcattgcattcagagctagtgtactctttcactaagaaaccattggccaaacttgattaaccgtactaattaataggacaacagtcatagattcaatgcaacagacattatggagagctacagcctctctgtcggggctccttgttttgagtccaaggacattaaacctttttttttttttttttttttttaaattttagagatggaggtctcactctttcacccaggctggaatgcagtggcaccatcatagcttgctgcagcctcaaactcctgggctcaagcttatcttcctgcctcagtgggcatgagccattgtgcccagcccaaggatattttaaccttttctttctttctttttttttttttgaccctattggacacttggctcaaatgcttttgctaatactacagaaaaataaattacaaacgttttgtcttttaaccatttcataatgaatattaatattaaaatagttccaaataaagctaacagtggctaaagctgcacaaggtataaagtgaagtttagtgttaggtaaaaattaagggaacagtgaggttttcttggtaaaatttagatttgtcaaatatacttgtcccatattctgtaaacaaagctggatgtgggagaagtagtgaccacaaaaatttatggaagaagaatttatttataaaatctgacttgggcaaaaacattcattagcaaataatatctttgctgtaacatttactaaaaaagaatgactcccaatggaaaaaaatagaaggaatgaaaaaaatgaaaatggttatttaaaattgaccatagcatttaatttgattaatggagtttatgcagaaaggattgtgtaacaacatttggtgaaatttgttaaaattctgattaagacataagcaaggacattaaccatccactagttcaaaagggtagtatcaagatggcagagtcaaatgtcagaggacttgtgtgcctctcagcctccgcagccgacacagccgctgggatgatcctgaagtgtgtgttctgttctcagtgttcgtgaacttggagacattggcttggccatatcagcttaactaaaatcctaagtcaatgcattaaacaacaaatagacatttgagtcagtggagaagagttacttactctctcaagaatgccaaattcattccttcagtaggtaaatacctcctgagcacccatttgcaggcaaaactagacatggctttgctcttggaaagctacagataaatctaataatcatgtaaatatagtattacaaccatgatatatacacctgaaagtaaaagtattgagagtgaaggtgcctgagctgtcagatttcctgcattaactcaacagcatagatttttttttagtgtggtgtgagaatatatctaattttaagggattttaatcactgaaatacaattgggatacttacgagggtgtaatgaagcctggtgcatttcaacatgaatagtagttacctttctttttttttaattttattattattatactttaagtttcagggtacatgtgtacaatgtgcaggttagttacatatgtatacatgtgctatgctggtgcgctgcacccactaactcgtcatctagcattaggtatatctcctaatgctatccctcccccctccccctaccccacaacagtccccagagtgtgatgttccccttcctgtgtccatgtgttctcattgttcaattcccacctatgagtgagaatatgcagtgtttggttttttgttcttgcaatagtttactgagaatgatgatttccaatttcatccatgtccctacaaaggacatgaactcatcattttttatggctgcatagtattccatggtgtatatgtgccacattttcttaagtagtttgccagaataattaacttcactgattttggaatcagagagcctggttttaagttgaggctctgatacttactatctagtacttcagtttctccatctgtaagatggaaataataatagtatctgcttgtcaggttgattaaatgagttagtgtgtgttaagtatttagaacaatacccattacatagtaagtacaatgtaagtgctggtactaggataagatattgcctgggttgtattagagctcatagtagctcatttagtggagagaaaattaagattttaatctcaacttcaaaatactgttaactttcccttaatcaaatctatcttcacatgaagtaggaagcaaagcgtaaatctagaagccatgtcgtatggtagagatcgaagaatggtatcattctatctctgtctctccacctctctctctctctctctgggagtgtaagtcagtaaaaacagttttttactctctctctctcccttcctcctttcctgcctccctccctccctctcacatgtgcgcacacacatagtttcagatttatattaactgtttatgtttttagagaaagtataaagatgaagcagagaagatgctttctaactattctaccatagcagatactcctgaaattcagagaattaagacaactcaacaaaacattagtgcggtgagtagccattacttcttttaagttgccaccttgaaattttgttttgtaagaaatggtcttttttcctcattgtctgatgttttctgctgtcttagttgaattttctgtcaagtgtattatctttatttctttaaaataataagaatactgataatttttacaaattatcatttttcattatttttttggaattacaaattcaaaatttcctcttcggtataaatgacagttattaactaaattttaaaatttaactcaggaaagaagtctgtcttctacacagattttactttgaaggtgaaaatagtcatatgaagtgattttattcctggttattgattgtttttactgataatatgtctaaccatttactcattcttaataaatttctaaacttctatatttttattttgaggaagaggaattgcatcagcacttttttttttaacttttattttaagtttgggggtacctgtgcaggtttttacataggtaaacttgtgtcataggggtttgttgtacgattattttgtcacccaggtgttaagcctagtacccattagttattttttctgatcctctccctcccctccttcttcaccctctgataggcccctgtgtgtgttgttcgcctctgtgtgtccatgtgttctcatcatttagctcccacttataagtgagaaaatgcggtatttggttttctgttcctgcattagtttgctaagtataatggcatctagctccatccatgtccctgcaaaggccatgatctcattcttttttatgactgcatggtattctgtggtgtatatgtaccacattttctttatccagtctatcattgatgggcattcaggttgattccatgtctttcctattgtaaatagtgcatcagcactattaattaagaggctgagtccattaataaatgtataaacttgacttctgttctaaaattgtaaaaattgaccatacaactaatattttaacatagaattagctcagtcattaatagttaaggaagcatctcatcaaaatataaattctagtaagtgtgaggacttctggaatatttcctacctcctaattagttggcaagcgccagctctcagagtaagctggtcagatgtctgctgggtctccacagggatggccaggctgtactgagaaatgggaaagtcttgatggaaggatgaggaaaagaggctgtgtgattctatagtgttctgtagttctagcctttggaggaaaacatctctcctaccgtgctctcccacccacgcgggggccactggattaccaaatgtcaagaaagggagtaattctatcctcatttacctttcttataattactctgtttttctgcagagtactcataacgagggcactcataaatactcttgtgtttttgttctgctttgggtttggaagggtagacgttagtaggggtggagacacatgggagagggttaacaaataagtggaagatgaagaagatagacttgaaattaacattgatattgatgatgagctaacattttcttggaagagaatgtgggcatccttgtgtttggagcatagaagttgcctaaaatgtcattttctttttgaattcagtgataacggcttaatgggcttttgtaatatctgctttttctcaaatacacatgggacatatatttatatttgaagaaaggaactctggtttgccaatgtgtattcttaaagcaaataatctgcagtcagccatggtagtggtctagacctagagcaggagagggttatttgtgagattatgggatataaaaccaaagttttcatggattatctgaatggattatttaatttgttcctataattccggcactcataaatagatgcagtattcatattattataaaacctgagaaattgtctttctaagaagcggatctaggacttgaattctgacaagcttagttattcttttccttttcttataataaaggtattttataagaaagaagtgggagctggcactgcagtgaaagatagcccagagatcgaacgagtgaagaaaaatcagcagaatattagttcagtaagttctctacagcattaattatcttttctaaaagcaaaccaaaactatagacaaatgtttttagttctttactcaactgatggcttttttccttttattcttcactttattgaaatgctatttcatcatatatcaaagatctaactttcagaacaaaaactgtatccttgttccccttgactctgaagcagtgtttcattttgatatatcacaatgaagaagagctaggtcattttaatgaaacctagggttagatttcatctctttgaagagaattttaactctattaaattttgcagagaaaggatacatttcagtacctctccacaagttggaagaaagaaatttttccctgatacaatgattaaaggccccagaacatttatttggcagcttaagtgaaggattagatttgaaaaggcaaatagtaccagttcatttttaaccgatgtcagtcacatctctaagctttttatcagacacgcttctgcccatttcttctttccagcctgttttaccttctgcttcttccagcagaaacgaaaacaaatcacacatcttcactataaattgtgaaataacttagcttccagtaacctttagactggggggaggggtcctcttctgttggaagggtccttctaacattaaggtgcttaatattacggataaattgttttttccattgagtgtttgacatttgctgtggataattgctctccttaccaatttgatattctcccatgtatatttagtacattgagtttcttttttttttttgagacagagtcttgctttgttgcctaggctggagtgcagtggcgtaatctcagctcaccgcaactgcctcccagattcaagtgattcttctgtctcagcctcccgagtagctgggattacaggcacacaccaccacacctggccatttatttttattgtttttatttttagtagagatggggtttcaccatgtcggccaggctggtctcaaacacctgacctcaagtgatcctcccgcttcagcctcccaaagtgctgggattacaggcataagctactgtgcctttccgttacatttagtttcttgaggaagtaaaaaggattcgttctttaaatcccttactctgacttatcttttcaccttatccttggaaagagcaccttccctttaagtaatccaagcagaattgccttgattagactcatctgtgggtcacttggtcattatgcagcatccagagaatatcagtgtgggtcagcgtttgtgaagaaagtgtaggagaggtaagagaatgcaatagtaaagtatacttcaaaataaaagcataaaaagtctacagaatatgagtgcaataaaacctctgtagcaccatggagctgtctcttgaataaagtgtaaggaggacctaggcttaaggtgtggatgagagtggatgaatgtgttcttctgatctttcatggtgagagcctgtgttagcctggtagatgaattaggttgggagagaagtataaaatattcattgcttctctttccaatgataatatttaaaatgcacccatcgatgtactgtggtttaatattataaatattctgtagtgtgcaattctatagactacagtgaaataactgtgccattttgattagagtccctttgaaaaacaaaagtgttcatctttaatcatgttaagcttcttacctgaggaaaatcccagagtattacagtatatcatttcttctcttagcatcccacagcctcttctagcaaacaataaatgcatagttctgtatctgcatgaggttgggccataaactcctgcttagtattcaaatggaaagttgcccttttaagattagctagatctgtcaaaccaagatatgattctctaacatttaaagatctcgacattttccacctccagagtacaagccttttagctgttagctctctgtcttaagaactatttttgaattttatttagaggtagcctgtctcagtgaacttccaatttaactgttttgggtctggactaatattggcattgttacttacatgaaatccacagatactaagacatagatgatatctgagatatttaggtactgtttctttatgacagtctgcatggttttcacccttaatcattttaaacattaccaggtgatttctgaaacatgtttcatgtagatttagatatttactaaatttcaacacggcctcttaagttgagcctatgctttcatatacttacatatatatgtatccttttcattcaaggaagattgaatttgaattatcttccatgaattttagacatattaaaataccacctgaattgatagtatcactaatcattttatgagttcaaagaactctttcttgtcccgtgcataactgtatgcttgtattaccatttgcctgattgatcttcctctaaatatatgtgatgggggagattttgagtgaagtagaagccaggataaaggtgagcttttcctaatgtgattgtgtggatagcagacatctctgacttcctggcgctgaccttccttatactgatgcaggacccagtggtctatgcttttagtacatttccttccatctccctttttctcttcttttattgtgctcactttatttttttccttattctataaggaattccttatttccttatttatttccttattatttatgtgctctcagtcagacaagcagtgctccccagactctgtggctaaatcaatttgacttttgcctttaaatacttgttaaattttaattaccatattaatagaaactgatttttggatagaaaataatcattttatttacgataatgtacaaggtttttttcctgcatctgcctaatgataaaatttatttttataagcaacatttgcttattttacttaaaaaactcctatagtgatgaataagtgaatagatacggatttatttgtaccttaggaataaggaatcctgaaagcatcatataaaattaagaattatgtccccagtgaaggaaaagtaatgttggaattaataaaattcaattatgcaatagttacaattgaagaattctcaatattttaaagccttgcatagaataaagttaacgttatattcttataaattatgcaggtgaaatacaaagaagagattaaacatgcaacagccatttctgatcctccagaactaaagagagttaaagaaaaccagaagaacatcagcaatgtgatcatatttcttaagtattttttaaaaattttattgtatatcaacacgtaatgacagcataaaacctgtacaggtcaaatgccatcacaatgaacctcattgcgagaggatcggttccttaaaagtggagctagcattttacacatctgtatgccctccatgacacctagcctaatgccttgtgtcagcatttatttattaaagacacatattattcagacatacagagtggaatcatagacattggagactccaaaaggtaggagggtgagagcaggatgagaggtgaaatattgttgggtacaatgtacactatctagggtaatggttacactaaaagcccagacatcgccactatgcaatatgtctatgtaacacaactgttcttgtacctttgaatctataataattaaaaaggaatgaaacctattttcagaaacatatattgatattttcttttttgttttgtcatttattttgttttgtagacatatatacgtatctatagtctctatatatctatatatctatagtctctatatatctatatatagcctatattagatagtctgtatatctctatatagtctatattagtttatatatagtctatattagatagtctgtatatatctctatatagtctttctatatctagttagactactacctatctatatagacatatggactatctatatattagtctacaaagcaaaacaaatcacaaaaaagaacattttctatttcttttatctatacctatttctgaaaataggtatagatatctatgaatatatatatttatgaaaataggtatagatatctatctatagatagacctatagatagatagatagataacatatatatatattagtctacaaaacaaaacaagtgacaaaactaaacatgaaatgtgttattgaatgtcttctctgttcttgttcttgggggattttaaagatgagaggtatgccctgagattaggggtcgtgggcatcctcaaggtttgtaggagaaacagagataggagtatatagctatgttcactgtttaagttccattacaataactgttatttgttgggtgcttactatgcattttgggtactttacattgcaatatctcatttaatcataagtaataatgcctcttgcaaagtgctgtgcaaacgcagaaggacggctatgcagtggcagagacaaagagccttggggaaggggtaacgttggagttagatcttgaaaaggtaataaaggtttagagctgagttttgtgaggaaaggcattcctggcagagcaaaccaaatatgttcaagatccaaggcttgttccaggattcaagaagagggtttagtgtgatgagtacttggggtgaaagatggcaggagcgtatgctggagagggaagttgagatacagatcacaaaaaggtagtatggattcccacagtgtctctaaagtgtggttcatataccattatggcattccggtagatattatgtggcttactgacaatcttaatgtttaagagcagttgacttcgtgattaaattgttctaatgtttaccttcttccaaaagaagggtgactagttttcaattgatggtagaaatataacaatctcttagaaataactttatttgaaaataaacagtgaattaatttaatgaaaaagtataacattgtaggtgttatttgtagtatttatctggtatgacatagagaaaggggcatgcaaatggcagaaatttgggaaatttggataacactcaagtggtggaaaagaacatgaaccctggatcctggactgttggatgatttgatcctaactccagatcttacttgttgtataattgttgtaagccattcacctcttgaaacctaaatttcctctatataaagcaaggataagagtattgaagagatattgcttgtgaagcacacagcatgtttgtgaagggatgaatacaagatgtgaagattctatcaaacttatgcacccaaacttacatccactagaaattggcagtaagagtttctctttgtcaataatgtgaatttactattcagatgtaacccctttgagctttagccagagtgatttctttcaagcttgatacagattaaactgaaacattcctccctttagctcaatcacccggtcacaagaatctgcgtaacatctcaaactacataccatggcacacagaaagttacatatcgaggaaagaggccagaggaaccttaccccttttcatttattttttaaacttattcaacttcccttcactctcatgttcactactaagagtatgcatcttaagtctatttctttttcttttctttctttcttttttatttttgttttgttttttgagatagagtcttactctgtcacccaggctggagtgcagtggcgtgatctcagttcactgcaacctctacctcctgggttcaagcaattctcctgcctcagcctcctgagtagctgggattacagatgcaaaccaccatgcctggctcattttgtatatttagtagagatgaggtttcaccatgttggtcaggctggtctcgaactcatgacctcagttgatccacctgcctcggccttccaaactgttaggattacaggcgtgagccaccaaacccgacctcaagtctgtttcatcagcaggccctgcaggtcttgtggggatttcttgtaaaagaaaattccctaacctgagctttaaagtctaaaaagacactaaaactgtccctgtgaagtttcttctaatgagatcttaacctccagctctacttttgtctgccaaaagttcatttgccattctgattttctctattgatgctcatttattttgggaggtgttgtggaattgttgggaaagatgaccacaaacaatggagttagatccccagctaagaaaaacacctctgtgcattaagtcaggaaaatttctataatgctaggtcagagatggggcttccaatgttagaacggcatagagaagaacctttgaagttcaaggtttctttatacagtaatagtctatcactaaagttcaggtacaggattttgttactctccttcccaatgataagaatgtagaattattatttttaaatataaaatggcaatttgataaatgttgctttagtgctatgaagaaatgaattcatagaattcattcttactgatgaggggattattcattattactgataagatcaaactcagagaggccaccaataaataatataatctgaaggaaaacaacaaaaagtgtgacttaaaacatttgataagggttgggtgtggtggctcacacctgtaatcccagcactttgggaggccgagtcgggaggatcgctggagcttgggaggttgaggctgcagtgagctgtgatgacgccactgcactccagcctggacaacggagcaagaccttgtctcaaaaataaaacaacaacaacaacaacaaaaccacttgacaaggaaaagactggcatcgccaagaagataaaatctataagcaatacatatttcactatgaaatcctgatgatgatcttattaatgaatgttctgtagccatgtgacatttaaaaaaaatctgttgcaatgttttgggacgtatttatttcccataatctcaaactgtcttgcaccttgtctctcagctccagtataaagagcaaaactacaaggccactccggtaagcatgaccccggagatagagagagtgaggcgaaaccaggagcagctgagtgcggcaagtcgtttctgtttccttttatattttctcaaacataacatatttttatttaaaaatatgccctttggaaggccattatccttagcaaactaacacaggaacgtaaaaccaaatactgcataataatgagagctaaatgatgagaatacatggacacatagaggggaataacagacaccggagcctgttggacgggagaggatgggaggagggagaggatccggaaaagtaactgttgagtactgggcttaatgccggggtgatgaagtcatctgtacaacaaactcccataacacaagttcacctgtgtaacaaacctgcacatgtaccgctgaacttaaaagttttaaaagaaaatgaatttgagcaacatgcaattatatggatgaatcatatcattataacatgaaaaagtgaatatgtacatgcagcattaattcttttgtaaaatttaacaactgcaataataacgatgatgataaacggaatatctccagatttaataaaactatctaaaaatttaaaaaggaaaagttttacaccctctgcatttttggatgttccttttcacatttccttgttgaagggcatgaactgcgtgtccaggaaatttgggactgtgttgctgtaccttagctgtgtttgcttattcaagagatcttcattaagtacccaaatgtactgggcattgtcctggtcacccagacacaaagatgggtaagacccactttctatcctcaaggacctcatagttcagttggtaaatctctttaaaaaaatgcagttaatggagaatactggatctgatgtcaatatgaaaagaaaaatatatatatattggaacagggcaaaagaagacctggcttgactggcattctaagacatagtatcaagtcaaagagccttataaatggaaaacatttttcagtcattcaatagtctgttgtgaataaagcaaaaatagttaacaaggcagcgctactctgtgctgggccctgtactaatgttctatgtaaacccatgaggtcagcactgtttgtttctctggttggtagatgtgggaaactgagtcttggggaggtcagaggacatgctggcctcccacccccagcccccccacccagctagtaaaggcagagctgagattggaacatattgttgaactttcaccaatacaaacaaaagccttctttttccaaaacaagtacctttgaaagacttcaaaatgtaagagtaggttctcctgggtggagataatgaggctcaacactgtttatccttataatatccctgggaggtggtaggagtcagagagctttagcttctattgaagggagaagccccacggtcagaagacagtaaaaagccttctagggtgacagggaatggacttcacaagagttctcttgtaatgacttcattctggcgtttcttttaaagcatgttgccttatgattccattacttttatttgtggaatttatggttaattttgatattgaagaggaaagcatttattgaagacatatttaaacagtaccagcaacaacttgtgcttgctaaatcagacccatcggaatgtgggcgtatatgtaagcgtgaaggttgatgtaatcaactgtggaaaaaaatgtgtaaaaagatggtgctaattttgagccttgtcctttgtggtatttcagtggagcccattgtgctatctgttaaagttcttatttatccttcttaggtaaaatataagggagaacttcaacggggaactgcaatttctgatccaccagagctgaagagggcaaaagaaaaccagaaaaacatcagcaatgtgtgatcatcttagtaacttttttcttacactatcaaatgcattgtccacgtgtgaatgaagggattgtatttatagaattttcataaccttgagctgatgtcctgttctcatttgactaacaacttatttgaaagatttcggggactttggtattgtgggtacagtcaggtgttccccacctcagggttcccagtgactcatcaggatgacttttttctttttgtttttttgagacagggtcttgctctgtcacccagactggaatgcagtggcacaatcttgactcactgcaacctttgccttctgggttcaagtgatcctcccagctcaacctcccaagcagctgggattacaggcacatgctgccacacctggctaatttttgtattttttgtagagacggggtttgggctggtctcaaactcctgagctcatgcaatccggccaccttggcctcccaaagtgctgggattacagatgtgtgccaccgggcctgggtgactttttttgacaggttgttgtgtatcccttctatcttgtcatctagctgatgggtgctatggtctcctcaagtcccacagtcgtagcttctggcatcctggccctacaaacaaacattttccctcccttttctaccagcatgtgttcctgttcttgcgcttcctccgagccccactttccacttcccacaatcatgactccatttttgggcaaagtctaggaagaaatgataatgtgtgcatggctgaataggttatattggacaggaccattttgggggcacttaataaggggctggcagtttttacctagacaccaacttgtggcctgctccgattccctgttgttgaaataattcacggatgcagttcaagaagaaagtcctcttttacagtcattaacatatagattgggttctttggaagaggaaacttggaaatctattacgttcaaagaaatcttttattcttcacacctttaaagtcattttaccagtttataatgcaaaggcaggtgattgatacttttcctaacaactatattttagagaagtagacgctcatctttcccccatatatttagagtcatacttgatgtgactccattattctcaaaaaggaacatggttatttagacaaggagtggaccagtgagaagcatgctggctttttaaaggatgcccacagtcacctatttaaacacatctttacaaaaattctgccgcagttaattcctaagaaaccacgaccatgtagtaccagtctacggtgaatacctttaagtaatctccatgaagacatttattctcatttccttttgtggttaaatatttattacagctttacggatggtatgcctatgtattcgagtacatccacagtgatttggacacatgtactctcttatgggatgaaatgaaatagattgatttaagatgccagcattttaaatacaactcaacctctgaaaatattttttgtagtttcctacaaaacttccctgactaactcattaaaataaatactgtgagccaggcactgtggctcaggattgtcatcccagcactttgggaggctgaggtgggtggatcacttgagcccaggagtttcaggtcagcttggacaacatggcaaaactcaatctctacaaaaatacaaaaattagccaggcatggtggcaggtgcctgtaatcccagctacctgggaggctgaggtgggaggattgcctgagcctgggagatcgaggctgtggtgagcaaagattgtaccactgcacttcagcctgggtgacagagcaagaccctgtcttaaataaataaataagtctctttgttgaattgattcatagtattctattttttgttctctgaaatgataggtttattacagaggtcagctgggaagagctaccactttaagtgtaactcctgaaatggaaagagtgaagaagaatcaagaaaatattagctcggcaagtggttttcttcattttagactatcacaaaggatgtgtcttttattatttacttgcggtcctcctttgcttgtgaaaataaaacttattttcaagaaacatttgtgatgtgtccaataagtacatgtgttatttcagatgacttccaaaagctgccactgcaaacatttacattattttgcaactctttgttatttccagatgtgaccaacagttacattcaaagcttaggttaaaattatattcatttaaacaacgattcatgatatgttagccgtgtctttgaaggtggtaaagcctttgatgtgtgcgttaaataattgtcattttcctgaaatatttcattgaacatggattgttaaatgctgtctgcaaaacaaaataggagatggatcattacccccactaaagacttacagaaaagaatccttaaatacagttaacgtagaattcagttgctcaccaaagtccagtggtgtacatgagtatcttatctgaatattgtgcttcctcttagtgaatatcagggcttcaattctgaattgtacataatgccctcaggtccacagtaagtggtatccatatcttacacctaatcagtttcataaatggcggtgttctgatgggcagttgtgaagaacacaggcccttttcttagcataccctgaatagctgtttgcctgagaatcagcatttaggctttgcaatttacagcttcctagtgacatttctgtccagagatgctgtgtgtatttaacataaattacctttaagttgtggctgcttagaagaacaactaaatttgttcctcattgtttcttattccctaagcagagaaaaaaataaaaagaaatagagtagcttgtatgcattttttaacactcttatggtagaaaattgggaaatttagaaacaaaataactttgggttctatttaatagttttggattttctctgtttaacttaaatatgataaccagttgtgtgtgtgtgtgtgtgtgtgtatgtgtgtatgtgtgtgtttgagacacagtctctgttgcccgggctggaatgcaatagcacaatcatagctcattgcagctttgaactcctgggctcaagcagctgtcttgtcttaacctctcaagtagctgggactacaggcacacgcccaactaatttttttttttttttaatttttacctgtagagatggggggtttcactgtgctgcccagcctagtctcaaatcccaggcctcaagtcatcctcccaccttagctttccaaagtgctgtgattacagatacgagtcctcgggcttgcgcaggtttacagactagatagatagttactattggtcattcacacatttgtttagagttgatagatttaggtcatttagcagtaggcggtggaggagatctttgattgtaaaattttaggttgctattctagaacaaaatttaattcactgaaatagttacctggaaaataatttcaagtatgttgcatatgtttcactcatttgtaaagcttaaaaatgttacatcatgtgttttcttatcattgtcttatgcctactatttactttgcaggtaaaatatacccaggaccataaacagatgaaaggtagaccaagtctgattttagatacacctgctatgagacatgttaaagaagcacaaaatcatatttcaatggtagggtccaaccagatcattcttaaaacatgctaaggaatgggcggatccagtgcacggatggcattacttcactattaatccgataactaacaaagcatggaaatgtggttggcttgtcttttgagggaggggcatttctaatcacactgaaatgcagtggaaacatttagtctaataaaatgatttttctcagtgactttttctggtgtgtctttatttctaacgtgactactgtaaactcatagtgtgaaagatatttgtgtagacttctttccaattaattctaagacaaaatttggtctgtttgcctgtcataaaggatatgaaaagaagtgtgtttttaaagctgtgtttttaaaaatgtgtgttttaaaaattatattatcagatgtaatttacctaccataaagtttgcccatttaaagtgttcaattcaatggtttctagtataatttacagttacacaactatctcctggacctaatttcaggacataaaaaaagtatattttgaagtataagtttttgtaattatattaaaagtggtatatattgttacctataaaatttcaaactgattttaaataatgccattttcatgaatgattgcctggaaatagatatcactttattgcatactgaagttgaagagataggaaatttaatttatatttaaattagtatattttaggaagtaaccaggatttgagaatatgtatttttacaagctctcattaataatatatatatagttttatatataatttaaaatagatatgagctataatgattaaaaactttgtgaaaatatcagcacttgatttctgatgctaagaaactgaagttccagactttagttttggagtatttggaaaagatacatacatgtagacaatctgcacgcagccagtgcagtgtacacctgtcatttaataaaaatgttgtgaaagaggtaactatccgcaaaattcagtatgatgatttttcctttttcaggtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttggtaagctgacggcgtttgtcggccggtgtgtgtggtcgaaaagatcatgcttgctctagcttcagaattaccctcttgagtcatctgactcctcatcacatgttggttgtggtacccaatttaaaatggaccgcaggtaaagtattatttttgtacgatgtggaatgggatttctggcattcacctggtatcatctcaagtcttttctattattggaagctctgtctttaataccttgctaattttaagaatgttcctccttgtatcacacaccagggcctgttgtgaggtggggggaggggggagggatagcattaggagatacacctaatgtaaatgacgagttaagggtgcagcacaccaacgtggcacatgtatacgtatgtaacaaacctgcatgttgtgcacatgtaccctagaacttcaagtataataataataaaaaaaagaatgttcctccttgttaagcaaagaagcagcagagatatgagtgatcacaatggttgaacaattactttgtttttctttaaaaagaaaaacaaaataattgtttttctgcttggttgacgtgttgttctgttgacctcatgtgcataagtggcagaaataaccatattgcgtttaggtccttttatcaaaaacagacacgccatgggcgttctgatggtactccataatagtaatagctcattttaaaaatattatttctggactggaatagttgagagccatctgaaagtcttgcaattaagagagcaaacttttattcctgctatctgttccttatagtcaggagaaatcctagaaggatatttgttgaatggtggctgagatatcagaaaagatcatactgaagtataaggcagggctaggaaggatgattattgatttttcagtctgtatcaacaactgaagactattgtctccttcagagcagttaacctctgaattatgtagttacgtagcttaaagaatatttttggtatatgccactcagtaatatcagtgttaggttttcttcatcttcaaaagtaggagcttattttttggtactagtgaaaggccatttagagataagctaaatttgacagggtaatgtctttacaaaaccagggtgctaaagtcagagcagcactaagtaacttggatgattatactaaagtgactctggaagtattttctgaagaaggattccaaacatgtttgtaggcaattgatagctttgctgatctgcctgagttgattacttaaaaggatcacattaagttggatggatgagttgtgatgttttcattcaatgtgacaccaaattagagtttcattgctttgtgctaaagggatggaactatcttaagggatagtgcaggggttctgatttatctcacttagggtggaactgctaaagtctgtacagcttacttccaggccctgcacacatcagaggtcaggaatgatggtgaggtcgttgctaaaaaccatgaaactgtctagaccgtgggctctcagaattcagtactcaaaaccattgaggttgaaattatgattgttttataaaatataagatgtatgactctaagttatttacttacttggcaatccagaagtcagtttatttgttcttattgggaagaactgttttccattgaaatttccataattggccaacattaaactttccaatgagccagcttctgtatcaggcatgaaaatacacgtttagagattttctgagtaattcagattaagccaatttgtgctgcttctatttttgttggaggctctgctacttcttacgagctgtgtaaccttggccaagctactcaatttctctgtgcctcagtttcctcatctacaaaatgaggataatatgtatgaaacttaaattaattaggtgttaaatgagaagagtgcctggcatatggtcagcactacataatattaattaaaaacagacaagcaaatttccagttccattttacaaattaattgtttttgctgtagccccatttctgccgtatgtctataactaggtttttcttttccagttgttggtacagctgtaaacagcttattttaggatctgatgcccttttgttggagagactggtgaattcagaagttattaaaataagaggagaataaagtggtttgcacagtctgatcactgactatggcagggatccattgacagcaggaagctgatattatttctcttttcattcatcatatttccttgctgtgtgccttgcttataacactttttaaataagtgtatctaataagatatgcattccctaagatacacttagcttgcactcacagactcagaatgaaaactaggcttgccaccattccacattttaaatattcatttctgttatagaaagggactttttttttgtttgttttgttttttaaacataaacttctcaattgtttcctatgaattactcacatgtcctgaatcagaaactataatcaaacattttgcttgtttcagcctgtggagagcaagagtgactggggattcaggggtgctgtgaggggatgcatatagctgccccatgtgctcctgtgttgtgtgatgggtcacaggtacttcagcaaggtctgatagggcagctcaatgaatagagcaggcaacttcaatctgattacaaagatttcttaacagatacttgtgaaagcaagtattttttcattctcttctgaagtcagcagcactgtgagtttgtctgttacatgtttgcttcttatatctattcctttgcagactttgtcttgactcttttgggtactggcttttttttttttttttccttttttaaattccttcttgatgagtgttgatttcttccttttggcaaaagacctcaaagtttggcgcacagatcctggctccatcttcgaccttgatcccctggaagacaatattcagtctagaagtctccatatgctctctggtattactcactttttagttcatcccatttatgtggttttgtcccaaaagtgaaccactgtgaactgtagaggttcattgtactgtgtaatgtaaattttaaagctgagaatttggcaaaccaaaaaaatgctatgctacttttaaatacaattagtcatttatgaaaagaaaactttttaatatatcttaattagtctgtcctagattcatttaaataagctttttattagtaagaatgcttttatattatttctgggtttacaaatacagttatttggattgcactaaagtgctgagacaaaaggaggtttgtttcatgaaatacattgttataattttttaaaggtagatttaaagaattatatatagaacagtagaaaggttttttacagggcatcatagatgtcttaaaataaattttcaagtatctttaaaattttctttgacattttatataatgtaaaatgaatagtttacatggcaagcatagttggcttttaacttagattgcaagttcataattaaaggcaaaaaaatgaatagttggggtacgaatgatggcttgatttgacatttcaaattttctctgacagttatgcagttatgttaaacaatagatagctatgtcatttagatcttgctctaacccctgatttctactctatatttaatttttgatgtgaatagaattgaatacccaaggcaaagcaggaattctagtacttttatagtcactttcattcatatagttagccaaacagtgtcacttgattttctaaaaataaagaaaaggcaacacatactatatatctggtgatagtttaaaggaattattgaaaaccaggcattacaattaacaaaaatttattaatttaccaatgttttctttgtccttgtcaatttcctatcccttacccgtcctttaaaattgagacttaaaagagcataaaacgatggttaagttattcatgtagttgatgcaatgcatgctgaagtttgggaataggtgcctagcgctgagattttgagttattctttactaagagatggtttttcttctctgttaagcttttaagtaattttttgttgattttgtttttcgagtcacttaatcacacgtgtaaatattttccctccaatatagaaaaggcgagtcactataggcgacactggtctcgatcccattccagcagtactttcggtacaggtctcggagacgacaggtcagaaatctccgagatttaccctagcttttcatgctgcagtgaggtaacaagaccgtctgatgaaggaggtatcaaacattcactgcttacaaagaaaatcgattcattttttaagtgtgtcacaagagtgtctttaaaattcttttcacttttgcatgaacatctatcctggctgtatttgagaatttaaaattaagttcagaaagttaatagtctttttttttttttaaagaaaaaaccctactaatttgcatttttgcatgttattttccccccgtcttacttcactattatcgcagcaatggatttgtaatgacaaaagggtcttgagacttgctgcttgagtctgtttcacaggagttatatgtgataaatatacacactacacagtcataggagaaacttgagttctgcatagtttttatatgatttccattaaggaaaaaaatcaatcttacagtaatattggggtacctcagaggttataatgaatgtgtatattttaaatattaatataaacttgcagacagagttagaccttgccaaaagaaattgggcataatacttgggatatgagagggtttttttttttttttaaatgagaaatactattgattgttaataatcttgtcactattttatatacccactcttttcctgtatcttctgttttctgtatccaggctgatggattaagcctagaacttcaatgaatttctttagggtattaaactaattttacttataaatctgtttttaaaggttaagactaaaatgtttcctcacctcattgcagttatattttagtacagcaaggagggggaaaggactgaagcatatgagaacaaaagcaatactgaatttccctttcaactcaaaggccatattgttgaaatcccaaaggtaggaaattttgaggttgagcaacttaacaccttggtgggtaaaaagtaatgtgactgaggaaatgaccaagctgcgaaagattgtataattgtgtaattagtttttctgcactcattacagtgaaacactaatgggaataaaatttattatattctatacatcttgaattgtaaaactggactgaccttattttggtagaaatttattaaaggtctcctttttgtgtaactaatgaaatcattataaactggttgttttattgtgggtaaaaatacatgagaaaatctcccctttttgtgtctgtctgaattgctaatgaagggttcagtaacttctgattacttttttgatagagtcttgctctgttgcccaggctggagtgcagtggcacaatctcagctcactgcagccttcacctcctgggttcaagtgattcttgtgcctcagccgcctgagtaggtgggtctacaggtgtgtgccaccacacctagctaatttttgtattttttatagagacgggggtctcgcaatgttgtccatgctggtctggaactcctgacctcaagtgatccacccacctcagcctcccaagtgcggggatcagaggcgtgagccactgtacctgacctctgattactttttttggacgtggggtcactgatttatgccctcagtgtccttcctggttctgtagatgcagaataatattgatatttaaagagataaataaaacccaaagcaaatacaagaactaatgttgatcaaccttatttaatgttactcagttcagcatactggaattgatgtctctcccaaaggcaatgtaccagagagtctttgtttcaagaatgaccctttacttcatgtctatcctcctcagtccatcattcattcatttagtcaccaaatgtttactgagtgctgtttgtgcactggccaagagcttagatctggcaatgcacacagcagtgagcaaaagaaacatgcatccgctgtaaggggcttagaggctggtggggggaccttgacatttagcagacacttaaacaagtaatacataatgaagagcagaatcaggcctgtgacggggtggaatgagggctacaataacagcgcagctgcatctggccttgatgtcagggaaaccttccttggggaggggatatttgagtagagatgtgaatgctgatggacgttaacgaggctgtggggctttgggagaaaaatgtttctgataggacagacgcatgcattggatagggcagaacattgagatgttcaaatggaagcatcacacacacaattagagtttagaagaggaggccgcacccgaggtcagtttggaaatcatccatccaagtctatgatttaggtcctaaatgaatctgtgtagagatcaggaattcggagggcctctgcttggatgcctctactccctctgcagcagcagaccatgcccacgtcacttgtctctttgcattctctcctccaaggctgtaaaaacctgctgctgttagttaatcacctctttttcttaagcccacattccttctcttttctaattatttctagcaagaggaccctatcctaagccaaattgaatgagaaaatgtctcattggaagaaggtataggcaaatattcttgcatttatactagaatttgagtaacacatggatgggtaagagggaataatcatatttttttttaaaggaggaatttcatacttcttcaaagatggagggagattttggacagcagcgatgactcagtgactcaaataatgccttgtaagaaaaagttgacttttttttttttttgagacggagtctcgctgtgtcactcagcctggagtgcagtaacgtgatcttggctcactgcaacctctgcctcccaggttcaaacggttctcctgcgtcagcctcctgagtagctgggattacaggtgcacgccaccacacttggctaatttttgtatttttagtagagatggggtttcaccgtgttggccaggctggtcttgaactccagatctcaagtgctccacttgcctccgcctcccaaaatgccaggattacagacatgagccactgtgcctggccaaaaagttgactctttggggtcatttataaatttctgttgttctcagtcctctgttttgaggccaagatgctctgtctttagggacattgcctattttaaaaaatagatattggggtatgaagcaaaagtcaagatgtaccaataagttgtataacataaacacaagtgacatgtgcccacaaaagagccatatgaatttgaaaagattttaggatacattggaatatgctaatttaatttaagtgaagcaaagcacattctaccaattggcacctgatgtcagtattcaaatgattagtgacatatatcaaaccttataagttcaataccacctctctgcttcccccttccctgcagaaatctcctttctgagcttcccagtttgctaagtgacaactacaactttccagctacttaaaccctttggagtcatccctgacgcttgtctttcactcataccccatgtctagttcattggcaaatcttgtcagctggaccatgacaaaaatatccagaatctgagtgcttggccctacctccattgttgctacccttatgtcagccactgtcatctctcatttggacaatgatagttgcctcctgactggtttgcctgcttctgctctggccacaccatcttccacccacctcctgctctgatctgttctccacctgacatctggaatgatcttcttgaaaccctggtgacatcatgtcactcttctatcattttattctgaatataacccaaattttcatcattgcgtacaagacccatatctgatcttgggccccggtcactgctctgaactaattttctgccattccaagtatatctgtccactctcaccatttctggtccccttgctttactcaaactttccaagaatgcttccccctagggcttttgcacacactgttcccccagcctggaatacttctgccaccccagatatttgcttagctaagtgccatttttctttatgtttcagtgggcctgcagcatattcagcattggagcccaagattaattctgattcaccctctcttaagtggaacggtgcttggttagtttctgctaatgttgaaataaatcatgttacagctagaggccataatggtagggttagtcatgtgaacctttgtgtagtgatgagggttgataaagcaaatgatccacttatcaagaaaactaacaggaggatgattgctaggggaactttgtatggaattgtttgggctactgcttgaagtgcgctaatgagtacatattttgaattgaatgtccagtgctcagatggtaccctctctaactactagagataaaatagcacccctttcctgactatctgtcccttttctctgaattttttccttcatagcacctggtaccacttcagatattatatattgatttatttatttgtctctctctgcatgcccaacaagatcagaggtactggctgttttgttgactgttgtatctctagctcttagaataggcattcagcaactatttggagagggaataaaatggccaaatgaatattttaaaaacaaggaccacatgcataaatatatataagtataattatttttataaaataaaattctcttggggaaggctttcaagaagattcttacatttttatgatgttttgatatgtttcaatgacattaaagcatagctgaaaaaatactctaaagtgaaaacattcccagtatgtgtgcatatatatatatatatatatatatatttttcgtacagaaggaaagaagtctccatgatttctcagtggctttgaaatttagggtcccctttgaaatgtgtgctctgctgggctctggtgagaaggtgctgattgactctataaaaagtggagtgatgaaaatcgttagtgcttttaacagtaacagtcaatcatatgcatttgtttaaattctatcctagaaattgaaaagaattttataacaatactagttaggggtaagatgaagaaatgtttataaatatttagaaacgctatttttcttctggatgttgttgattcttttaaatttatttacttttaaaaacaaaatgtagttaaaattttttggttcaagatcatcttctgagtaccactgctataatggactattttaaggattgatttttcttttttaatgtttcagtggataaataataattatacatatgcatgaggtaccaagggatgtttcgatatatacaccatatagtgatcagaacatggtaattagcatattcatcatcttgaacatttatcatttctttgtattgggaacattaaacatccttctagctatttgaaactgtataatatattcttgctaactatagtcatcctacagtggtatagaacactagaatttatttctcctgtctagctgtaatttacatgataaaatgtattatgtcccagaaagacgtcctttaatatttggttgcctgcttgtggtcgaggtggggtgtgtggcagtggtgtcctgcggtggccggaaccctgaactggaggacgagacattggacttaagtcccagtgctctcacgacttggtccgggttatcaaaggggtcatttaaccttattaggcttaaattttgcatctgtcataagaatggcgcagaacaagaagcagatattttacatttcctcagctaagtgccctaaataaactttttttctttcttttctttctatgtgtaagaatgtgtttatgttctgaaagtggtctgttttactttatgaatgaagtacttgggcagttatgagagtcacagttttcgttccttctttcgagtaagttctgattgttaggacaaagggttgaacaatcaactcatttcgttaaggcaaaagtacaaggttttcatcgttcacatttggttttcatgagcattaacagataagccttctcctttaagttttcatcatcattttggttatgtgttttccatgatattttcccatcttactttgattgttcagtattttcattttcctatgtgattattttggactttctttacttgtcaatctacttttcaatgtattaagttaccaaagggtttgcattttacatctctactgtgttactttgatttaagaacagaggcttttatttaacctctacccaattttgttttgattcatgaatagtattacttgaaattatctttactgccttttggtattagattcgcttaacttatattttatttgacacacagctcctttggtgaaaaggatcctgatgatttcagcttatttcactgtgaggtttcctttgatctttgtgtttgcctctagttcattgcctgcaatgtgtatctgcttcccggtattactttgtgtttctttggttttccttaacttgcagttttctggtattgaaagtattcgtatgtgcttgcaatctcacctggtgtttacctgccttgatttgaacttgtattcagttttgcttcaggtatgctatgtgtttctgttttcctccggaaaacgtaaaaggatatgggagtgtgatggggaatgaaaaacagatgcacttttcaaaataaatattttcagctttccaacctcgtggcctttcccattttgctgtgagagagtcttatggggatggcctagccctaccttaactgactgaaagtaagtttctgaattttgtagcagtttaacccaccctagccaggctatgcttccggcgtttcatcccatgtaatacgtattcaagagttgcaagagatgcttcagtacattctggaactctcagtttattgttcatagcatatatcaagagggcagtgcatcaactgtgcggccaattgccctggtgttttactggtacccataactccatctgctcagtcatcaaacatttatctagtatctcttgtatgtgtgagatactgggaacacaaaaataaaagaaacgggtactgtttttagagagctcacattctgttaggtgaaccagttgcataaaaccattgtgctcaggaaagcattgtgatgaagtattgcatagggttagaaatagccaagtagaggccaggtatggtaacttatgcctgtaattccagcactttgggaggcccaggcaagcaggttacttgaggtcaggagttcgagactagcctggccaacatggcaaaaaaccttctctactaaaaatacaaaaattagctggttgtaatcccagctactcaggaggctgaggcatgagaatcgcttgaacccaggaggtggaggttgcactgagctgagatcacaccactgcactccaacctgggtgacagagtaagaccctgcctcaaaagaaaataaaaaataaaaataaaaataaataaaatttaaagagagagagagagatagccaagtagagaaatgggaaaggaatgtactaggcagaaaaagggtagacgagagagagcatagcacgttggcaacttggtatagttcagcacatcttgaggctgtgtgtctagatgagctgaagaagaagtctggaactagagcacgggcagtgctgaaccccaatctctgcagagatagggctcaagggaacatggtcccagcacactttccttggattttatcctgtaggagacttaaacgctatttagaggaccagtgacctacacttgtaggtgagtggagtctcttccttggaggtttaatccattcctggagcttttctaagaatctggtctgcattgcgttgtttagatttttaccaagaaattgactcctcaggcatcaagagaccttctcagtggtccgctagagggattaatgatgtagaaatagtattggtagattttttttttcaaatatcgcaacctctcttattgtgagcatttgtcgtttatgcagaagagcagaaacactgaaattagataaccagaaaaacctattagaaaatacactcctagaaaaggaaactttagcacacagtgggaatgtagattggtagagccgttgtggaaaacagtatggaagttcctaaagaaattaaaatagaactaccatacaactcagcagttcctcttctggtatatacccaacccaaagtagatgaaaccaccaccctgtaaatatatctgtactcccatgttcattgcatttttatcgtaatagccaagatatggaaacaacttaaatgcccatcaaaggatgaatgggtaaagaaaatgtgtatatatacacatacaatggaatattgtttagcctttaaaaaggagaccctgccatttgccataatatgggtggaactagaggacattatactaagtgaaataagccagacatagaaagaaaaatattgcatgatcccacttatatgtggaatctgaaaaagaaaggtcaaatttacagagatagaaaataaaacaatggttacgatggggtggggggatggggagttgtaactcaaatgatacaaagtagcagatatgtaagataaacacatctagagatgtaacatatagcatgtggactgtagttaataaaattatgttagagatttttgttaagtagattgtagctgccctttgctcgctctctcacacgcgtgcgctctctctttctccgtctcacacacacacacacacacacacacgtgccagatggtaggtatgataatttgcttcactatagtaaccattttaccacgtatatgtatcccataccatcatgttgtaaacttcaaatatacatgagctttatttaagaagaagaaaatacactcctgatttagaactatgtatcttcatttaaaataaacttgctggtgtttctattttagccactgcttcggttttctgactactgattggtgacccttcaagatcactccccaatccaactccttgctagcctgacttctgtaaagaatgtgcattcagcaagagaatttcagaatttcagttgtacttcccaactatatttgagtgttatttgcaaactgaatttgaaaagttggtttaaatttgtcccaaaaatgctgttgtgtttacatttgtccaaaaaagtgctatcttcatttaagtttaggaagatatgaagaattgatgattgaaatactaaatgtctgtgatgaaccgggcacgcctgcaatcccagcactttgggaagcggaggtgggtggatcactagagtccaggagttcaagaccagcttggccaacatggtgagacctggtatctcctaaaaatacaaaaatgagctgagtgtggtggcacgtacctgtggtccccactacttaggatgctgaggcaggagaatcacttgaacccgggaggtggaggttgcagtaagccaagattgcgccactgcactccagcctgggtgacggagcaagactctgcctcaaaaataaaataaataaatttctgcgatgaatctaatcattagaaaaatgaattatttctttataatgtaaattccaatgtgtaggctatcatatgattatattttaccatctagtctgtacatctagcctgtgaaaaaaacacattgtacattgttcgcaagtattcgttcattctgttacgtccctaagaaaaagtttcgggcagcgaaacttgtattcctagtctcaatagaaatggaatgaaagaaatgtcatacgttttcttttctgagtgtgaagttggggaaaggatcaaatactaatgaatagcacttgttctagaatgcacatgtgtctttcatcgatgtgccaagattcagtcaaagggttccgtatgtgtgtgaaggagaaacatctgacacttaaactagaaacaatacaacattaaaaatacatttcctgtgaggctgagttgatttggagaaagagaagttttgatcttcaggaagaacataaatgtggctctagcatgtgtgtcaaatgagaaagcttttcgggaagagcttcataaactgtaaagtgacatgcatgtaaaggagaaaataaatattcctgcttatcggatggttgaacattagcaaatgaaatgaaaatagttgtttttgatttatatagattaaaatcaatatccaagttggatcatagactgaacagatatgcatacttacctgtctgtctcatgtgcaaaacagtagagtcataatgtgatctccacagtcacaaatttccctgcttttctcccactttccatttcagccaggtgccccacattaagccctaggcgtgtaggttgtggggattggttcctgactttagaggaactctttaatatttccacgtgctggaaataatacagtggggaaatagtgtatgaattttctgcattttgcttgcccgttatctgtggccctggctctttgtcatgtactttatcccttgtggcgagatttgctacttattactgcctgatctttccccctagtatttctgatatgcccatgctacattttttttttttttttgtaattagaaacagggtcttgctctgtcatctaggggctggagtgcaggggcacaatcctagctcactgcacctctaactcctgaggtcaaaggatcctcctgcctcagcctctggaatcactgggaggacaggcatcctccaccatgcctggtgagtatttttttgtttttttgcggagatggttcttgctctgttgcccaggctggttttgaactcctggcctcaagtaattctcccatctcagcctcctgagttgctgggattacaggcatggaaccaccatgtctatatttttcattctggtccttgatcttattcttgtgccatacctgacccatgtgtgttaaacttgtctactgttctgtctgtcaagttcttaccttgctcctgtctaactatccttacgattgtgtgcagtcaacctgttgacctccctacctggcagggaatcttcatacctgcctgtttgttcagacccacatagagaatttgggccctctgagacgcagacaatcattcacatttactttctcgtatttctgtatcttgagatcatgttggggacacatcgagtcagttttatatatgtctatttgttggaaaatatatatgtgcccattcagcaatttaatcagcaccaagatatgtctatttatgatatttagtgtggcttgtcacttaggatgtctagtgtaaaactacgtatcagaactccttatggattgatggtattgtctaagggtcagtattagaatacattagttcaagaaaaaccaaaggcaatgccattttaagtctttaaaaaatgttacatgcattgatccaatacatatttctagaatatcctctgcagtggaataatgacaatttctttcattgtactcgagtaatgaatcttcatattaaatattgatttatacaacatggacagtagtattcactgaggaaaattgggatttgctgttagctgactcttcagtcatggcataatttgcatctacaagctagtcttggtgatagggatacatgagtggaaatagcatctctgtctacctgccagttgtatgttctgaattgctttccccttatcgaagaactgcccagaattacgtagttcttatcaggaagctacatatgtgtctgcactgtacattcctttcttttctttctgtcttgttttgggggatagctcacacgtgttcatgtgcacacagacatataccatatggattttgtgccatgagaataattattaaagactctataatttggggaagaaattattttcttttccctcaccgacaatcctgcttatatttgtggtttgaattatagttacaacttgcagagtttatcctaagagagataaaatgagaaacaaatctgagggaaaaaaatggaagtggcaattcgaatctaaatgtagaagtaaatgggctagattattctgaagtaaaatagcagaaattctaaaatctaaagctatctagttgtatttaaaccatattatggtttagctcagttctgtcagaacatttgcagactaattttttctagagaaaaagcagttggcttcaaaatcaaaatgtactgattttcttggtttgtgaggctaattaagtttaactggtggaaaattaaaaatacaactaatgttgtgtgttttttcaatatttaggaactgcagagtccccaagataatattttagagaagtttttttttttttttttttttttttttcttgttttagactgagtttcactcttgtcaccccaggctggagtgcaatggtgcaatctcggctcactgcaacctctgcctcctgggttcaagcgattctcctcagcctcctgagaagctgggataacgggcgcccaccactacgccctgctaatttttgtattttagtagaggtgtgatttcactgtgttggccaggctggtctcgaactcctgacctcaaatgatccgcccgcctcagcctcccaaaatgctgggattggaggcatgagccaccgtgcccagcctagaagttctcatttgagacaactaagtcaaatatatcaatgaagtgctgaaatgtaatgtctgcatatgtagtttaaaaagtacaaagtatgtatgtttccttttgcagttcacaggcaataaagaatctttaatccattaatatttaaggaatattataaacctggttatttatatttggggaagaaaatggttaaaaatctcatggaattaattgtattttcaactaaatctttcatatattggtgacagcattgcttattctaatactgatggtgggagatctttttcaggcagcgttgtacacagtgactttgaagattgttaggtgccatcactatgcagctgttgtcactcagtgggaatgtggttgaagtcacattaggagacgtgatattgaacataggcttgaaatttatcatacaagataaggcgactaaatatttgccctggataaaataggttggtattggcaatgggaaaaagaaaaattaatctgacatacacacacacacacacattgcacacgcacactctctctccccagagacttgtcagatgctaaaatgactcttacaataaatctaaaagtcattgcttcagaaatgatgctactttatttgagtttgcttttccaaaagtgggtgaatttctgcctctacaatttcttccagagatgttttagcatacctcatcaaccacatacacataaacttctggttggatgtttaccacacatatacacacaaattaatgacaaatagagtaacctctatgagcctaacaagcctggctggcacatatcctgtgcatttaaactcatttttctttacctttccctctttctcacttctactgccccaagcaggaagggttgaccgcctccttttcaaacttcagatccagtcttcttactcctagaatcttctctgctcaacatgccatagtactcttacacttttctgaattcacagtggttattttgaaattaatctcacactgttttgtcatttcttctgtaataatttaggtttagtatagtcaagagtttgggttctgaagtcagatttttggcattaaattctggctccccctcatttctgatatttgaccaaattacttaatctgctaaccttcagctcctttgttggtgaaaagaagattgtggtgacagttacaccaactaaagcatgtgacatcctaagcgcagggctggaacattgtaaggaaaaaaaccgaacatcccaaattgcccgagactaaggatgttcctgaaaagcagaactttaagagctaaattagtaaaatcttgagctaacggggttgtaagcattttacttatattattaaacttttattgtgtgcagattcagtattcctggggaagtagagtcttatgttacctctttcccccactaactttcacaggggtatacacctgagtgcttaaatacttttatgtaggttgcattttcttataaagatgcaggttgcacaatatgaatatgcttaatgtcaaacaactgtacacttaacgattaaaaggatacatttatggtatgtatatttcaccaaaataaatagatttgcaatcttaaagtaataatggcgataattgttttatcactataagtagtatgtattactgtagtatggtcagcagtaagcaggatatagtatatactataaacaggatacattataggaatagaaataacatttagctaaaactagaaaattaaaacaaagataatatgagagtctagaagaggagaattgattattaggatcctagcattggcttgagagaggatttttgattttgcaaagatattttaggctgtacacttcctccttcctctcagctgatgaccgccaggtcctgctctgctccaccccaaggaaatggggtccgcttcccctcgcctcgtggcactggctttcccaggaatgttgcacgctaacctccaaattattctacaatgagctttctcttgacttggatttcttcctgcagtcccaggctgcttcccgaggcccaggttcaaacattcgcctccacagatattggaaacaaagcactgggggaaaagagggaattggggaaatagcatgtttaaaatagagccacatatacccctaaattcctgtcaaatgggggtgaatgaagcccgccagttcggtaggtccgcattgtggctgctcatttgaaaaaacaagacaccagccagacacagtggctcactcctgtaatcccagcattttgggaggccaaggtggatggatggcttgagcccaggagtttgagaccagtctgggaaacatggaaaaaccccatctctatgaaaaacacagaaaaatgagctgggtgtggtagcatgcacctgtagtcccagctacttgggaggctgtggtgggaggatcgcttgagcctgggagatggaggctgcggtgagctgagatggcatcactgcactccagcctgggtgacagagccagatcctgtgttaaaaaaaaaaaaaagaaaagaaagaaagaaaaataagacaccattatgcaatttcctttaccgccaccctagattctgatttattataattggtgtgggggacctgaacgtcatatgcagtcagggttgaaaacactgcaagtaactgattcttcctctgtcctcagtccttaatctcctgtccttcctttccagggtttgttgctcctgctgaaactgaagatttaacatataaaacagtaatgactgcttttatttttaaatgattcccaaagcttgagcttaattattttgtatcacgatgattaggcatgtctttaaaacttggtggttttaactcaattatagagcacttcatttttatattgaagtctgggtattcttagtttattatgcagtaagcctgtttcttcggcacttccctattcagagcttataattaagaatctgcaaactaaaatctagaggcaatctggcttgcttctgtatcctgcagggaaggaaaaggggtttctgtagtgctaagaatcctttcagattaaaaaatagcatcttgtttctagattgcatataaactttgtggacttaactcccacttatgtcttgtgatcagatgtgaataggacttgaggctttgacatgaaactctcagtgacacgtgtaaaagcaatttgagcagaaaggtccataccatggccgtgtgttataaccaagcagcacagccaccttgctcatggactagacaggagttttgttttttttttttttgagacagaattattttgctcttgtcacctaggctggagtgaaaaggcacgatctcagctcactgcaacctcctcttcacaggttcaaacaattctcctgcctcagcctcccaagtagctgggattacaggtacctgccaccaagcccagctaatttgtaattttagtagagttggggtttcaccatattggccaggctggtctcgaactcctgagctcaagcaatctgcctgcctcggcctcccaaagtgctgggattacaggcgtgagccaccatgcccggccaggactagacaggatttaactaggatctagttcattatttaatacttacttcaaaactagcagcatagtcctactttctcttttagcaattcctctctgattgtctaaataggggttctttgtcctaaaaagaaaaacaaaacctcattaagttatttgacatacattagctgataaaacagtagtcaagtgttagaaaatatgacaataattgcattgtgtcctagactctttattgggaaatttctgaatggtgattttctccctttttctggattttttcaaaaagtaagcccataggaaaaaacccaaattattttctcttttcacattacatctatagttaaagtaccatttttttctttttctttttctttctttcttttttttttttttctatttggaatttggccatcgactgtatctctatagtcattgaggggccttcaaaaccttcaccttttctttgatgacttgaaaccttaactgtggcttcactgcacaaataatttttttgctgccttcctgttcaatctctcagcctctgttgtattttgttctgtaaagtgggaatggtatctgttttagatagttgttgcagtaattaaatgatggcatacaaagcaccatgaacaccaaggacacttaatcatattctcttctttcacgcactctgcgtacatcccccccagtgaacttctttttgagtactcttcaacgtttcttgtgggtacatttcttcctttcatttactctaatctttgtgtatttacgtatatttcctcttttccagtttcagatttggtgagcctcttaacatgttcttagcatggtgcagtgctcacgcccataatcccagtgctttgggagtctgagacaagataattgcttgagactgggaatttgagactaggttgggcaatgtagcaagatcctgtctgtagggaaaaaaaaaaatcagctgggcatggtggcgtatgtccagctacttgggaggctgaggcaggaggatcgcttgagtccaggagtttgaggctgaagtgagctgtgatcacatcactactctacagcctgggtgacagagtgagaccccatctcaaaaaacacaaacaaacaaaaaaacaaaacttttcttcctcccttttcatcttctcttttatgatcttcacatgtattcacttctttatcttggttttatctctttccattttaataataaccattaagcagaaaatagcctatctgtggaagtactttattgtacagtagaagagacattttgatgttataaatgttgtagaatattccatatagagcctgaaatgcttagagctttagacagcttctagatctttggtcaataaatcttaccaatgtgaagtgaaagttgagtcacacttctgtgtattttcattgacttagtataactaaaactattatttgtggctttaatcttgttgacataaaacaacctgtcaaactcaaactctttggttagaaaagccattgtcccccatttgtagcaatgctaatggtatctgatgactagtttaataaacagggcactatgcttttactctttgattgaaaagcccttgtttgttgccaaatgaacctgacatcttactttttaaaaatcctttgattccacatgttcatggaagaaatctcatacatggaatagctatctttcaaccaaattctcagtgaaccaaatgtgaagccattgctttagatttccttttgcttgttttatttacctaagtttccaaaaaaggcattcctgtagcataacaatagaaaagcagtgtttatgcctcttcttaaattgctgtttgcttttactaagttgatttctttaggctttcaattatgtttgtctttgtttttttgtttgtttgttttgtttttttttttttgagacagagtttcactctgtcgcccaggctggagtgcagtggcatgatctcggttcattgcaacctcctcctcctgggttcaagtgattctcctacctcagcctcccgagtagctgggattacaggcacacaccccacgcccagctaattttttgtatttttagtagagatggtttcaccatgttggctaggctggtcttgaactcctgacctccagtgatctgcccacctcagcctaccaaagtgctgggattacaggtgtgacccatcagttattttttttataacccctataggagttccctaaaaactcttttattgtaccaagtataaggtagataactaggttttataatcccaaagaaactttttaataactaattcagccagatggcaaatgagaataatcaataaaggcatgaagataaactgcaagggctagatagatggcttatgtttattccaaagtttctcattctaaactcccttccctgctgtctgcaacatatacacatttagaactaatacattactttcttttcttgctatatttaacagtagcacaggttccctttcaaagtcagatataagtaaggagtaggcataaatataacttgtatgtgtgtgtgtgtatatatatatatatacacacacatatatatatacacatatacacacacatatatatatacatatatctatacatatatatatgtgtgtgtgtatgtgtatgtatatatatatataaaatttgagataagattgctctctgtcacccaggctggagtgtagtggtgagatcacatggcagccttgacctcccagatacaagcaatcctcccacctcagccttccaagtaggtgggatcacaggcatgcaccaccacacacagctatttgttttattttatttttagtagagacagagtctgctatgttgctcaggctggtctcaaaacttctgggctcaagcagtcctcctgctttggacttccaaagtgctgggattacaggcatgagccaccatacccagcatacttattttttgaaagccaaaatgagaaaacattgttaagcaacattcttgaattgtcagcacttaacaggcactaagctgggactgtgatgtataaactaggtgaacctaaatgtattacagagtgtgagatagcctattttcccaaatttttcaatgtccattcctgaaagtttttcttaaacatttaaagatggctgtgcttacctctacacattaaaacttaaagttcacagttaaatggtgtaacaatgaattagaatttaatttttataaatttacagagatgtttatatttaatctttcaaactttacaaatagattcaagtagtaattaatgaagccatgagttgtttaaatggttaaaaaccagtgcaagactaacagtctggagtatgcaggctgaatcatttaattggaaataccgtgagtagccagtgccattttgttaattgggtaaaaggccaggtgcccaagaccctcggtgctccaggagagcaattgtttttgtcaccccttttcttcctggcatgccttgaacatagtggacagtaataattattgttaccatttgtgaaggcttactatgtgccaggaaatgcagtatgctctgtgcacgcattaactgataaatatttgctgagagcagagacagtgaatgaatcaatggacaaggcttccagagtctaatatagaaaagcctccctactcagctaattaagtgggcctggagatctatgggaatttcattcttttttcttcgtgagtggattttgacaatatctttaacatctgttgatatcaaatatttaaattttgttgataatgttaaaaagtgttcttttctgaagtatttgatatttaatgatgttttaatgactttgcaatatactataattcaagtggagatcttggcagtttctctttggtcccctatctggacattaagcataatttgtaataactttataagataaattcactcaagaactatttaaaaaatcccctttcaatctaatataattatcatctggagaacatattaaatgatttgtaattttctgatgattaaacttctttaaagtattgatgttctcacttattagagtgaattttctacttataaaatattaattattcataacactcagaattaaatcttatttcttttattataaaaactgttctgaataaatcaacccattataattactttatatactcaacctgattaaacaaaaatggcaaactattatatattttatagcacatatgactataagttttactaatgtagcacataaatttttcaaaagacaatgaagggcacgctacgaaaataccctcatttatagctcatgtttctggtcacagataacttaaacacattcacagagaaacacacaagcatatgtctgctgattctgtggggttttaaaatctagcttctgtgttggcttctctagaattccgagttcttcaaaacaggaactatgccttttgaatgtcataattagtggtttggagagcacatactaaatgaatactattttgatacttttttaatatagaagaataatgtttatgaaattctttaaggatttggtttctcaggcttttgtaacgtatttagctgacttatttagtcttgataagtcagctgaatatcactccttcataaaacaaagacttcatatattctaagtaaatgtttctttaaagggtatggactttttgttaactaccgaacaaacgtgttgctaaacatacgttatgtttgccgtctttgtaaaagtaacattcagctgtatgtcttgaaatattgacagtatctgttatatgagaaataccctgtgaaaacacttatactctatcattaaattcctttaaaattcttatttttcttttggaaaatgccaaaaaggatcacatggtcgaataaaaacatgatttcattaagggagtatgaaaaatttttgtttatgtttttaactgagcatctgcaatagagccacaagaatatttaaagcatatttaactgcatgctaagctgagtttctttatgtgtccctaattactaagatttctactaatctagagatcacttataacactgcaacttaaatttcacaacactgaaaaggcattttgtttcagaagcttctagcagagcataacatcactctgagggtttgggatgggtatttcgaggctaactttaaggaatctttgtgtgtgtgtatgtttaacatgcagcacctgttcttcccggagcctatcagcaaagccattcccaaggctatggctacatgcaccagaccagtgtgtcatccatgagatcaatgcagcattcaccaaatctagtaagtgtccatttgatacgttcctccttagctggtcttcccatttcccctcaagcatgtaaatacatgtggaatagagttgaattgaatattgggtattttcatttaaagataaatgatgatgtgttgccatttatacaactcttttgaaggaagcaaaaaacttacagaggtaaactgttgagaaaggaaggcattaataagcattacataaaacaataaaacatacaaagaatctaccagtacagtatcctaattgttacttcatgattggtactagccgattatgctctttactcatgccttaggagcatggatatttgatggttgtatttacaagttcatcttaatcaaaatgaacacaaaagcctaaattatgtggccaaaatatatcttcaaatcccccattggaaatcttgaagaactggttcatatattcagtgtaaaacttggaagaagtgttcaacatttgctagttatacttggcttctcatgcagaaatttcttctacaagccctcaacatagtctcttggtctttgcctcaacacctagaaaactcttctacactgtccggtaacttgaattgctctaaaattctttgggtcccagccatgtcctcagtctgtgaatgtacttgattttgagattgtctgatgttaatgttagctaaatgcttagccttaaacaaaaacaaatataggaaaactcattataatcataatataataagtacaattgagtatgtatcttaacattcaggacacttatatgctaaatttctctcatagtgatacagaaacctatatagtgagtatgttatgagttttttctttcatttgttttacatagttttaagaggaaatgaacatttttagcatcaacttaagaaaagtacattgccaggagagatttgaacttctctgacatatgacgagttttgttctctgaagaatatgaaatcacatattatctaaggtttctggggttatctgaagttggggggaacttggctttattatttcaaagcctactttttgatgggctagctgtcgtatttagtgacttttctatccctgttccaaaaatattaagctatttgctagactagtaaacttgagatcagcacaatgagatgctaggtttacagatttccagagatacatgtgtttgaaaacattcctaatagttactttatgtgtgggtcggtgtgttgtgattggaatttgtggctgtagctatttcggcattcatcgtataatcccttcttcctttctcagaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacacctggtgctgctaattgtgttcatggtttcctttgattggctattgaacccttctgggaaatgtatttttgtagactttaatagagaagttgattgtcccttaaatgtagtgtgtgtttgaaacttcttagctgtcactttggaatcaccccaagccaattctcttaactctgtaatgcagccaataatttcaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagttttgaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtatcttcttttggaaaatggtattcaaattctggaatggaaatctagccaccaaaacgggttaatcaaaagacgtccttttccatttttttttgcttttattttctaaatcatttttaagggaatgaaacaggaatgtcatcagagattttttagtacaggcccaagagcctgttctctaagaaagaaattgttgccatgttttgattttcgaataagtgactttgcaggctttatgctagcccttgctggtgggtcttgaaatttcatccagagtctgcagtccaggtcaccaagccagcggcacccgtcggcaaccctgtgtttttctgattgtgccgtttactgtgacctgcaacggggtggcattcacttagggtctgacttcacagctatgacaaaaccgaaaaagcaaaactgcaaaaaagtactaagatgtacgggtcttggggatatctgccttatatgttatattcaaggaaattaacaaaacatcctgtaaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcaggcaaataactagagacttcttttaagggggtttggctggttttctctcactgaaatggccagtcgtgattaaagtgataaaaccccatatctgttttggtatattgtacacaaacctacaaaaataaactgaacttgcaatatttttgcaaaaaaatctgtcgttaaaactgaggataaaatacctgctcaattttattttactaagtatatatttacatttcacccaggcaggccattttcttttgtgattataagaaagagtagttgttgattaaattttcagactaaatataggacaggtacaattttggataaatagcacatttataagaaccgcaatgaaaactgacttgaaataatgcttgtaatcaggaaagtaatttcatccaccgatttcaaaaccagattcactgagcataaaagtcaatacatatttgaggaataagtctcctaaaattttaagcttcacgtaataatgtttgcatagcaaaatatttctgcttcaagcctttaggaattaagatctgatcagaatttaactaaagggtagttgttttacaatgaagactaaaactgaacaagatgttgcatgctcttgaggccataatttggtagtgttggcagttgttaataaagcttgtcaggatgttaagcatctcaggagaaatattggaaaattatatgtataaaaccaaagtgctatttttaaaagcatcatttaaaaaaaaatgacatgcctgaacaacttttccactttccacgtgcttccctcccacctttggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgacagaagcacaaggaacagtttgatacacttttaaaaggttctgaaaacaaagctgtatagggatcctctctctcttgagcaaagtatagcaacagaatatattgcttttgttgtaagcttttgtagtacatgtttttactaataattcttgttctctagaaagctttctatttctaacctatggcaaaatgaatccttcatgtcttcttgttattgtttacacacttgcagtgtagcccagtttgaaatatttatttggttatcaactgcccatggaggaggctcttgatgatcccaggtctcctcgacctccatacaccacacaggcatttgtaagcacagtttccacaagcaccttgtaggaatatggataagattagaccagcccctctctgtccactgggtttatttcttgaagaagatgcagatctggtttttccaatgtgccacagtctttccttatcctctccatgctgagcttgacaacactctgggaatgaggaacaagactttttctaaaaagatagtggaagttcaagggatgtacctcgttttcaggttcatccatctccagtggaatgttttcaataaaagatgaagaaaatgtgtgtgatctttaataacacatccctatagaaagtggataaaagatataccaaaactgtaatacagatatatacaaatataggtgcctttttgattactcttgtttgtctagtatgctcttggaaagaaaaccaagcaagcaagttgctgcctattctatagtaatattttattacacatgattgatatttttgtggtagggaagtgggatgctcctcagatattaaaggtgttagctgattgtattttatctctaaagatttagaactttagaaaatgccgacttcttccatctatttctgaaaggttctttgtggatttatatagagttgagctatataaacattaactttagatttgggatttaaaatgcctattgtaagatagaataattgtgaggctggattcactacacaagatgaacttcacttcataaattaattataccttagcgatttgcttctgataatctaaaagtggctagattgtggttgttttggttaaggtgatatggaggtgggagagcttttagttaagtaagaagctatgtaaactgacaaggatgctaaaataaaagtctctgaagtattccatgccttttggaccctttcctcgcaactaactgtcaactgttgatcaaaaaagtcaaggcattgtatgttgcttctgtggttattattctgtgatgcttagactacttgaacccataaacttggaagaatctttgagcaaattttctcagttgtctgtatgacttcagtatattcctgggaatgccataggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttgcaaatgaaggggcttcacggaatgttacaatgttactaatataatttggcttttgttatgcaaattgttaacaccagctattaaaatatattttagtagaaatgctttaattcatatttttttcctctacactgtgaatctttaagccttggtggactagagcaacatcgtgctgcccaaaggactaacctatgcaaactagttcacattttagtggatgtcgcagttaatgtgtaataagacattatttcccctgcataatgtacaacagcattgaaatgacacattaagcctagcatcacattgtatagtacagtcactcacaaacccttcaaggctaccctaatcattaacattaatatttgtttaaaagcaaatcaccgatttatctattgaaactacttaaatgacggcaaaccaggaatgacagatggctgtgtcagcaatggctttaatgtgttccctgcaagtggtctcctatgatagaactgcgttctcaaatgcactctcttcagggtcttaatattctgtgttttctctctgtatttgtaaaacattataacacattaatttcctatctctacacatttggtttgcttaaataaatgcaggatataaaaaaaatggttcacttcttggctctcaccgtggtttcttggagcatgggttgttagatgcaagcaatgcaccctaataataccccgggtctgagatttaacatgacaactcacatcaaatcgcatcagaggtgtgtgctgccttcagtgcatttacattggtgaatcagtcaagatattttcctcccccaaataaacttagttgtaagtgataacaatattatgcttctccaagctcagtatctttctgattttatatcaaagtaccgcaacaatgcatcattgtagttaatttatttcaagaataaattcctcatatgtcctcaatagtacaattctaattttcttctattcataagatgaaagaaatggtttggagcatagaatagaaagtgcacaaattgagtacataaaatgggaagcaactgatttctcagctaagaaaggctcatttatcacagaacacaattgcttttctccccccactacgcttcccataattgaaaaagtgagtccctatttttcacactcatataaatctatgcgatttggatgctagtcttattgtattattttgtaaaactttctctttggctcataatccttcctaattgtaaattgataaactttgcggatgacatctgctcgtagaataaacacttcttccaaatattggattttctgtttttcatattccgtaagtatgaaatgaatattttaatagtattatgaatcaagcacactgtatttgaaatcacaagacagcacagttatttatttgaagaattcactaccttttttccctctgagactttttttttttccattcgattataaatttactctttgtaacccaggccacagaggaaatgaataccttagatttttttttttctgacaaaaaataatttagcttttaaacagactgtgcttataattttattttcttaaacatttgtgaggttttacgggtaactatgacatgcgcaccaaacaacttttctaccaaaataagtttctacaaaaatatataataaactaaaaagtaggtaaaaggggatttttttttttcttcatataatctgctttgatatggtttggctgtgttcccacccaaaatctcatcttgaattgtaatccctataatctccataatccacacgtgtcaaaggagagaccaggtggaggtaattgaatcacagggtcggtttcccctatgctgtgctcgtgatagtgagttctcacgagatctcatggtttactaagtgtttggtagttcctcctctgtttattctcctttctgccacgttgtgaagaaagcgccttgctttcccttcgccttccgccatgattgtaagtttcctgaggcctccccagccattctgaaccgtgagtcaattaaatctctttccttcttaattacccaatctcaggcagctctttattgtagtgtgaaaatgggctaatatatgcttctcctacacag

SEQ ID NO: 13320 - DNA, 12383 bp, Human; identical to SEQ ID NO: 12789

SEQ ID NO: 13321 - DNA, 12383 bp, Human; identical to SEQ ID NO: 12789

SEQ ID NO: 13322 - DNA, 12383 bp, Human; identical to SEQ ID NO: 12789

SEQ ID NO: 13323 - DNA, 12383 bp, Human; identical to SEQ ID NO: 12789

SEQ ID NO: 13324 - DNA, 12383 bp, Human; identical to SEQ ID NO: 12789

SEQ ID NO: 13325 - DNA, 17879 bp, Human
aggtggccggtgagtgcgggcctgggaccagggcgggagtggccggcagggaaggggtaggctacgttcgtgggacgcgcactgagccgcgtggcccgggaacctctctggcaactccagttgggagaactgacagtgcattgcttcccagcaggcatcctggggcaacagtgtatctttcggggctgcccgggctagtggcaggcggggagccttgtttcacttgttacacttccacaaaggggaaacgccgccgcatccggagagtgggctgcgggcactgccggggcccagccctatccctccggcccccgccccttacttcctccagccccctgagcttcaggggcagatgcagccgccattctccttgggccctccccacgggctttctggtctaagttctcgtctccctcgcctgtgcctctgctgccgggttccaaggggagattgctgattcgctgtgctactttgggaaccattcacccgggacccagcttggaaagaggagagcttgtttgtgcttcggttggtttatgtttaaagacacagccgcaggtaggaaatagaagagttgcagttggacgtgtagcgttactgatgtgaaaatcaggagccgttgacagtggagctggagcagcccacttgcctggttaaggcacaggtggagaggccaagaggggttattttgtcagggagctcatgatagccctgcctggctgggatggtgccaagcccctagctgaatggttgaactcaactaggccgagagaaattggggcagtctctgaccaagctgggcttcctgaggcctggtgccatctgctgtctacactcacccaggaatgttggggagcggggagggagggcccctgcggaccagcatggagctgagcatgcctagattgtcgcgttcgtgtttgtacccttagggcctggcacttggtagtcactcagttgatgtgtgagtgggtgaacagctcaaatgtaatacaagctgctgtcactgactaaatgacctcagttttcactttgtttcacagtacatctcctacccagtaccagggccaggctccccataaagacctcaaaagtaaatgaattctttctgtgatccagtgatttctgcaggagtccaacgctaaagcattagccacccacccattcagctttctacatggccttcatcccatctgagctctcagtctggtgatcccctcattcagctattcgttcaacaggtcattcattcgttcgccaaaaactgaatgtccagtgcatgctaggtactggggatacagaggtggataggctctggtacccttgctacacagctcccagtccaggggggagacaactttcagtatgtcaagtgctgtggtagaggtgagaatggaatgctgtggaaacagctccccatgggagagtcagagaagttgtgtcagaagtgacatttgagctggttttttgaagaatgagtaggagcccaccaatcagaaagtatggagggcattccaaatagggatcattttgcaggaatgagaggttataacattcagggaatggcaagatcccctgtgtagacaaaaacagctgtaacttgtaaaaagaaaggaggactagggccagtcagtgaaaggagctctttgaatggcatcatagagaatttggaatattatcttgaaggaactgggagcatcaggaggcttttaatgaagagagtgtcatgatcattactacctggtagaaagatcattctcctacatgatgtgagattgggctaaagaagttgagacatagggcaggataaccaggcaagaggtgatgagggcccagatatgggctatggtggaggagatggcatttggagacactgtagaggtaggctggccagaatctggtgactccaagtgagggggagggctagaaagactggggtctctggtgcaaatggccaggaactcatccccagccttatgttaactgatctgtgtattctagatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtaaggccacctctaccttgcagctctggaaaactggtcaagcagggctcactagccagagagaggtgagaggcacagatagaagagtgacaggaataaagaatagtgaaagaacactgattttgccagggcagtgagtggaatggtacgccactaatgcacttactctacagtgccacacgctactcctttattttattctcaaaactctcaggtaggtatttttctcatttcacagatgaggaaactatggtcaagaaagggtgccagatttatcctttttttttttttttttttttttgagacagggcctggctctgtcaccctgcctggagtgcagttggctcaccccaacttcctccttccgtgcttaagtgatcctcccactcagcctcctgagtagctgcaactacaggcacatgccaccatgcccagctagttttttaaattttttgtagagatggggtttcaccatgttgcctaggctagtcttgaattcctggactcaagtgatccacccacctcagcctcccaaagtgctgggattacaggcgtgagccactgtgcctggccagacttatctgaaatcacatgccagtagatagctgaactgggattcaaactcaggtccctctgactccatagctgtactgtttccactgtggcaaaacatcctgtttctgattcctggtcctctccatttccttatgcatgaccttgggaaatgcatccaaattaacgtgtgttttaaggaccccatctgcagagcagatacggtatttctctgtctcccaaaaggtagaagactaggatcactgatttcataaggtactaaaagcactttgtaaatctgcagaggtaattctcccactatttgttctgttattgtcatctgtcctttaacatgtttaagcagtattttatacttaaacaatatttaatactcctccagtggcccttttatttttgtcatttaattgtttctttaacatgaggtaaaagatgaagggatatggggggcagtgtggtgctgaaactacatggagaaatcctggctgaaggatggcactaaaaccaagtgtaaaacctctctgaaagttggcatccaaggcaaaaaaggcattctgatgagttaatttgccaagagtgtaagtttgttttcagctacttagaaggcctggtctctgaggaggatttgtcataaaagcttttatatgaaaagcattttttaccaaaagtgcagtccacatgatgttaaacctccattttttttttttttttttttttttgagacggagtctcgctctattgccaggctggagtgcagtggcgtgatctcggctcactgcgacctccactgggttcaagcaattctcacgcctcagcctcccgagtagctgggattacaggcacgtgccaccacacccagctaatttttgagtttttagtagagatggggtttcaccatgttggccaggatggtctcgatctcctgacctcatgatccacccgcctcagcctcccaaagtgctgggatgacaggcatgagccaccgcgcccggcctaaatctcagttctttaaaagcaaatctggaaacaagcaatatggcctgtagcactttcttctctccactgtttgagtttaagcccatctcccacttcctctcccattctttcatcttttcagtccaactccacttccttctggctttccacagtctttctcttttctgttcacactgactgccctacccacctctgccctactccaaacacacagacccctctttggacttcccctccctcccaatggcccttgagctctctctgctctaacaggcagcccagcccagctcattcagctgcttttcttcctccctccacttagactgactctttctttctggggatcagatatgttcttcaggggagcagttctcagcaggtacactgcaaacaactgagatgtgtattgcatggaatttgttaccactgttggtaaaactgcccaagttttggaaacgatttactttttatataaattgagaagatttgaggtcatctctctaatagcatcactttctcttgcttgcattctaatatgcttccttgagggggagagagagggtggcatgtcagctggtgtgccaggaattatacgtgacatgcagcctaccttatctgtactgcagcctgtaatctgggtgcctgtgggagtgtgttatgcaccatcacataatgtcacgtgtgtcatggcagagaaaagggtgagaattggtgctgaagagagctggtgccaaggcctggaagaagccagatggttcacaccatccatgagtcatacccttgttcaaagatagggaggttgcagtcaccttggggaagaggtaaaaggctaaaaaggaagaagctgcttcctacaatgtttcagtctctctcctcccttccacccccaaaatgcctttcaaatgaacagtgatgagtgcctgtatctgtatggcgaatcagacacaatccccacttctatcgtgtagtggaggagttagacacatacacagctataatgctaggaaggtgggtaaaggccatacaaaaactaataagttaacatttattgagtgcttgctgcacaccaggcactgtcctaagcactttacctgcattaactcatttaatgctcagaatagctatgtgaaataggttcagattattagcatcaccactttacagatgaacaaacaaggctcagggagcttagctcacttgccctctgttagacagcacccaggcagtgtggctccagagcctgtgtgtgctggcccactctagcagccaaagttccatttcccacataagaggagaaacgagctaatgtttttctagggcctgctgtgtgccacttgacttagctcattcatttttcaaaacaactttttaataaaaagataaatgtacatatttgcacacgtctgtatgtggtcacacatgacttagtggttaggtggcattttacaccaaggtgctcacacttccttccatgggcctgctgggggttgctggagcctgatggggtagtaggcactgggcaaggtagtatataaataaatgtaaaggccaagagtttgtggcctattcatttttataattccatataaccctgacagtttctttgtgagtgggtagtattatcctcgttctgtcatcagtaaaactgaggtttagtacagcagtgatgtcctaaaagtcataaaatggcagaggcaggatttaaatctggtttgcttagaagccaaagccccatcccttcctttgtaccctgtagtttacagtgccagagtctaggccacctatagcatgccaggcaaggagcaccttctctgtgtgacaagcaccgagagcagccctcaattccaggcctgttggcatagtaagtgatacaggttggacattaagagcactgggctggaggttgaatgcctctgcctctgccactcccttgttatgtgacctatctatgttttgattaacttctcaaagcttaagttttcttatctgcaaaatgaggacaacaagaacactaactctatggctgtggtaagaataaatgtaatagttaagcacaatgcctggctcataggaaatcctcagtaaaccttagctattataattgttatctcccaaggctatccagtgaacaaacatagcacctagagtttgacggagccttgagctgatgctgacactagctgagagaagatccatggcagctctagtcgaggccctgcccaccagtgctaaaacaacttatatgtaatttgtcaatgacatccaatgaccttccttcttccccgattcttcgtaccatcatctggaccactctaaggggtactagctgccccaccttcctccttttagaggaggctggctgagcctctgcaaccccaagaagatggtgtcacatatagcagctaggacatgagctttgcagtggcagacctgggttcacatcccagctccaccactttctcacaagtgagctggggccaggtgattaaccttccaagccttaggtttccttttcagcaaaatagaaacgatgatagtacctataatatctggagttaaggtgaggatgaaatgagacaacacatctgaagggcataggcacagagtaagtgctcaatggcaaatgacccatcatctttaagggagggaaatctcaaccatgtgatgctgagttccctgtttgtaccgtaggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggccgtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggtatgtggggagccggtggacaggcagatgagggagaaaggagcctccaggagaggagctggcagcctcctgagtggaatggcagggctgggctatcttcccaggagctgcatagaagttaaaaagaacatattttcaaaacagatagttgtctttagcaggtcacctgactttcacattaagagccagaaatgtcagcttttatctggcatagctaacaggcgttttggaactgcccttcattttgatggtgtggtttgttaagttgggatggaagaggatggaactgccactggcagcaatggaaaaaatggtctgaatatgaagaaacaaatagaatgaaaagcggggaaggggaagctcaagaagttgtgaagtggttactgctgctcatttgggctgtgatggccagggatttttttagttctcttgtgccgtttatttgatttactatatatttctgctgtacagttgtacttcattttaaaaccttcaaaggctcagtctcagtggggctcccagggtcaaatagtactctgggctgcagtgactagagcagtcttaggggcagaagtccctgattgctggtgtacagggttagggatctggtttagtgctgggagcttggtttcctgtctgccacggtaccactgatggcaccactctttcttccttgccttaagtccagagtcccaggccttttggacaagagatcctctcccttcatccccattcaggaactttcactggccagagacccttgctctgcttaagagaatcagggcccaacaagttttactctttgtttcctgcctcccaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttggggtactgtgtccagttccctgtgggctctgggaactagcgccagggggacgaaaaccaaaatttgcaactgtagtttccagtgtcagagggcttagactctttcctcctttaagctagccctcaaaccaggatcagcatggaatgttcaatgaaaagatgttgttcctatgtgtttatgtattcattcaacaaacacataccaagcatttattctgccaggccttggggacacacagattgaggcactaccaataaattactgtgctccctcttttggcttgacctgagtttcctgggctctcttctccctgttgacctttcctctggctttctaatcatcctctgatcttcgttttgcctctacagagagattctgaggataagaactgggcccttaaagaacagctcaagtcctggcagcggctccggcatgacttggagcgagctcggctgctcgtggaattgatccgcaagcgggaaaaactcaaaagggagacggtgagtgctcctgggccagccctattttataaaagaaaaaacaaaaaattagccaggcatggtggcaggcgcctgtagtcccagctactcgggaggctgaggcaggagaatggcgtgaacctgggaggaggggtttgcagtgagccaagatcgtgccactgtactccagcctgggcgacagagcgagactccgtctcaaaaaaaaaaaaaaaaaaagacccaggagaaggaatagcgtgtgtaccccagccagatagcagcagggctgacgctggagtcaggtctcctggtgctcggtgtgcttttagttctgctggaagcagaatgtcacaggagcgtatgaacagaatcctcagttatgtgacataggtagctggtgctggtagttcaagaaagggggaagccagaattgttggtgcaagtttccctgggtggagcctcatagaaggtagacctgtatgagtacacccagctgtgagggtgggaaagaaggcgggttcccaggccagctgggaccatatcctcagacctctttgccactgaactggccgaggcctggctgatcaggcctttttctatgttagatcaaggttcagcagattgccatggagatgcagctgactcctttcctcatcctccttcgcaaaaccttggagcagctccaagagaaggacacaggcaacatcttcagcgagccggtccctctgtctgaggtaaccgaattggacgaagtaagaatcccttcccctcactccaccttctctctgttcctctcccagttggacccctgctgcaggtctgggccaggactagatggggaccttgaagagaggggctggtggctctggggcaggatgaactggagccacatgtatcacctggactctgtcttgtccctgtcacaccccaagggcccagaatgggaggcagtctgcactccttccccagaggcagggactgagtctgccaaatgaataatcccagggcaggaagacactttcggggtgctgaaccctagaacggagactttagaaggctcagcacctaaagaaccagctctgaagccctaggtcctgactggcagactcttctctctaaaaggtataaaatgagaggcctgaggcagcagcctccttataagttactgttaagtaaaaagagctgtaggaatgcaaggtggtgtttattttcagaggagtccccaagccattttcttactaaagcctcatatagtctagaaagtatatttggctctactttcatcattttccaggagaggaaaagtaggcccagagaggttaagagacttgccaaagtcacacagcttgtgactggtaaagtcaggaccagaatccagctttcctttcccctgtgctatatgcctgcctctaactgtggtgggaggaggttgctggatgtgtttcaggggggcttgttaggagcagggttcggggcaataaggaggatatctccacttaaaacaaacctgccctgcccttccaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatggtgggtgatatatcacacacacatataagaggccaatgccggggatggacagctttccaaaagtcccctcctgggagcaggcagtgtaggcagaaagcagctaggctgagcagtggcaagctatccccaggaatgctccccaagaagccagactgggtgaatggatagcagtgcccgccattccacatcttggtgctgctattttacagctgttcctggtgagaagcccaggggggatgagtgggtttcttgctgcctgcccaggttcaaggggccctgagggctgccctgagtctgacctttcccctccaaccctacccctagcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggtctgaatcccatggcaaggtggaccccaaagcaagtcagactttggctctgcagcacacactcaacccctgccattccccaggcagaggtccctcctacacagctagctgtactttctccctcattccccaatcaggggcctcttagctgcctctctggctatttgtataagagttaatcttccaaattccaagcccctaaaatgatctccccaacgttagctggagtaatggtcctatatgcccagggcatgaccctggatatctacccttctcaaatcaggcccctcaccaactctccttctttctttctctgctccaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctgcgtcagcgcaagcggggtaggagcccccggcccagttcgagctcagacagcgacagtgataagtccacagaagaccccccaatgggtgagccttaccatcacccagccccccaagagagtgagcaaagctgccattcttcccagcatactcccagttacccctttatttgcccataaaagagcgagctagaagggtccttaggaatcctttaactccactcactcatcttacagttgggaaaactgaggcccagagacactacgacccagctaaagtcccatccagggccccctgcctccattgtatcactttaccttttctcttctcaccttccttggggatctcctgccctttaagccatttgtgtcctaaagccagtaactgccgagggaagcaaggggtggagcagggctgtggccaactgtggtagacactgcccagagctagctctgctggccaaggttggaggaattttccagcacagaaggggaacccaagctccaagtccctcttacctccatgtcatctctgatctacatcttcctgaccggttccttccctcctccccttcccttcaaccaagacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccaggtaccagccctccagatcgaggccaacctcaggggatgcccttccagggctcttgggcctgtgtaggtttccctgttggaagtggggtggcagccatctcagtctagattaagatggctcaaactcaaggttctctgctaaataaataaatcagtgttaccattaatagaacagagagaaccatcctggattaaggtgatgattagagtatgcactcctgccgccactgctcaggctaacccacctctgttaggtcatcagcctagcccctgtgggtgtttgaatttgaaattcctcatatagcctctgctttccaaaagtctcagaccctgcgggctttaagagctgagggcacataccatgctgttccccattcttcccctcctttgagctgagctcccattgtcttgtccacagcacaacgccctcaaaacaaggccggggcaaaccctccttctctcggggcactttcccagaggacagcagtgaggatacctcaggcactgagaatgaggcctactccgtgggcactggccgcggcgtgggccacagcagtaagttcccttgcccaaggccagggatgctggggacccagtgtcagggtctcgccagccccccagctgctgatccaccccctctcccccattcctgtgaagtggtaaggaagagtctgggccggggagctggctggctgtcagaggatgaggactccccgctggatgctctggacctcgtgtgggccaaatgccgaggctatccatcatacccagctctggtatgcttgcttctgttacacttcttgctttccaatcccagaatacagattcacagttagcagacttttcctactccctgctgagctgtggggcacagagtttcttggtaaggtagactggtgggcagatacagcttgagtaccacttagaggctcccactcagtttctccatctctcccttttgcttctctttgctccttgggctctgaaataatttagcatggaaagaagctgagggtcagcattgcagttctagtagcatgataccctctctgtccccacttcagacatactctctaagttcttgaggaggaaaagccttgggaggacatggactgaaccaaactgggctcttattatatcctcagatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggtaaggaggggagcatttggtgtgactcacagccacagatgcagccctgtgtggtatgggggcagactgccaggaaactccagcaacaggcagactgggctatcacaagtcagtgggggagggacttagaacagttttttgagcgaaagggttgtgtcgaccatgtgtctgagaggctgagtgggcactagtggacacagctatagctagaaaccaaaggaccatcagagacttatgacaaatatagaggtggctcccacccagactcagatggcttctagacttagttttcccacctctgcctccacagtgacaaaatgaggataaagcaggcataaacattcaggctctgaatccctgttctgtcacatttacacatgtagtctttttgttaattgtctgcagaggatattcaatgtcagtaaagtctgcctagagcctatggcacagggtagctatttctggtgaggtcagggtgcctcctttttgtacccataaataccctgtgattaccctcccgccgccaccacacagtataactgttgactgggctctttcatctctagaccatgaacagtcctttgagggcagggaccatcacagagtctggccagagtgggtgcttgggtggtgtgtttgagtgaatagaggaggaaggctggtccttgttctccctgagatgatttatttgatcttcaccttatcctataggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaattctttgttcttgccccctgccagggcaaaggggatacaaagggaggttctgtgccccagggatgatacataattgggcccaagtggttgctgactgctgtgcatgctacatttcataagacacagcaaagagagcccctgttgcccatgcatggagtgagtggcaggccctgtgttgagcacctttagacattcagctttgcgtaatccttgcaataactatagggtagtttaataatagactggttatctccacaaagatgctgaagtttcaaaaaattatcttgcctaagttcctacaactaggaaggtgcagagctagaattggaacccaggtctgtttgcaaacctggctcttcaaccagtatgctgaactgccaggggaagagtcaactatcgattcctacttggcccttagaggcctcaagtcctttgccagtggcatggcccaagtgtttcagcatcaatacagctgagaccttccccactgcttaaccggagacagagctgggatggagacggttgctctttgctcacccccaacctcagcaccttctttccagactccaccgacatttattgaaggaatgccttccaagtgctaggcgcctgtgggatggcatgcctacagataggaacagtcacaggaagaaggggcggcccaggccttgcagccactgaggactggcactgagacaatgatggcactggtctgatgttgattccatgctgacggtacactccgctaggtctctggctgggacacaagggtcaatccgctgcagatgttgctcttcaagaatttgcagtctgggcggggtgcggtggctcacgcctgtaatcccaacactttaagaggccgaggcggctggatcacgaggtcaagagatcgagaccatgctagccaacatggtgaaaccccatctctactaaaaatacaaaaattagctgggcgtggtggcgcgcacctgtagtcccagctactcgggaggctgaggcaggagaatcgcttgaacccgggaggcggagcttgcagtgagccgagatcgcgccatcacactccagcctaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacagg

SEQ ID NO: 13326 - DNA, 20661 bp, Human
ggaagaaaatatattgattcttagaaaataaactgtcaatttagaattctttgttcttgccccctgccagggcaaaggggatacaaagggaggttctgtgccccagggatgatacataattgggcccaagtggttgctgactgctgtgcatgctacatttcataagacacagcaaagagagcccctgttgcccatgcatggagtgagtggcaggccctgtgttgagcacctttagacattcagctttgcgtaatccttgcaataactatagggtagtttaataatagactggttatctccacaaagatgctgaagtttcaaaaaattatcttgcctaagttcctacaactaggaaggtgcagagctagaattggaacccaggtctgtttgcaaacctggctcttcaaccagtatgctgaactgccaggggaagagtcaactatcgattcctacttggcccttagaggcctcaagtcctttgccagtggcatggcccaagtgtttcagcatcaatacagctgagaccttccccactgcttaaccggagacagagctgggatggagacggttgctctttgctcacccccaacctcagcaccttctttccagactccaccgacatttattgaaggaatgccttccaagtgctaggcgcctgtgggatggcatgcctacagataggaacagtcacaggaagaaggggcggcccaggccttgcagccactgaggactggcactgagacaatgatggcactggtctgatgttgattccatgctgacggtacactccgctaggtctctggctgggacacaagggtcaatccgctgcagatgttgctcttcaagaatttgcagtctgggcggggtgcggtggctcacgcctgtaatcccaacactttaagaggccgaggcggctggatcacgaggtcaagagatcgagaccatgctagccaacatggtgaaaccccatctctactaaaaatacaaaaattagctgggcgtggtggcgcgcacctgtagtcccagctactcgggaggctgaggcaggagaatcgcttgaacccgggaggcggagcttgcagtgagccgagatcgcgccatcacactccagcctaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtgagtgactgagcctgagaagcctgtcccctcggactggctcctgccgcctcaacactgcctggcatggggtacaaaggaatttgggggatgatggaagaaacccggggtacaaaagaggaaacaagcacgggtagccaacctgttacctttaatatgtctgtacagtgataattgtaaggatccagcggtataaccgatgcagaagataatagcacttgtttttctttttttgagacagggtctcgctctgttgcccaggtaggaatgcagagaggcccattccagcctcgaccccccgggcgcagcctcccgagtagctgggactacaggtgtgcgccatgcccggttaaatttttgtattttttgtagaggtgaggtttcgccatgttgctcagactggaagatagcactgttacttgtattagtttcgtacatggagctattgtaggataggagggaccccaaagggtgcaagaaaggaaattgagtgccagggttgtcatgtgccttgggctcaggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgagtacaggacctgggctggggttagggttcttggacataagtcacttctctatgactcagttttgccacctgtaaaatggggattatatctacttcataggcttttatgaggatttaaggaactaatacatgtaaagtgcttagaataatgccaggcacatagtaagtattattaccattattattatcctgctaatcaccatagtgaagtgacaaggattttgagcccattcctggttgtgtgacctagggcaagtgatttcattcattctgtaaatatatacaaagcatctgctgtgtgaccggggatacaccagtgaacaaaacagacccaaatgccagtcctcatggagcttacattgtggcctctttatctgtggaatgggatggtaactcagccctcacaagatgctatgaggaatgagaggtctggtgttgctttctctaacggtgctgactctcattctcctgggatcctcctggagttttggtacctaggatctgacctgtgggtgggaagaggccacacccaacagcaggtacctctcctaccccctgcatttctggtctccaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggtgagtaggtgggtcccctgcccccaggccttccatcagctttcaagatctgttcatttctcccctggttaccttctcaaggcttcctgccttcccaaacacttcccctatccagaaccgccctgcctggtctgatcaactccagttactcatcctccctatgcatccctaaaatgtcagcacctcactggtctgtgctttttgcccaatgggttcaatgcctaatcagaaaaatatctgtatacaatgtacagtagtttggggttaagagcatgcattctggggacagacccatgcctggttctgaaccccaactctcacttgggcacattatttagcatctctgtactaaagtttcttcatctgtgaagtagaataataatagcacctacctatgctattattggagttgtcatgagggttgaagaaaggaatatacatactgcacctagcacagtgtttggcacacaggaagtatatgtaaaattcaagctggtatcagccaggcgcagtggctcacacctggctaacacagtgaaaccccgtctccagcctgggcaacagagcgagactctgtctcaaaaaaaaaaaaaaaaaaaaaaattcaagctggtatcattgtagtgaatgggatagttttgtatctaagaacacgtgtgttcttcacagtagccctgtaaggcaaatgttttacagaggcaagtgtatcgattggcagatgtgagaaccaagctaggacaagtgcttgggaactgcatagcaaagagacagactgcctcaaaacaggagaatgtttttggtgcttagaaacccattcctggccgggcgtggtggctcacgcctgtaatcccaacactttgggaggtcgaggcaggcagatcatctgaggtcaggagttcaagaccagcctggccaacatggtgaaaccccatctctactaaaaatacgaaaattagtcaggcgtgatggcaggcacctgtcccagctactccggagggtgaggcaggagaattgcttgaacccgggagcaggaggctccagtgaaccaagatcagaccacagcactccagcctgggttacagagcgagactccatctcaaaacaaacaaaaagaaacctgggtcaggcacggtggctcacacctgtaatcccaacactttgggaggctgaggcaggtggatcacctgaggtcgggagtttgagaccagactggccaacctggtgaaacccgctctctgctaaaaattagctgggcgtggtggcaggtacctgtaatcccagctactcaggaggctgaggcgggagaatcatttgaacctgggaagcagaggttgcagtgagctgagatcatgccattgcactccagcctgggcgacagggcgacagggcgagactccgtctcaaaaaaaaaaaaaaaacctggccgggcgtggtggctcacacccgtaatcccagcattttgggaggccgaggcgggtggatcacgaggtcaggagatcaagaccatcctgcctaatacggtgaaaccccgtctctactaaaaatacaaaaaaaattagccgggtgtggtggtgggcgcctgtagtcccagctacttgggaggctgaggcaggagaatggcgtgaacccgggaggcgaagcttgcagtgagccgagatcgtgccactgcactccagcctgggcgacagagtgagactctgtctcaacaaaaaaaaaaagaaacctgttcttgagtctcagctcctggcttagttagtcataaggcctcaagaaagtcattcacctcttccggcttctcttagcttgtttgtagaatgggaataacagtttctatctagaagggctttgggagtgaataaagcaatcatgaggcagtgtagtgtaatgggttaagagcacggcgttagccaggtggggtagctcatgctggtaatttcagcacttttgggagcccaaggtgggaggatggcttgagcccaggagtttgagaccagcctgggcaacatagtgagacctcatctctacaaaaaataaacaaaattagccaggcatggtgacacaagcctgtagtctcagctactcaggaggctgaggtgggaggatcgcttgagccttaggaggtcaaggctgtagtgaactgagattgtgccactgcattccagcctgggtgacagagcaagaccctgtgtcaaaaaaagaaaaagcacaggtcttggtgtcccagacctaggtgcaagatcttatctcccccatgtcctttcttaagtaagttaacctcttctaagccctcattttctccacatgtaaaatgggaaaacagcagtactgtcagtggggttcttgggaaaagtaagcatgataatatatctgaagcatgttgcctagcacttgatcatagaagctgttgctatattgtggttatttttttagatcatgagtgtgaacactctttcggaaaggttaaggaactcagttggggagctcctcaagggaagcaagtcctcagtccctggactagacttgggctccggggccaattcatagcaggtgctcagaaaacatgtgtagagggacaggacccaggcctaaccctttcccttgcacataaaagtgtccactatcccatagagggtggggaggtaggaggggaacttaggaaaagcactcttgtgaggtagagagctcacttactagcctaaggacaggaagaacttgaagatgcctgatgcttgccctcctcctcactccccgcagggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtgaggccccagggggtaggagctgccctctctactgacactaagaggagagcaggaaatgagccaagcctgggagctgggtggaggcttggcttccggaggcagagcaggaaggagaaaggatataagtagatgttttatgagagaaaaaagcagagtgcagaaagagtagaaaggatatagccctttgaatgaatttctagaaagaccatttgttcagatgcaacacatatatgctgctatatatatgcagcaatttccagaaggaaattgcaggaaactaaataatagtttccttgggggagacaaatgggaagatatttcttcttttcggttttttgtttgtttgtttgttttggtagaaataggctcttaacaatgttgcctaggctggtcttaaactcttgccctcaagcagtgttcctgctttgccctcccaaagtgctggaattacagggatgagccactgctcccggccacattttgttcctttcgtaaaatgacatgtactgacaaaactttttgcttgatgtcaatagggttaactggcaataagatgactggaaattaggcatttgtctttttttttttttttttgaggtggagtcttgctttgttgccaggctggagtgcagtggtgcaatctcggctcactgcaacctccgcctcccggcttcaagctattctcctgcctcagcctccagattagctgggattacaggcatgcgccaccacacccagctaatttttgtatttttagtagagatggggtttcaccatgttgggccaggatggtctcaatctgacctcgagatccacctgcctcagcctcccaaagtgctgggattacaggcgtgagccactgcacccagcctttttttttctttatacttctctgtagtttaaaaaatgaatttttgcttaaagatttttttttgatgggctttggactacagcctaacattaaatcttggttctgcctattctcagccatgtgactttggccaggtcacttcacctttcaaagcctcagttttcttgtctgtaaagtgggtgtggtaataccttcttcccaggttatgataacctggcccacataggtgttcagctagtagcacctcttattacagcaatttcagtgtattcataggccgcgcatggtggctcacgcctgtaatcccagcactttgggaggccaaggtggacagatcacttgaggtcaggagttcgagaccaggctggccaacatggtgaaaccccatctctactaaaaacacaaaaattagccacacgtggtggcacatgcctgtaatcccagctacttgggaggctgaggtaggagaattgcttgaacctgggagagccaggattgcaccagtgcactccagcctaggcaacagagcgagactccatctcaaaaacaaacaaaaaaaaagtgtattcatagatagtatctgttgattgagaatatagaacaacagtaaccccagagtgaaggagaaagcagccggctttggggctataagcaagatgctggccacatgctgcccttcttccacaagggctcattctgtgtctgtcaaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggtgaggaaagtgggctgcaggggctggcagtgggctgggatggtagaaacttctctctctcttagtcacctctccctcagaccctacttctgttgatgggtcacagaaggggtcagataacttagtctcatcacttctgatttaggaaactttttccggagcctgtggggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgaccccagtgtaccctcctccccacacagactccaccctcctacaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaatgcagtgaggagtggtagggaagcaggtgaggaggggacagggcagagaaactcccggttcagggagggaaggggagcaggctgcccccaagccctcccacgcagaggatcatgacccgaggtccagggccctagagctggtggggcagtgtgggggacagttctgtgcccggctccacgcagcagtctcgacagcaacagccagctgccggccctgcatgggaagacagaacagaggtggccgcaggggcaggccctccactccagcccgggtgcacctttgtggaccacccatgcccttctgcagagcccgctcctcacccccagccactggtgtcagcagctccccatggctcgccgtctgcccctgcccctcctggctggtgcccagctgcagtttcctcatgtgccgcaccacagccgtggcattgaaggcttgctggcattgaaggcattgaagggagaggggagaaaggacttttgagagagtcaagtcatggggcaggggcgcagtgggattcttgcaattgttctgttattttcattcaggagttattttattaattcccctaaagccccccaaaaacctctacaaggctttattatatatttacacacacacacgcacatatgttagatgtatgtgtatctatatatataaatagaaacataactataattcatattaatatgtaatagcaaacactatagcactgtatgtcaggcactgttctaagcactttacgtagtaattcatttaatcttcatgaaagtctttgaggtaggtactattatcattttcaaaggaggaaactgaggcacagaaagctgaagtaacttgctcaggtgtgtctctattcaatatctccacctaggtgtcccacacacccctcaaattcaccatgtctaaaactaaaaccatccccccaaaacatgtttctgtccctgtgataaccatctcagtcatggtaccaccaccatccattctgttcccagccacagtcttgggccagcccttgacatctctttcccccaacatccattgcatcgtcatgtcttgtcagtttcacctcctaaatgactcctggatcaaccactgttctctgccccctgttgctgctactgtggttccaaacccttaccatctcctgcctgtatctctgccacagcctcctaatgcgtcacccagtctttactccatgccattctctgcatcctgagagctctttcttttttttttgaggtggagtctcactttgttgcccaggctggagtgcagtggcgcgatctcagctcactgcaacccccatctccgaggttcaagtaattctcctgcctcagcttcccaagtagctgggattacaggcacgcaccaccatgtgtggctaattcttttatttttagtagagacagggttttgccatgttggccaggatggtcttgaactcctgacctcaggtgatccaaccacctcggcctcccaaagtgctgggattacaggcgtgagccaccatgcctggccctgagagccctttctatgcagcaaatacttgcctaagattcttctggggctcctcagtgccctcaggatcaagttggtgctcctctgtggcatatgaggccctaagaggcctggccccttacctgcttctctaaattgggctcctgcctctcagtcccctcagcccctccagtctggccaggcttagcacttgcacttcccggaatggctatagacattattccgctatgcctcactaattcctacttaactgacagctctgtcaggtcatcaccacttttatgacctttctcggaccccataggctggatcagatgcctcctgaagaattacagacttcttcctctagacttggaggtgagggaccctctctggaatagagaaggtgttgggagtgtttgttgaatgaaagagtgaatgaatgaagtccttcagtaaggatccctaagcagttactgtgtgcccagtgtgatgccaggtgctgtgcaagctgagcctgggtagggatggggaggagtcctggggaggctgggaccagaactagggatatggactcaccttccacttgctcttggcaaagttcttcttgatctgctcactcaccgactggtggatattcttatctagagctgtatctcctgcaatcctaggatggggttatgtggtgggttgcctatgagggcagaagcagacctgagggccccaaatcccgccccagctcacaggttgtgtgaattctcaccatgggtgctgcaaggcctgctcacaggtgaatcttttctctgggtccttctccatcaagtgccggatgaaatctttggctaaacccccaagacaaaagcaaagataatgacagcatggtactgcctgtgtactccccaagagcatacccactccctcaggtctggcctggcatcaagacaaagaggccaaatcagtccatgccccaccccacccaacctatgctcttcttcaggccctcccaccccgtgccttccagctctttcctttctctcttaagaaaaacatatggccgggcacagtggctcatgtctgtaatcccagcactttgggaggccaatgcaggtggatcacgaggtcaggagttcaagaccagcctggccaagatggtgaaaccttgtttctactaaaaatacaaaaaaaattagccgggcatggtggtgggcgcctgtaatcccagctacttgggaggctgaggcagagaattgctcgaacccgggagacagaggttgcagtgagccgagattgtgccactgcactccagcctgggcaacagagcgagactgcgtctcaaaaaagaaagaaaaaaaaaaaaaagttgttcttgactaatctcagtgcattcacactgatgataaacgatagtagcttcacaggtttgcttcttaatagggggcacaaaaggaggatgaaaatgtttatggtggtgttttagacattagggtgtcaataggggagaggtattttcaaatagactatgtttgaagattgaacaaatgaatgcctagtttctcactctgggagccaagcagaaggaagtacccaagcagaaggaagaaggggtagggtgtctggtctcgaagacagctctttgtgtggtgctggaaaatccgacagaaggaaggcaggagggagaccgcccccaaagcaggtgagggaggaaccagaggcagggcccaggggaaaaaagcaaagccccaaataccagagtcagagatgtcgtcccagtaaggagagtcaaactcgtactcggccttcaaaatctgttcaaagagtttggcatcattctcgtcatagaagggagggtaaccgcagagcctgggcagggagaaactcatcctcatttccactttcgggtgccgttggctccggggtggagcactggggcagtctcaggggtcaggcaggagccatggaaggagttccccctttataaactctaccagccctgcctgctcactcctgttctagctacattatcctttctgttccttgtatgtgccgccatcttgccctcctcagggcctttgcacttgccattgcttctgcctatgccactctttccccacacctccaatgtctggctccctcaccactcggtcatcacctccacagcgagcccttccctgacctccctactgaaatggcatcaccccgtctccctattcctgcttggtttttctccacagtatttatttttatcacctgacgtcagtttgtagatttatttacttgttgattgtctgtcttccctactagaaagaaagtcagctccctgagggcaggcactttgtctggtttgtgctgtgctaaatttaccccagtgcttgcttggcacagtgcttgaaacatagtatctattgaatgaagtaatactggtaattgattggtggaaggaagggagggagggaaggaagggagggcagagggagagcagaggaaggaagagaggaaagtaggcgagaggacaactctggagccacagcctaccatggccaagccccacttacaagatgtaggcgatgacacctatggaccagcaatccacagccttgctgtagggcttctgggccaggacttcaggggctgtggagggaagaggacgtggtggtgacaaatctctgcccttcaactcctggttccccccaccatcacagccccagcccagggccctccgcacccacgtatcccggagttccacaggcggtggagagcacactgcccgggtcctccatcttggagaggccaaagtcggagatcatgattttggagtcttcatccaggctgtagtacagcagattctctggcttgaagggcaggagggaagagaaggggcaatcagagatggttagaggctggtagaaccttctgccgctccaagcaccttctgagaaataatggatccccaaaagccactgtggcttcatggctgtcataagaaaatcaaggaagctctcaagaaggccaaaaattccaggaaggacaaggctcaagagggtgtgggggggaactgtctctaaacctcaggtgtgcactgtaaagccctaaaggaatgtttgaatgcctattttatgccagaccctggattagtgcttgatttaatgccatcctcactgcttccctgctaggccagtctgtataatctcacctaacagatgaggaaactgatgcctttggaggcaaagtgactcacccaagaacccacagttaggcagtagcagagccagaattcaaaaccaggcatgtcacaccccaagtgcccttctcctagaacggattgagatgtactgctaaatgtgagccccgtcgctatttccgaggagtaggatttcggggatttctggcttttttctttatgttttgctgtcccatccaagttttctacagaaggggaataggattttttgtttttattttattttttttgacatggagtctcgctctgtcgtccaggctcgctctgtcgcccaggctggcgtgcaatggcacaatctcagcttgctgcaacctctgcctcccgggtccaagtgattcgcctgcctcagcctccctagtagctgggattacaggcatctgccaccacgccgggctaatttttgtatttttggtagagacagggttttgccaagctggtctcgaactgacctcaggtgatccacccgtctctgcctcctaaagtgctgggattacaggcgtgagccatcctgtctggccagatttttttttttttaatcagaaaaagacaaaatgttgtttggataaaatgccacacaattcactcgtgttcctttgagtatctggactagaatgggaggaggcagtttaaaggttacaagatccactttgtagatggaaatccaaggctcagtgagggggtgaaagttgcccaaggtcagacagtttggggtttgcaaaggccccacccctgggtaccctagctcaccacacccccttgagccccaccttgagatcccggtgtacaatgcccaggtcatgcaggtatttcacagcatccagcacctggaagatgaggcggctggcgtcccgctccgtgtagaagcctttttccacaatacggtcaaagagctccccacccgacaccctgcagcaggggatagggcagtctggcaaagagggttgggacagctgggagaggtgtgggggcagggcagaggttgggccactcacagctgcatgatgaggtagaggtggcccccactctcatagatgtcatccagggctacaatgttggggtgcttgatcctgaaaggagaaatgaggtggtttagccaggcatggcggtgtgcacctgtagtccaagctacttgggaacttgggaggctgaggcaggaggatcacttggccccagcagttcaaagctgcagtctgttatgattgcacctgtgactagccactgcactccagcctgggcaacagagtaagaccctgtctcaaaaaaaaaaaaaaaaaaacagcggtttagagctcaggacagctcagccacccccaacccccgaccactgcctacatacctgggtaggacaaaccaaggatctcgtccccaaagggaaaagctagcttaccatggtttattaccattttttggaaggtgagagagcagagggataaacactgggctctggcatacacagacctgggtccaaatcctgcccgtcacatgctatttgggtgcagatcttttcaccagtgagccactgcacccagcctgatacatacctcttaagagttttctggctaggcacagagactcacacctgtaatcccagcactttgggaggccaaggcaggcggatcacttgaggtcaggagttcgagaccagcctggccaacatggcgaaaacccatctctactaaaaatacaaaaattagccaggcatggtggcacatgcctgtaatcccagctatctgtgaggctgaggcaggagaattgcttaaacctgggaaacggaggttgcagtgagtcgagatcatgccattacactccagcctgggcaacaagagcaaaactccatctcaaaaaaaatatatatatatagttttctgtgtttacatgtttgtcagcctcccccaccagacataagctccccgaatccagaggctttgtcttgcttgccactgttcctccagcacctggtacagggtaggtgctagatttaatgtaacctctctgaacctcagtttcttcatctataaaatgaagccaatggtagtacttccctcaaagagttggagtgaggatcatgtgagataatgcaggtaaggtgcttggcacagtgcctggcacacggtaaatactcataagtgaaacaataatggtaattgattttttttttctttttttgagacggagttttactcttgttgctcaggctggagtgttgcccaggctggagtgcaatggcatgatcttggctcatcacaatttctgcctcctgggttcaagtgattcttctttctcagcctctcaagtagctgggattacaggcatgcgccaccatgtccagctaattttgtatttttagtagagacggagtttctccatgttggtcaggctggtttggaactccccacctcaggtgatctgcccacttcagcctctcaaagtgctgggattacaggcgtgagccactgcgcctggcgtttttgttttttttttgttttttttttttttttgagatggagttttgctcttgttgcctaggctggagtgtaatgcacggtgtgatctcggctcaccgcaacctccacctctcgggtttaagcaattctcctgcctcagcctcccaagtagctgggattacaggcatgtgccaccacgcctggctaattttgtatttttagtagagacagggtttctccgtgttggtcaggcgataattgatcttgatgatgaggaaggctcagctctgccacaaacttgccatgtgactgtatacaaatccctgtcctctctgggtcttattagaaatgctctgccaggagttgggtgtggtggctcatgcctagcactttgggaggccgaggcgggtggatcacctgaggtcaggagttcgagaccagcctggccaacatggcgaaaccccatctctactaaaaatacaaaaattagccgggcgtggtggcaggtgcctgtaatcccagctactagggaggctgaagcaagagaattgcttgaacccaagaggcagaggttgcagtgagccaagattgcgtcactgcactccagccggggcaacagagtgagactccatctcaaaaaaaaaaaaaaaattatctgcccagggtggttggaagctcaggggagagattggaagtgattctctgtaagttttccagtgaggacaggaggtttcatatcagcatgagcaattcatagaccagttggttgtggatttagtctgggggtcagcagacagtcatttttaaacttgctgagtggttttaatatgtgaggggaacttgaggtaggtccagagacaacaccaactgagatatgtgggtccaagccatgttcaggatggatctttacacctgattgaacagttaaacccctgtgactaagcactggcacctccatcacatctgtcatgttaggccaggcacttgaaataaaggacttctgatgttccccacaaccctgccaagtggaaattgtgatccccattttataaaggggcaatttaaggcttagagagtttaaatgatttgtccaaagcaggaaaggaggaggatgggagggccaaggcagggtcagcttggggcagggaaaggctgtggcccacgcacttgtgcaggacagcaatctcattctccatgctgccttccttgccctccagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagttaactgattaaagaggatttgctagggtattctttccacatctgtttgctttctctgggagaataagaagtcataagtcaaagaaaagcatctctcgtggtgaaatttcaatcctcagggataattagttactgtagtaacctcatcactggtttccagtcttgtccctctccaatttaccctccaagctgtggccagagtgactatcctgaattgcacacctgccaaaaagtcttaagtgtctcccggtggcctatgggacaatatccagcctccctggcctggcttccaaaaccctacacaaactgtcccactttcatctccagcccctttttccactctccccccagcctgtgattttaagctccatcacactctacctctctccacatagaaccatgcctctaagcctttgtttatgctattccttctgcctggaatgtccttcttcctctctgacaagtgcacacctacccatccttcagtccccagctctaatgccccattctccaggaagttttcccccaggcagaaggcacagctctctctgggctccacaaagccctcaatcccaaccttaattggagcacagcacacaccctgttgtcattttctgtaggtctgtctcttgcacatgtctgggatcaacttgaagggcagagaccaggtttgagttatttctgcattcccagcaccaagaacagagccatctccagcctcagttcccaaacctaggctagaacacttagctcttggcagcaagttaaatggactgactggcaccttcattctctcgacttctttctcttcaagaacccagggctattgggagagcagcccgtgtcccacccactgtcatccagaagtgaaaagctggggacagtttaggccctagatagtgctgccacagggcctgggctgtgggaaacaggaagcattaattgaccagaggaagccccaccctggactcagcctccctcagccatccagcacccaatcctgccctggactcacgtgcccagaacatctcggaagtcgtagatgtctctaatgtcctccgcctgcttccacctggggccttccactgcccccagcatggcccactgccccccgaccacagccagggctcctgtaaggagaatggaaggaggagactcagcagagcccagccctctgtctgggaatttactgcaggccccattcagtcattcaacctgcatttattcatccttgattcatccatttgacaaaatcattcaacaaacattcatttgtttattcaacattcagcaaattctcatgcctagagaaaaacctttcacagtggcagcaaaattctttatttaacaaagtcatgcattcattcattcatttattctagttctcttcccagttttccccctatccaaatccaagcacctagggaaaccctgacttctggcagtacaacagataaacccccagagcagctggtagaagcctggaggatccccctgtccccagaaccagtgatgtccccgccccaccctggggattgctggggtgtctcctttccctcctccttcccccgactccccggcctctccgaaatcaggtttccagcagcctgggcttccagcaacatctcagccacatttttaaatagctctttctgcactgttaccacagcaacaacagccacagctggagctccccagacctctccctcctgactccccatctgggtcccgggagcatgagaaatggtcctgctcactctgtcccttcctggccccatctaaccctatccagcctggcccttcctctgctgaggtctgtctcatccagcaggagagggtgggagttctctcccatttatcagatgaagaatggggagactgaggttggagttaggtagaggctggctccagaggccctaatgacacctggcctggggcccccagctaagcttgctgagggcaaaggccatcgaatggcct

SEQ ID NO: 13327 - DNA, 20661 bp, Human; identical to SEQ ID NO: 13326

SEQ ID NO: 13328 - DNA, 20661 bp, Human; identical to SEQ ID NO: 13326

SEQ ID NO: 13329 - DNA, 20661 bp, Human; identical to SEQ ID NO: 13326

SEQ ID NO: 13330 - DNA, 20661 bp, Human; identical to SEQ ID NO: 13326

SEQ ID NO: 13331 - DNA, 20661 bp, Human; identical to SEQ ID NO: 13326

SEQ ID NO: 13332 - DNA, 16600 bp, Human
tacttgggaggctgaggcaggagaattgcttgaacccaggaggcggaggttgcagtgaggcgagatggcaccattgcactccagcctgggcaacagagggagactgtctcaaaaaaaaaaaaaaaaaaaaaaaaaagaagttgtacaagtcctcgaaaggacagaggtcatcttatcacccagggggtgttgtcatcaagatgaacaggaatttgtggtaaaagaacccctagctcagtgggtgtgcttggtgggtataggggagagtgggggctcagccctgagcaggaaatgtatttttccatgaactaaggagtctgagatactgagatttggaagatggatcccttaacccctcatccctggccaaatcaagtcctctctctgagtctcagtttacactgagtctagctctcatgttttgaatagtgttctaggcacttcatatcattatatcatagaattctcagaactctgagtcaatcttcaatattcccatgttcccgagtaagaaactgaggttcggagaggtaaagcatgaccaggatcagttagactccaaagcctttccaggaacctcagctatcttcctctctcatctgtaagatgggcataataaattggccaggtgcagtggctcatgcctgtaattccagaaccttgggaagctgattggggaggattgcttgagcccaggagtttgagaccagcctgggcaatatagtgagatccccatctctacaaaaaataaaaaagccaggtgtggtggcacgcacctgtagtcccatctacatgggaggctgaggtaggaagatgacttgagcccaggagtttgaggctgcagtgggccgtgatcatgccattgcactccagcctgggtgacagagcaagaccctgtcttaaaaaaaaaagaaaaagaaaaaaagaagaagagaaagaaagaaaaaagaaagaaagaaagagaaaaaggaaatgagctgggcataagcactgttctctccccatcaccagctggaacatgcaagaattcaggagtagggagtggcacttggaggcccttggaggtggagtggggtcccaagcaacgtgcctcctccggctgcccccagttcagccccatccccaattcctgcgagttgctccccccgccccctctttccactcggcaccaaatttcttcccaaggaaggccttgagcaaaccgacctttggcctcttgcctgccgtcctagttgcaggctctctcccctaacctggaccccagccatcaaactctggagccccgccagtcacgtgacacctcggtcctttttggcctgtttccttcaggatcccgatttaacttcctcctccccaattccctctgcccccaatacctctaggcaccaccacccgctctgaggagcaagtgtctggggctgaagcctcagctccatcttgcagaggaaccggggcctcagtcttcccacctgtcaagtggggcccacaccctgcgaccacctccactctcttcattgcctagtcttgcccggtccttccccactccctcactcccccatcccccaccagactcccgtgcagttccagggcctgtttcccttcagggcacggagaagggagacagagccctaagggaggtcgcagaactggtctgaaagaaaatccaccaggccacagggtgagtttggccggcctctagcttcagacagacggggttcgaatcctgctttgcttccgaccacccgctgatttgaaaatcatctctccgggcctcagttgtcccctctgtgaaatggaccccgcttaagaccaagggcgggaagcgtccagcaggagatctctgaccagaagcagggagatggcctccacccgtgccccttccccagccttggagcggtgcctcgcctcccaatcccgggtccctccgccgcaggctccacctccactgacatcagagccgcaggcgggcggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggtacagccgggccccccatccctgcacccctgggcgctgcgtgggggcggtgggagcccctagcctctgggtatcctttcccaaggagtggccactgggcactctcccgggcgggctggaccctgaggggcagggctgggcctttctccacctctgtcccaggcccagcaggtgccaggcgggcctatgggacactgagtgggtaatagagaagggggcctgtgtgagcgccttcagctgggcctgactggaagggcgtgggcatttggaggtatccatggggtgggggggcttgcggagtgtactgtcttaggacaggcgtgtgggtcagacatgggtggaggatctgggaatctgtgtgttttttgttccagaggggtgtccacgtgttttgtgtgctggtatttggctctcagggtcttaagtcagagttaggagggggtgtacaattgtgtactgaggatgtttggagttaggtgtgtaaggacttggggtttggtttggaatacaggagcttccaggggatggggtagaggagctggagggtgtagggtacgtctggtatatgagggtgtgtgtgtgtgtgtctgggtgtcatcttgtgtgggtgcgggtggatgtgtgttttggggtgtaagagggagctgggtgagggatgtttggatggacaggcaggtgttcgggtgcagggctgtctggggcactgtgtggtgtggacatgtgtgctgatgtctgggagtacatgtatgatcaggtgtcacgggatgtggatacaaggcgtactggatctgggaggcaggtgtttgagttcagggctgtggagggggcttggtgtggcatgtctgctacagggatgtgtgtggatctgtgagggttgtatttggtaggcctccatgtgggtttcagactctgcctctagagcttacactcgagtctcctttcctagaagattctgcccctggatgggtgggcagggtcccctgggaaaaaggtcctgttccaggagtggaatctcacaccagaggccctagtcagggcaccttctcctcattctcccttagagaaaaagagagaaggaaagtgctctccctgaggtcacaaagcatgctgggctctgttttggcctcatctgtggatgggttgggaggctgtgttctctgaatggggcccattctggcttcatattggaagtaccagccaaggccattcgatggcctttgccctcagcaagcttagctgggggccccaggccaggtgtcattagggcctctggagccagcctctacctaactccaacctcagtctccccattcttcatctgataaatgggagagaactcccaccctctcctgctggatgagacagacctcagcagaggaagggccaggctggatagggttagatggggccaggaagggacagagtgagcaggaccatttctcatgctcccgggacccagatggggagtcaggagggagaggtctggggagctccagctgtggctgttgttgctgtggtaacagtgcagaaagagctatttaaaaatgtggctgagatgttgctggaagcccaggctgctggaaacctgatttcggagaggccggggagtcgggggaaggaggagggaaaggagacaccccagcaatccccagggtggggcggggacatcactggttctggggacagggggatcctccaggcttctaccagctgctctgggggtttatctgttgtactgccagaagtcagggtttccctaggtgcttggatttggatagggggaaaactgggaagagaactagaataaatgaatgaatgaatgcatgactttgttaaataaagaattttgctgccactgtgaaaggtttttctctaggcatgagaatttgctgaatgttgaataaacaaatgaatgtttgttgaatgattttgtcaaatggatgaatcaaggatgaataaatgcaggttgaatgactgaatggggcctgcagtaaattcccagacagagggctgggctctgctgagtctcctccttccattctccttacaggagccctggctgtggtcggggggcagtgggccatgctgggggcagtggaaggccccaggtggaagcaggcggaggacattagagacatctacgacttccgagatgttctgggcacgtgagtccagggcaggattgggtgctggatggctgagggaggctgagtccagggtggggcttcctctggtcaattaatgcttcctgtttcccacagcccaggccctgtggcagcactatctagggcctaaactgtccccagcttttcacttctggatgacagtgggtgggacacgggctgctctcccaatagccctgggttcttgaagagaaagaagtcgagagaatgaaggtgccagtcagtccatttaacttgctgccaagagctaagtgttctagcctaggtttgggaactgaggctggagatggctctgttcttggtgctgggaatgcagaaataactcaaacctggtctctgcccttcaagttgatcccagacatgtgcaagagacagacctacagaaaatgacaacagggtgtgtgctgtgctccaattaaggttgggattgagggctttgtggagcccagagagagctgtgccttctgcctgggggaaaacttcctggagaatggggcattagagctggggactgaaggatgggtaggtgtgcacttgtcagagaggaagaaggacattccaggcagaaggaatagcataaacaaaggcttagaggcatggttctatgtggagagaggtagagtgtgatggagcttaaaatcacaggctggggggagagtggaaaaaggggctggagatgaaagtgggacagtttgtgtagggttttggaagccaggccagggaggctggatattgtcccataggccaccgggagacacttaagactttttggcaggtgtgcaattcaggatagtcactctggccacagcttggagggtaaattggagagggacaagactggaaaccagtgatgaggttactacagtaactaattatccctgaggattgaaatttcaccacgagagatgcttttctttgacttatgacttcttattctcccagagaaagcaaacagatgtggaaagaataccctagcaaatcctctttaatcagttaactttagttaaatgagtttatttgttcctttttaagaacctgttctaaaacactgcttcttaaagttcaatgagcatacaaatcacctgaggattttgttaaactgcagattgatttagtaaatctggggcagggcctaaagttttgcatttcttttttttttcttttttttgacccaggatccaaagcagtagagattttgcatttctaaaaaagttcccgggtgatgctgatggttctttaaggttctaaagggtgttaaattagccatgactcgaattagcagaaaaagggatgaaccaactgtacacataatccaaaagcccaggggtagacctcaggcatggctggatccagagggccacataatgttatcaggaaatatatttggccatttctcaggttggacttcctttgtgttaatttcattcccaagcaggctctccccaggtggtggcaaagatgatcgccattagctccaggcttacatcctaccagctcaacaggagactcattctcaaagtgctagtaagctggcttgcatcacatgaccaattactgtggccaggggagagactactttgactggccaggcctgggtcatgtgaccatctctggagccaggggatggatgagtgactaggggagggtcatccacgtccttggtccagcagtggtcacagaacccatagggaatggaggagaggctggagggaagctggggttccagttcttcaccttgtgaatcccctctcccgataggggggccttctcggaggtgatcctggcagaagataagaggacgcagaagctggtggccatcaaatgcattgccaaggaggccctggagggcaaggaaggcagcatggagaatgagattgctgtcctgcacaagtgcgtgggccacagcctttccctgccccaagctgaccctgccttggccctcccatcctcctcctttcctgctttggacaaatcatttaaactctctaagccttaaattgcccctttataaaatggggatcacaatttccacttggcagggttgtggggaacatcagaagtcctttatttcaagtgcctggcctaacatgacagatgtgatggaggtgccagtgcttagtcacaggggtttaactgttcaatcaggtgtaaagatccatcctgaacatggcttggacccacatatctcagttggtgttgtctctggacctacctcaagttcccctcacatattaaaaccactcagcaagtttaaaaatgactgtctgctgacccccagactaaatccacaaccaactggtctatgaattgctcatgctgatatgaaacctcctgtcctcactggaaaacttacagagaatcacttccaatctctcccctgagcttccaaccaccctgggcagataattttttttttttttttgagatggagtctcactctgttgccccggctggagtgcagtgacgcaatcttggctcactgcaacctctgcctcttgggttcaagcaattctcttgcttcagcctccctagtagctgggattacaggcacctgccaccacgcccggctaatttttgtatttttagtagagatggggtttcgccatgttggccaggctggtctcgaactcctgacctcaggtgatccacccgcctcggcctcccaaagtgctaggcatgagccaccacacccaactcctggcagagcatttctaataagacccagagaggacagggatttgtatacagtcacatggcaagtttgtggcagagctgagccttcctcatcatcaagatcaattatcgcctgaccaacacggagaaaccctgtctctactaaaaatacaaaattagccaggcgtggtggcacatgcctgtaatcccagctacttgggaggctgaggcaggagaattgcttaaacccgagaggtggaggttgcggtgagccgagatcacaccgtgcattacactccagcctaggcaacaagagcaaaactccatctcaaaaaaaaaaaaaaaacaaaaaaaaaacaaaaacgccaggcgcagtggctcacgcctgtaatcccagcactttgagaggctgaagtgggcagatcacctgaggtggggagttccaaaccagcctgaccaacatggagaaactccgtctctactaaaaatacaaaattagctggacatggtggcgcatgcctgtaatcccagctacttgagaggctgagaaagaagaatcacttgaacccaggaggcagaaattgtgatgagccaagatcatgccattgcactccagcctgggcaacactccagcctgagcaacaagagtaaaactccgtctcaaaaaaagaaaaaaaaaatcaattaccattattgtttcacttatgagtatttaccgtgtgccaggcactgtgccaagcaccttacctgcattatctcacatgatcctcactccaactctttgagggaagtactaccattggcttcattttatagatgaagaaactgaggttcagagaggttacattaaatctagcacctaccctgtaccaggtgctggaggaacagtggcaagcaagacaaagcctctggattcggggagcttatgtctggtgggggaggctgacaaacatgtaaacacagaaaactatatatatatattttttttgagatggagttttgctcttgttgcccaggctggagtgtaatggcatgatctcgactcactgcaacctccgtttcccaggtttaagcaattctcctgcctcagcctcacagatagctgggattacaggcatgtgccaccatgcctggctaatttttgtatttttagtagagatgggttttcgccatgttggccaggctggtctcgaactcctgacctcaagtgatccgcctgccttggcctcccaaagtgctgggattacaggtgtgagtctctgtgcctagccagaaaactcttaagaggtatgtatcaggctgggtgcagtggctcactggtgaaaagatctgcacccaaatagcatgtgacgggcaggatttggacccaggtctgtgtatgccagagcccagtgtttatccctctgctctctcaccttccaaaaaatggtaataaaccatggtaagctagcttttccctttggggacgagatccttggtttgtcctacccaggtatgtaggcagtggtcgggggttgggggtggctgagctgtcctgagctctaaaccgctgtttttttttttttttttttgagacagggtcttactctgttgcccaggctggagtgcagtggctagtcacaggtgcaatcataacagactgcagctttgaactgctggggccaagtgatcctcctgcctcagcctcccaagttcccaagtagcttggactacaggtgcacaccgccatgcctggctaaaccacctcatttctcctttcaggatcaagcaccccaacattgtagccctggatgacatctatgagagtgggggccacctctacctcatcatgcagctgtgagtggcccaacctctgccctgcccccacacctctcccagctgtcccaaccctctttgccagactgccctatcccctgctgcagggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaaggtggggctcaagggggtgtggtgagctagggtacccaggggtggggcctttgcaaaccccaaactgtctgaccttgggcaactttcaccccctcactgagccttggatttccatctacaaagtggatcttgtaacctttaaactgcctcctcccattctagtccagatactcaaaggaacacgagtgaattgtgtggcattttatccaaacaacattttgtctttttctgattaaaaaaaaaaaaatctggccagacaggatggctcacgcctgtaatcccagcactttaggaggcagagacgggtggatcacctgaggtcagttcgagaccagcttggcaaaaccctgtctctaccaaaaatacaaaaattagcccggcgtggtggcagatgcctgtaatcccagctactagggaggctgaggcaggcgaatcacttggacccgggaggcagaggttgcagcaagctgagattgtgccattgcacgccagcctgggcgacagagcgagcctggacgacagagcgagactccatgtcaaaaaaaataaaataaaaacaaaaaatcctattccccttctgtagaaaacttggatgggacagcaaaacataaagaaaaaagccagaaatccccgaaatcctactcctcggaaatagcgacggggctcacatttagcagtacatctcaatccgttctaggagaagggcacttggggtgtgacatgcctggttttgaattctggctctgctactgcctaactgtgggttcttgggtgagtcactttgcctccaaaggcatcagtttcctcatctgttaggtgagattatacagactggcctagcagggaagcagtgaggatggcattaaatcaagcactaatccagggtctggcataaaataggcattcaaacattcctttagggctttacagtgcacacctgaggtttagagacagttcccccccacaccctcttgagccttgtccttcctggaatttttggccttcttgagagcttccttgattttcttatgacagccatgaagccacagtggcttttggggatccattatttctcagaaggtgcttggagcggcagaaggttctaccagcctctaaccatctctgattgccccttctcttccctcctgcccttcaagccagagaatctgctgtactacagcctggatgaagactccaaaatcatgatctccgactttggcctctccaagatggaggacccgggcagtgtgctctccaccgcctgtggaactccgggatacgtgggtgcggagggccctgggctggggctgtgatggtggggggaaccaggagttgaagggcagagatttgtcaccaccacgtcctcttccctccacagcccctgaagtcctggcccagaagccctacagcaaggctgtggattgctggtccataggtgtcatcgcctacatcttgtaagtggggcttggccatggtaggctgtggctccagagttgtcctctcgcctactttcctctcttccttcctctgctctccctctgccctcccttccttccctccctcccttccttccaccaatcaattaccagtattacttcattcaatagatactatgtttcaagcactgtgccaagcaagcactggggtaaatttagcacagcacaaaccagacaaagtgcctgccctcagggagctgactttctttctagtagggaagacagacaatcaacaagtaaataaatctacaaactgacgtcaggtgataaaaataaatactgtggagaaaaaccaagcaggaatagggagacggggtgatgccatttcagtagggaggtcagggaagggctcgctgtggaggtgatgaccgagtggtgagggagccagacattggaggtgtggggaaagagtggcataggcagaagcaatggcaagtgcaaaggccctgaggagggcaagatggcggcacatacaaggaacagaaaggataatgtagctagaacaggagtgagcaggcagggctggtagagtttataaagggggaactccttccatggctcctgcctgacccctgagactgccccagtgctccaccccggagccaacggcacccgaaagtggaaatgaggatgagtttctccctgcccaggctctgcggttaccctcccttctatgacgagaatgatgccaaactctttgaacagattttgaaggccgagtacgagtttgactctccttactgggacgacatctctgactctggtatttggggctttgcttttttcccctgggccctgcctctggttcctccctcacctgctttgggggcggtctccctcctgccttccttctgtcggattttccagcaccacacaaagagctgtcttcgagaccagacaccctaccccttcttccttctgcttgggtacttccttctgcttggctcccagagtgagaaactaggcattcatttgttcaatcttcaaacatagtctatttgaaaatacctctcccctattgacaccctaatgtctaaaacaccaccataaacattttcatcctccttttgtgccccctattaagaagcaaacctgtgaagctactatcgtttatcatcagtgtgaatgcactgagattagtcaagaacaacttttttttttttttctttcttttttgagacgcagtctcgctctgttgcccaggctggagtgcagtggcacaatctcggctcactgcaacctctgtctcccgggttcgagcaattctctgcctcagcctcccaagtagctgggattacaggcgcccaccaccatgcccggctaattttttttgtatttttagtagaaacaaggtttcaccatcttggccaggctggtcttgaactcctgacctcgtgatccacctgcattggcctcccaaagtgctgggattacagacatgagccactgtgcccggccatatgtttttcttaagagagaaaggaaagagctggaaggcacggggtgggagggcctgaagaagagcataggttgggtggggtggggcatggactgatttggcctctttgtcttgatgccaggccagacctgagggagtgggtatgctcttggggagtacacaggcagtaccatgctgtcattatctttgcttttgtcttgggggtttagccaaagatttcatccggcacttgatggagaaggacccagagaaaagattcacctgtgagcaggccttgcagcacccatggtgagaattcacacaacctgtgagctggggcgggatttggggccctcaggtctgcttctgccctcataggcaacccaccacataaccccatcctaggattgcaggagatacagctctagataagaatatccaccagtcggtgagtgagcagatcaagaagaactttgccaagagcaagtggaaggtgagtccatatccctagttctggtcccagcctccccaggactcctccccatccctacccaggctcagcttgcacagcacctggcatcacactgggcacacagtaactgcttagggatccttactgaaggacttcattcattcactctttcattcaacaaacactcccaacaccttctctattccagagagggtccctcacctccaagtctagaggaagaagtctgtaattcttcaggaggcatctgatccagcctatggggtccgagaaaggtcataaaagtggtgatgacctgacagagctgtcagttaagtaggaattagtgaggcatagcggaataatgtctatagccattccgggaagtgcaagtgctaagcctggccagactggaggggctgaggggactgagaggcaggagcccaatttagagaagcaggtaaggggccaggcctcttagggcctcatatgccacagaggagcaccaacttgatcctgagggcactgaggagccccagaagaatcttaggcaagtatttgctgcatagaaagggctctcagggccaggcatggtggctcacgcctgtaatcccagcactttgggaggccgaggtggttggatcacctgaggtcaggagttcaagaccatcctggccaacatggcaaaaccctgtctctactaaaaataaaagaattagccacacatggtggtgcgtgcctgtaatcccagctacttgggaagctgaggcaggagaattacttgaacctcggagatgggggttgcagtgagctgagatcgcgccactgcactccagcctgggcaacaaagtgagactccacctcaaaaaaaaaagaaagagctctcaggatgcagagaatggcatggagtaaagactgggtgacgcattaggaggctgtggcagagatacaggcaggagatggtaagggtttggaaccacagtagcagcaacagggggcagagaacagtggttgatccaggagtcatttaggaggtgaaactgacaagacatgacgatgcaatggatgttgggggaaagagatgtcaagggctggcccaagactgtggctgggaacagaatggatggtggtggtaccatgactgagatggttatcacagggacagaaacatgttttggggggatggttttagttttagacatggtgaatttgaggggtgtgtgggacacctaggtggagatattgaatagagacacacctgagcaagttacttcagctttctgtgcctcagtttcctcctttgaaaatgataatagtacctacctcaaagactttcatgaagattaaatgaattactacgtaaagtgcttagaacagtgcctgacatacagtgctatagtgtttgctattacatattaatatgaattatagttatgtttctatttatatatatagatacacatacatctaacatatgtgcgtgtgtgtgtgtaaatatataataaagccttgtagaggtttttggggggctttaggggaattaataaaataactcctgaatgaaaataacagaacaattgcaagaatcccactgcgcccctgccccatgacttgactctctcaaaagtcctttctcccctctcccttcaatgccttcaatgccagcaagccttcaatgccacggctgtggtgcggcacatgaggaaactgcagctgggcaccagccaggaggggcaggggcagacggcgagccatggggagctgctgacaccagtggctgggggtgaggagcgggctctgcagaagggcatgggtggtccacaaaggtgcacccgggctggagtggagggcctgcccctgcggccacctctgttctgtcttcccatgcagggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaaccatccttagcgctgtctccctcaatatcccccaccccatcttgttgtgcaaactgactgcttgatttgggggtgcctggcctttgaggtagtcacagggaggcccctccccaacatgagactgggtggggatggggagagagaagtggggaatggaggggaaggtgcttggggaatttctttgtccagggtgccccatctagccttccggccctttggaaccctttctgcgctttgctggtggctcctgagcatggcgggattggcgcaggtcggcactgaacagcacctgtaggagggtggagtctgtgtggggaggagggtacactggggtcagggctggtgagactagtgacagtgttgggaggtggaagagtccttggggaacagggccgaaggcaatgagaatccactggggttgggacaggggtggctggagagtcctttagggccacctggggcggtggtggaagagtccactgggtctgggctggaggagaggaaacctagggaggacacctaggtacactcaccgcttgggcccagccagcataaggtccccacaggctccggaaaaagtttcctaaatcagaagtgatgagactaagttatctgaccccttctgtgacccatcaacagaagtagggtctgagggagaggtgactaagagagagagaagtttctaccatcccagcccactgccagcccctgcagcccactttcctcacccagttccttgttggtctgggggctcggtcccttcgcctgggacgtggtagggtgccagctgtagtcacgttgggcaatgtgccacatatggacatccacgggcacagcctggggcttgtctagggccatcaggcagatgcagtcagccacctttgacagacacagaatgagcccttgtggaagaagggcagcatgtggccagcatcttgcttatagccccaaagccggctgctttctccttcactctggggttactgttgttctatattctcaatcaacagatactatctatgaatacactttttttttgtttgtttttgagatggagtctcgctctgttgcctaggctggagtgcactggtgcaatcctggctctcccaggttcaagcaattctcctacctcagcctcccaagtagctgggattacaggcatgtgccaccacgtgtggctaatttttgtgtttttagtagagatggggtttcaccatgttggccagcctggtctcgaactcctgacctcaagtgatctgtccaccttggcctcccaaagtgctgggattacaggcgtgagccaccatgcgcggcctatgaatacactgaaattgctgtaataagaggtgctactagctgaacacctatgtgggccaggttatcataacctgggaagaaggtattaccacacccactttacagacaagaaaactgaggctttgaaaggtgaagtgacctggccaaagtcacatggctgagaataggcagaaccaagatttaatgttaggctgtagtccaaagcccatcaaaaaaaaatctttaagcaaaaattcattttttaaactacagagaagtataaagaaaaaaaaaggctgggtgcagtggctcacgcctgtaatcccagcactttgggaggctgaggcaggtggatctcgaggtcagattgagaccatcctggcccaacatggtgaaaccccatctctactaaaaatacaaaaattagctgggtgtggtggcgcatgcctgtaatcccagctaatctggaggctgaggcaggagaatagcttgaagccgggaggcggaggttgcagtgagccgagattgcaccactgcactccagcctggcaacaaagcaagactccacctcaaaaaaaaaaaaaaaaagacaaatgcctaatttccagtcatcttattgccagttaaccctattgacatcaagcaaaaagttttgtcagtacatgtcattttacgaaaggaacaaaatgtggccgggagcagtggctc

SEQ ID NO: 13333 - DNA, 16600 bp, Human; identical to SEQ ID NO: 13332

SEQ ID NO: 13334 - DNA, 12835 bp, Human
gcttatttattctacaggaaatgagtgagacactgtatatgttaggtactgagctaggttggaggctatatagctgtgaataaaatagatatggtctgttgaccatgaggtttacagcctagtaaaggagaaatcacttacaaaggcatgaaggagggcaggtgcagtggttcatgtctgtaatcccagcactttaggaggccgagatgggcgggtcacttgaggtcaggagtttgagaccagcctggccaacatggcgaaaccccatctctactaaaaatacaaaaattaaccaggcacggtggtgcacacttgtcatctcagctattcgcatggctgaggcaggtgaatcacttgaacccgggaggtggaggttgcagtgagccaagattgcaccactgcgctccagcctggacaacagagtaagactctgtctcaaaaaaaaataaaaaaggccaggcacgttggctcacgcctgtaatcccaacactttgagaggccgaggtgggcggattgcctgaggtcaggatttcaagacaagcctgaccaacacggtgaaactccgtctctactaaaaatacaaaaattagccaggcatggtgatgtgcgcctgtaatcccagctactcgggaggctgaagcaggagaatcgctttaacccaggaggcggcgattgccgtgagcagagatcgtgccactgcactccagcgagggtgacagaagcgagactccctctcaaaaataaatattaagaagacatgaaagacatttttttgtcaattgtaataaatactttatagggggatgtcaaggtctctctcaagaggccttccttaattaagctgagatctggaggatgacttaggcaaagaaagaggagaaaagcctacagatagatggtcaagcatgtgtaaagctctgaggtgggaaagaatttggctgatacaaggactgaccagtgcagctagaagctaatccctctcctaagaatgtccttattctggcagggtgtggtggctcacgcctgtaaacccagcactttgggaggccaaggcgggcagattacaaggtcaggagattgagaccatcctggctaacaccgtgaaaccctgtctctactaaaaatacaaaaagttagccgggtgtggtggtgggcgcctgtagtcccagctacttgggaggctgaggcaggagaagggcatgaacccgggaggtggagcttgcagtgagccgagatcgtgccaccgcgctccagcctgggcaacagagcgagactctgtctcaaaaaaaaaaaaaaaaaaagaatgtccttattctcctttttctcctcctaatcccatttcaccttcaaaaccagtttcttctgcaaatatagattacttgtaaatctaaatatttcacatgtcatctttatatcatagttattttctgtatatttgctatccagttgagctgtttgagggtagagacagtgttaatcatctttgaattcccagttagctcagtgcgtggcaaacagtacacctatacatttgttggcctaatagattgacgacaatcatgcattcactggtgtgtctctagatcactttctcaaccttagcactattgatatttgagtctcgataattctttgtagtgcattgtagtatgtttagtggatatctgtccactgaatgcctgcagttccccttcttgccaagtcatgacaattgaaaatgtctcagcattcctctggtctgaccccaggttaaaaaagaaagaaaggaaatgtctcgacattaccaaatgtaccctggcaggcaaaattgtctcctgttgaaaactaccactctacaccttggaaggcgtctcgaaggcctagtctgttctgttcacagtagtgtcttaagagccttgcaccctcagtgctacctggcttcatgggagctggaataggggatcggtgggtttggcgtgacagattttgatcttccctttcctctgtgttatttcctatagactgccactctccgcccctacctgagtgccgtgcgggccacattgcaggctgccctctgcctggagaacttctcctcccaggttgtggaacgacacaacaagccggaagtggaagtcaggtagggaaggacaagtcaaggtggggatgaggggtgcagcacacagagatggctgctgtctagaaggtgccatgaacttatgtcctgcagtagtcaggaaagctgcagttgacattttgtcttgctgccagctgaatggtgattcccaatttggagttaagaaaatagggtcagtgggttggcaggacagaacccaggggaaaagacaagattggttaacacaaggtatgacttctcagagcagggctgttgatgaagtctctcctgtggcattgttgaaaacactggtagtttaaggaatggtcagataattgttatctgagattccatctccatacttttcttttttttttttttttttcccatctccatacttttctaatgtaatgatcagggattttttttttacctaccagcctagacactctgaccccctaatccaaatacttcatattttgaatgattttctcttatctagtttccatttcataaatatctttttcccctttaaaatttaatctggaggcctggtgcagtggttcacccctgtaatccgagcactttaggaggctgaagtgggtagatcgcttgagtacaggagttcaagaccagcctgggcaacatggcaagactccatctctaccaaaaaaatatgcaaaaatagtcaggcatggtggcacatgcctgtagtcccacttctctggaggctgaggcaggaggatctcttgagcctgggaagcagaggttgcaatgagccaacattgcgacagtgcactccagcctgggtgagaccctgtctcaaaaaataagtaaataggccgggcacagtggctcacgcctgtaatcccagcactttgggaggccgaggcagacagattatgaggtcaagagatcgagagcatcctggccaacatggtgaaaccttgtctctactaaaaatacaaaaataagctgggcatggtggtatgcacctgtagtcccagctactcgggaggctgaggcaggagaattgcttgaacctgggaggcggaggttgcagtgagccaagatcgtgccaccgcactccagcctggcagcagagcaagacttcgtctcaaaaataaaataaaataaaataaaataaaataaaattcattctggtacatacataactgagataatctgggttacaacattaaatgatacgatttaatttttaattttaaaaataactgataaagatgttaggatatgccctgttatactgtgtaacgtacacgatttccagtgggcctttgaaaatggttagcagtttagagacaccacaccacaattaattactattagagatctctaggtattcagaggcattactttgtaacctgaactcataggggtctcagaggcaaatgaatcatttctggattgataattaaaggaagccaaactgtgttcaattttagcctttccttacctctaagacaggtgttctctctgtattcctaaatggtatattggtttgcctgtacaggttgagtatctcttatccaaaatgcttgggaccaaaagtatttcagattgtggaatatttgcagatacttaaccagttgagcatccctaattccaaatccaaaatgctccaatgaggatctcctttgagcatcttgtcagcactcggaaactttcaggtttttttttttttttgagatggagtttgattctgtcacccaggctggagtacagtggtatgatcttggctcactgcaactgccacctcctgagttcgagcaattctcgtgcttcagcctcctgagtatctgggattataggagtgcgccaccatgcccagctaatttttatatttttagtacaaatgggatatcaccatgttggccaggctggtctcgaactcctgacctcaggtgatccaccagcctcagcctctcaaagtgctgggattacaggcatgagccactgtgcccagccagtttcagattttggatttcagatttgcagattggggatgttcaacttgtagttactaaaatagctatcttttgtaaagctcctactatgtgccaggcacgctattagacatttgaccctttttgatctctctcagtcctcgccagtgaattaggaatcagagtcattttacagatgagaaaattgagattccaacagggtaacttgcccaaggaaagtaacagaggaggctggatttcaaaaccttttcgccctgacttcagagcctgtgctctttctgctgaagaacacactcactggcccccatcttggagcactcctgcttgtgagtcttctattccttggactctatggtctcatagtgattccaggacctgcgtggggtcactctgactattctatccctctgtagtacaagtactctgtcacattatgttttcaggagtagcaaagagctcctgttacaacctgtgaccatcagcaggaatgagaaggaaaaggttctgattgagggctccatcaactctgtccgggtcagcattgctgtgaaacaggtaagttcaccatggaggaggcccaacgtaaggcctctttcagtcctttcagcctctttcagtccggggtccccatctgagagatcagtgtgccagattccagattcagagtgcaggaaacctagcctctgcttcctttttttttgacacggattctcactcttgtcgcccaggctggagtgcagcagcatgatctcagctcactgcaacctctgcctcccgggttcaagcagttcttctgtctcagtctcccaagtagctgggattacaggcatccgccaccacgcccagttaatttttgtatttttagtagagacagagtttcaccatgtttgccaggatggtctccatctcctgaccgcaggtgatgggcccgcctcaacctcccaaagtactgggattacagtcatgagccaccatgcctggccagtagagggcaactctaaactttcaacaggatgaaaacgaagcactgttattaaatgcagactacacactgttttctacagaaacttataaacctggggcctgctttccttgctaaaatgggaggttaacaagtgttgagaggtgttaagggcatgctagcaaccagcagcaataatcttcctttagaaatgttgagagttcagggccaggcacagtggctcatgcctgtaatcccagcactttgggagaccaaggcgggtggatcacttgatgtcaggagttcaagaccagcctggccaacatggtaaaaccctgtctctactaaaaatacaaaaattagccaggcgtggtggcacgcgcctgtaatcccagctacttgggaggctgaggcaggagaatcgcttgaacccgggaggcagagcttacagtgagtcaaaatcgtaccactgcactccagcctgggtgacagagcgagattccatctcagaaaaaaaaaaaaaaaaaaaaaaaaaagaaatgttgagcattcagaagggagaaacttcagggattgttggatgttcagtgttattaaagcagagaccacctaaggttatctctgatagcccaggtgatgctgcaaaacaccctgggaaatgtgacactagtgaaatgagaatggaaagggcagcttggagtacagctgtagactctgaaagaagcaatagaagcctgtcagaattacctctctggaatgggtcgtcattaagagatgccccaaggtagacccttgtttcagttgacagccaggtcccccacttcagtgatccttccgagtaccaaacctcactgtctcctgggagccttgaaaaaactggagtcagaagaccaggctacaaggtgtttttggccttgggtgtcagctttagagaaacatttctctcttgcactccccaggctgatgagatcgagaagattttgtgccacaagttcatgcgcttcatgatgatgcgagcagagaacttctttatccttcgaaggaagcctgtggaggtgagaccctgtgacccatgagtttgcgatacccaggaccctgttacagaatggcctgggattgtttctagaaccagctactccagctgtttggcacccactgcctgaattgagagttggccttcatcttggagtgggagcaaagaggattagaagcttaggaaaagttgggtctacctcagccatagaaaaggcaaaaaagagccgggcgtggtggctcatgcctctaatcccaacactttgggaggccgaggtgggtggatcatgaggtcaggagttcaagaccagcctggccaacatggtgaaaccccatctctattaaaaatacaaaaattagctgggcatggtggtgggcgcctgtaatcctagctactcaggaggctgaggcagagaactggttgaacctgggaggcggaggttgtagtgagccaagatcgtgccactgtactgcagcctgggcgacagagcaagactccgtctcaaaaaaaaaaaaaaaaaaaaaaaaggcaaaaaagataagacacattgcttattcccggagcctatagtctagcatcagaaagagcacagtgaattagaaatcctttgtaaaatctgccaaatgaatcatagtctctctctctcttgtcttttctttgagacggagtctcgctctgtcgcccaggttggagtgcagtggcacaatcttggctcactgcaagctccgcctcccgggttcacgccattctcctgcctcagcctcctgagtagctgggactacaggcgcccaccaccacacctggctaattttttgtatttttagtagagacggggtttcaccatgttagccaggatggtctcgatctcctgacctcgtgatctgcctgcctcggcctcccaaagtgctgggattacaggcttgagccaccgcgcctggcctttttttttttttttttgagatggagttttgcttttgttgcccaggctggagtgcagtggcgcagtctcactgactgcaaccttccacctcccaggtcaagtgattctcctgcctcagcctcccgagtagctgggattataggcacgcatgtgctaccatgcccagctaattttgtatttttagtagtttcattgtgttggctaggcggtctcaaactcctgacctcaggtgatccgcctgcctcggcctcccaaagtgaatcatagtctgcaatctgggctcactgcaagctccgcctcctgggttcacgccattcttctgcctcagcctcccgagtagctgggactacaggtgcccgccaccattcccggctaattttttgtatttttagtagagacggggtttcactgtgttagccaggatggtcttgatctcctgaccttgtgatccgcccacctcggcctcccaaagtgttgggattacaggcgtgagccaccgcgcccggcccactgaatcagtctcttaaagccacagttaacattgggtcagttgttgcctgaatttgtacttgaatcttctccacagactccttgccaggtaaacttaaaatatccccagtgactaagcaactaccacacagcagcatgtgccatcatcagacacgtcaggcgtgttagccaagttcttcctcattctgagccaaattttctctcctggtcctagatctaacctctggggccacccggaataaataaaattgatcttcctcccacagccctccagcagaaaaagacccttaatcccacccatcttccacatcatctcttctctggactaaatgttccctgttgtttgattagattattctgtaacaagacttcaagttccttgactcattctgaatgcagagctgttgtgccacagatagttttccagagatgtctgatacacacagaattctcaacggggttcagttgcttggatccaacctagacaccctcccccagagcagctgggctgctgactggaagggtatgtagcttgggagaagatcacagccagtgggaagcatgtggatgagtggaggacatgaccagctcagttcccatggggtgctaattctctcctgttccttctcttccccctccctactgtcttcttccctaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatgtgagtaggggcctttagctttccttccagaggccagaggatctgggggtcatgttgagaacttagcatctggtgggaaaggggtccaagcagtgtgtttatatctcctgagctctctaggacccctggggcacagcaggtcagtcaggtgctttggagctagaggaccccaagttcatctctgagagctacaaggcattttctatatttgggtgtctggggtggctcttagtctctcgtaggaacttggtcactcatttctacatctcaggatgttcacaaagtccttgcctctatctcgtttaaaccccaagtgaggtaagtgaagtctgcatgtgaattttctaggagtataggacaattaatcatgttatgattccacttctcaaatagacttcagtactttccttcagcatgtttctcaggcttaaatcatgattccttcaacctgttttccatcacttgcatggcgtaagtcctccagattcctcttacgttgtttatgtctttctaattgaaagcactttagtcatctgaagaggtagaattgtttacattgatgaactggtgacatcgttcttagttgtttagatattcagaacatgcctttttttttctcctttttccaagcaatctttggtttgttgacatgtgccacccagagtggctgtgatctctagacggtagacttagtgtgtactcccaccagtaagtacatacccagtccagaaggagctcagattcctaaaaatggaaattatacccgcttcccttgggatttaattatactgagggtggccagtgtacagagtagctgtggtgggtgcacaggtcggcatggctgttcagctcactcggctatggaggcaacccacctgtgtgggaatccaggctccaccgcctactcaggcatgtcactgaactctcaactaagtctcagtttcctcagctgtgaaatgaaggtctggtaattaatacttatctttcagtggttgagcattaaatgagaccatgtgtgtaaaacgtagcacctggtacatagtaagctttccgtgtattgcaccaccaaaattttatggccaggatattaggaggcctctagattgaactggaaggggaaaatagctcttgttccaattgaatatttggctcactcactcaacaatcatttacttatttatgataattatatcgcacagaattggacccctaaaaaagtatgttcacatgtcccatttattactcaaaacagtctttgagtcagctattatcgccatgttagagattaataaactggggctttagaagtaaaagcacctgtccaaagtccctcagccagtaagaggaggaaccagaatgtggagctgggttttcggactcagaggtctaagaaagtaccatagcctttgtcaagggtcacaaattcaggtgcatccaaaggtcgggtagctatggagtgggctgagtatggagtgggcagggtgaggagctgctgagcgcatgcctcatgtgcaggggctggctcccacacagctccaggccattgaacccccaaatttggatttgtatatggcatcttccatgttttcaaggttggcaactaattcatattgttttaaacaccatgtgggccatgcagtgctcatctttgggctagtttcaggcatgggccattggttcacaacctttggtctctaaaatgtgcagggctgtcctaggcagcatgggggacccttgagggcagaaaacatttcaagggcctggcttggttggaggttcatccagagcttgacacaaaagtaccagaacctgggtccttttccacttggccctctgagtccccaggccccttgcatgagagcccccatgcctaaagaaagcaacctcagttcaccaggcaggacgctggcagggctttctagcagcctccatgccagggcacaagggagctgtggagaagctctcatggctcttaatttttctgccttatctagtgctaggcttagggccggtgcccataggtcacttctgaaagctggctgaattagagcatgaccacaaggtgtcctgggacccaactctgcccctcacagatatgagcacagtggcagctctcaggttcatgcacctccttagagcagtgccaccaggatgcaataataaccaccatgcactgcctcttggttctcttgacagttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcatgaggtctatgctgtgtgtgtgtgtgaaaggaggggaggtggggcttcttttccctgagaccagatggctggtaattgtgcctggagctccccactgggtgcagtctcatgattggtcctgccattattcctgccaggggtcccaacccagagactccattcattgcagtccaggcaccattaatttctgaaactgctctgtctgcctatacagagctttggtgcttttcacataaggaacttacttgggctaaaaagtaacctcagagaaacagtgctcccatttggtggataaggaaactgaggttccaaacatgagatgtaatagcttgccccaaatctagccagtgagcaagagagtagacttttgcctgtgccaaaacagtaatcaccatccacaagtggctatttaaattttaattattacaattaaataaagtttaaaatccagttccccagtcccactggcaacttaacagctaccagtgactgtaccatatataacagcatatatagacatacagcatatacaacacatacatagagattcccatcattgcagaaagttccattggatagtactagaccttagtaacaccttgaagtaaaaagacaaaagacccttgtgtttgagtcctgattcttcttgccagatttggctaagttacttctattttgtgtctcagtttcttagtctatgaagtggagataatgaatataaacaatctgatacggtcgctgctacacaggtactgactgaactatattttttccaccagcccagtggctgggctgttgaataatttccagtgttcatgatgtttatccttgccttgaggcttggaggtccaggaaaagggctgggtgtgtaaaaggttcactgaagtgtttcatatttaatattggaagtctgggggccaaggggtaaatataggagtgggtgtcagggtaagcttcaagaagggtgaacctttgagctgagctttcaaaagggattcctccagatggccagaggggtttcttctgatggggtggacaaggtgatgttaaagggaggaggtggtaaagggcaacttggtaacagctatttgcccccctcctcccccccccctttttttttttcatttttgagacagggtctcgctttgttacccaggctggagtgcagtggcgcaagcatggctcactgcagcctcagcttccccaggctcaagtgattctcccacctcagcttcctgagtagctgggaccacaggcctgtgccaccacgcccagctaatttttttgtttttggtttttgtttttttttaggtctcactatgttgcctcggctgccttgggtgatccccccgcctcagcctcccaaagtgctatcatctcctttatgacattac

SEQ ID NO: 13335 - DNA, 87567 bp, Human
agatttactgggcaacttgtattttatctggccatcctattctggctcctcgctgtgtgctatgtgccacagaagattccactaaacactagcctgcttttattttacatggaacattttgtttttagtcctgaataaggaagtacaatctctttattgatctaacagaaggagaaagtccatacaaacagcagcttgttaagaggagaatggctcccagggttagataaacacccaagacaaacgccttttcctgagctcaaagtgcgcttgttcttgaactttccttcctgggcctagaggtgggcttgatgggacctatcaccctggtgctgctgaagatggcaggaagagaaatgctcagcctgggaggaaaagatttatgggaatgtgggcttagtcggtgattcatccattcattcagcctcacccaccagctattggcagacactcagagatgaatggcaccgcatcctgtcctggaggctctccatagatagggaaatgaattttggccccaggactaacaagtactgcctccttccaaatctgtctccatggttgaatgcaaaaagtacattcctgtccctgtcttttctctctctccctttctccttacccattctttctcttttttctcatctcctctctcttcctctctcaccttcccagccatttgtcaccttaaacctaattaccttgtccaactagtagtgtgaaaaaaacaattactggttcactcaggccacggacctggtcttaaatgcttttcctttgtctctccaagaccccacttcctccacatccagaactatccgacattttccagctcagcctggcattcatttgcgttcatttgcatgccgttctatgattggctgatacaaagtggggggcgggggtggacaccgtaaacctccattcctcatgcatttaatataacatgtatgaaaaaaagtatctatatttatatctcgtttaagaaaaaaattgttcaatgatacttgttaaagcacaataaggaagacttaatcaggacaattcaagtaggtatagagaccactggaactgtgtcttgcaattggtgaaaactgggctcaactctgaatacaacatgggcaaatggaaatttatagccaggaagcagggtggggagcagtgcatgaaaaattactaagaggaaacatcagaggtaacagtagattcttgctgaagaggccagggtgatcagacatcaactgggggatggtggaggatgaggaacacatcagatatccagagtgatcacatatcaaaggtggggattcttggtaacttgatttagcagggttttttgctaaaactggatttttacaggaagtacacagattggcctaggagaaggttcaggagcctgactaaagtttgctcaagcaaagaatcttcgtcaatctgcataggaaatatctagaaggctatatgccaaagttaatggtgcttctctccgaagaaaaagaaaaaccgtgcattaaaattttaatatgaataaaagcaacagctcccatttaaagcccagaggtcctgtttggaatctgactcgaaactctatccactttttcgggcgtaggcttctcttgtgtaaactgacaatgataacatctacctcccagtgttgtgatacgggagacataaagtaatggatataaaaacttctgttcagagcaaggacggatagtcactgcgattagggtgggcgacccggaggggggtcatgagcctagaccttgacagatctggtgaggtctggatttggtttgattcctggctatcttttcttaatattcaactggctctacgctttttaaccattcactttcttcaaggtaagtgcggcagaagcctggcgcatgcgcagtacaagcccttaagcggcgccccgcccacatactactacaacttccggcaggctccgcgcccgcctctggcgcgtcgcgggctgctgacgtaatgcggtagcgcggggaatttcgagtggtgttggagcgccggaggctagtgggtggctgacccccagcatcctcgagagcgaccatggactccctggccgagtctcggtggcctccgggcctggcagtcatgaaggtgagtgcttcggggagtttgggagctcccgggtgtctgcggggggaggtccctccctttgaggaggatgtcctcgccttaaggagaaaggatgaggcgcgagcgtcgcactgggcccgggtatccggctctgccctgccactagccgaccgcgtggctctgggtctcagtttactcctctgataagtgacaaggacaagcctggtgagctgaggttggcagtcttatggcaccagctattctgcgatccaatcccaacaataacatggagaaaaacagttattccaaacaatgacatcgacagctgttctttactgaaagcttactttgtgtcaagcactaaacagtgacaccggacatgattttgggtggacactttatcagataacatgtatgtaatcacgtagccaagcaggtagtctcctttacaggctctttcatttcttctgattattctcaataaacgtagtgctcgtttgttctgacatactgccccaactcctctctaacacaccttcactcttctctaacaattgctcatgtctcttaaacagagatcaggactcaggctcagcgctgatcttgcattgcatctgattatttcacttaaataacatttatttttgtggccactttctgttttggcaaggcataccagtttccatttacagtagtggtgggccctggatttgctcaagagcagatgcactttgctgtgctggataaagatcagttgcttggtgtttcttcttgctctgtgattatttccgtttctcacagtggctaagatagccttcttctccctcagttttgtagacttggggattataatacctgtcccactgactcataaatttgactttagaattaagtgaaggctaaagtaagtagaaggccttgttcttcctgctgtcatcagtgacgtctagagtgcttggggacttgagatatctgcatgatgagaagctgacattgtgaaatgatccaggaaagctgtagttttggagttgtgggcttggcaccaggatgcagtggagaagagcacagatttgagttccagtggtcctgggtgaaatctcctgtctgcctcttgactgtatgaccttcggttagtaacttaacctctctgagcctgaatttcttcaactataaattagagacaaaaataacagttcataggattgattaaataaattagttgatgtatgtgggcacagattctgccgtgtattcactgtgcttactgcagtgcctgacaccaagtgggtgctcaaatattatttgctgcttgattgaaagtatctggaatgtagtaagcattcaatgaatatattttattattattagcactgtgttaagtgcttctttccccttttaatttgttgtcatgaagcttgacttggataaggaaagtaaaagagctctgtaacctgtaaagctcctgctttgtagatttaagcacactttacatattcccacaatttcagtgttctttagaggcgggttccatgtcttctctgactttggtatctcaccacagcactgaatgtagagtttggcaccacagagcgttcagtgagtgttcaaccagagagttgattgagcccgtatttttttgctcacattggaatcatggaatcttaaggttagaaaaccagcccctttcagtattttaatctcctttataacacatctgccaatttctcacctaatttttgcttgaactcttccaggcacaaagaactatcagatcccagaagcagatctgactgaagttacttcttttattgaatagaagtctgactcagaatccatggttgctaacttaggattcacagaaagactttggagtctcaagttatttgtaaaatttttgcatgtatgtttttctgagcagagagtccatagttgtcatccatttttcaaagggatctgtaaccccaaaaacttaagagtatttttgtaattattacgtttttccacccattttctacttctccctttcactttctctctctctaaactaaagaaattttggggagtctgctgaccactctctattcaggcatcattttttgtttagttggttgaggcgcatgtgatatgcatgttactgtcttggagtgacatgacaagaaatttgaaccagaaatggctcatctgatgtagtgtcaacttccacaattgtgctctgcagatctttcagaatcattcctccaccagaagaggatggcatagataagaaagtgtgatataatagactggttctggcttctgggcctgcctctgctcttaattgatcttgaacataaccctttagatttttgtgtctgtgacagcttaccatccacaataatggaagattttggcattttattatttccctggttttactttaacaaaaatttactgtttttggcatattgtaaatgtaatatgtgtacacggtagaaaaaaattaaaattcagaataagataaaggagaaaaataaaaccatccataattctaccacccagagaaccagtgtttaacattttaccttattttcctttggtttttgtgcatttaaaatttgggatcactgtggagtcaacttcttgggtttgatccagccaacttaggaactctgtagactttatttttaaaattgggatactgatgctgtggacttcataagattgctatgaagattaaactacagagttgttattattatgtattattggcataggtttgttttctgatttttattttcctagggcattaattattctttgaaagcatgttttttaatggctgcataatatttcatcatatggaccattagcgacattagtccttttttgtttacatttttaaaattcaggtaataggttcacatggttcaaaatacacataaaataaaaagtaaaagtctccttcttaccatgttcctggccctgatcattatttatgacttcttgtttatcttctcattatttacatttacaatgaaaatagaatgcattcttttttcctttttttcttttttgagatagggtctcactgtcgcccagactggaatgcagtggcaatcacggctcactgcagccttgaactcctgggctaaagcaatccttccgcctcagcctcctgagtagctgggactacaggcatgcgccactactcccaacgaatttttaaattttttatagacatggatttttgttattttgccaggctggtctcaaactcctggactcaagcagttctcctgccttggcctcccaaagtgctaggattacagagccaccatgctaggcctattagaatacattcttactcacctcttccttttaaacaaaccgtagcatagtatatgtactgtctataccttatttccttttttcacttatcttggcaatcttttcatatcagtatgatggagagcttcctcttttttttttttttttttgagacagtttcactcggtcatgcaggctggagtatagtggtgcgatgtgggctcactgcaacctacgcctcctggactcaagcgatcctcccgtcgagagcttcctccttttaaaaaatatttctgttgaatggaataatattttattttaaacaatttgaaagattttaggttgccagagtagttccgttcctgtttggattgcattccaggttggcacacatctctctttccaagttgtccactttcccttcctctgctttcactgccccagctctttccaggcttcctcatttggctgcatgtgtagtaccatgccgaaagcactggactgccagacgggagacaggaattttggtcttggcttgactgatgcctactattgtgtgcctgcttttgataccagtttcctcttttgactagacagtttctggagtttggctttaacattctttgatttgattcttaacttgtgtggtggcaatggccacctttcacccaatagtgactataggctaggtgttggagtctgaagaggaggaggcttggagtaagagctggaagcgcattagaagtggaacagaagtacagtagcccttatgtgaagggatgacaatatggcacaagaatcggtgtgccatcatctttagctgtctaaagcaatttgggcaacctgagactgaatgtataagagtcatatgagagaagtttttatttatttgtcaagatcccttgcagtttatctggagttagcttttgaatttgtgtatttgacaaagagtttgattttttttttaggggatagagaaaaagttttgtgacaggacttccaattttgatgtctttctgatatgtatatatgcatatttgcatttcagacaatagatgatttgctgcggtgtggaatttgcttcgagtatttcaacattgcaatgataatacctcagtgttcacataactgtaagtatgttttgttcctgtgagttagtaaattgcgatttttacatgaggtagtgttaatttaacaccaaagatatgtgcacatatttatgtttcacctttagctcttctatcttgtagtttttcagaaggtctttttcactgccttcctcttgaatattgaaggtttttacaaggcttctatattttctacctcgttcctctttgatatttttatgattcttatagcatttatggcagtaaaatttttggtcacaataagtggttctttatttgccaagtgttttttgacgttaagtttcagaatttttgtttttaacaggataacagataggtggttccaccaagtagtacttgatatagaatttcaaagtttaaaaatctgtaacaataagaatattgccccagtgggagaattctaccactgactttattacagacagttttataccttaactgctatgtgacgctggaaagactcatgttggaatttgtttgtacttctctttaagagtctagtatataagcatttaaaaatatcgtaccttaagatatttagtgcataggggttaccctatcattgttgaggagctagacatacagtttatgggttattcaggttcatgatctttcttgtcctctattttcaagttgatttatcttggaaagttaaaaacagtcaacttaggcctaagaaattggttttagttggtagtagctttggtggaaaagtttctgtggagaagacatagtaagagggtagcagtgacggcagcacgggcattgcagatgcccttgggcttgactcttgaaaatcgggtgagaatttactactttagaaaatgtttgtgagaattaaatgtgcagaactcactgtccggcacattatgagtccttaacaatgttagttttcttccagacaagattcacattaaaaaccaagataagttttggagattgttttaaaatatattttaacatcatctttatttgggtgtaatttacatacaataaaatacatccattttaagtgcacattaaggtataaaagtgttcatgaattttgacaaatgtgtatgctgtgttactactgcaattaagatactgaacattttcattatctgataaatttctccccatctcagtcagtatgacctcagctagccatctgtagtctatttctggactcttctattccattgatcttagaaacttagtagtttttcaccaaaactactgcccactaaaaccaattgtttaggcctaagtttactgttgctttagctttccaagataaatcaacttgaaaatagagaacaggaaagagcatgaacctaaataatctgtaaactgtttgtctaactcctgaacaatgataggataacccctattgcagtaaatacctcaaggtacaatattttaaaatgcttatatgctagactcatatatgtctatccttgtgccagtaccacactatcttgattactgtggctttgtagtaagtcttgaagtcaggcattgtaagtcctccaacttttttttcttcgttttttttaggatcgttgcattttaaatgcatttccatgtataacttaaaatcaggttgtcaatttctaccaaaagcctgctgggatgttcactggaattgtattgaatctagagatcaatttgggagaattgacatcttaacaatgccgagtcttcagtgtatgaatatgatacacttctctatctttatttctctcaacagtgttgtttgattttcattgcacagaccttgcacaaagaaatataacttatattgacctttcgtcttctgactgcagtaaattcactttaattccagcatcttttttgttgattccttagaaatttttgcatacacaatcatgtcatttgtggataaagacagttttactcattcctttctgatctatatgcctttatgtttctttttgttacacaggctggtacctcaactacagtgttgaaagtggtgtggagggacatcctgtccttactcttaattttttggggaaagcattcagtcttttaccattaagtatgatgttagctgtaagttttttttatattcttaatatgttttcataaacctaccaagttgaggcacttctctacccctggttaggcgagaggatttttttttttaaatcatgaatgggtgttgaattttgtcaagtattttctgcagttatggagatgctcatatgattttcttcctttattttgtgacatagctaataacgttgtttttgttttgttttgtttgggagacagggcctcactccctcacagtggctttgttacagactggctttgtactgtagtccccccttatctgtgatttcagttacctgtggtcaactgcattctgaaaatactaaatgggaaattctggaaataaataattcataagttttaaattgcactctgttctaagtaaagcactgatgaaatcttgtgccgtcctgcccaggatgggaatcatccctttgtcaagtgtgttgatgttacatatgctatctaccgttaatcgtttagtgaccatcctggttaccagattgactgttgcagcatggcagtaattgtcactgtgttgcagaacacagtaattgtgtcaagtagcgcttattttacttaatagtagccccaaagcacaagagtaatgatgctggcaattcggatatgacaaagagaaaccataaaatgcttcctttaagtgaaaaggtgaaagttcttaacaaggaaaggaaagaaaattgtatgctgaggttgctaagatctacagtaccatctacagtacagcacaagatattttgagagaaagaccacatttacataacttttgttatagtatattgttttaattctatgttattgttattgttcctaatctcttactgtgtcttattaataaattaaactttatcataggtaagtatgtataggaaaaaacatagtataaataggattcagtactacctgtggttttaggcatccactgcgctttatggaatgtctcgcctgtgtataagggggcactaccatatagagaaagatctttactagtcagcttgactgcagattctaggggcttcgtaagccttttctgtggatgtgtcttccctggacttgtgattataaatttccaagccgagagatttggtcagttttttcattagctgctgtttttctctctcatgtgtctgtccatggtattgcaggttctccagagttgctgtaagccatcagcctctttttttgttttcagctgccctcaagcatctaaagtatgctgatccaaagcaccccaagttgagtgagacagaaaccattcccttaggcagtcctttgaaaagttcaaatgttggtcacacactccactattctctcccagcctcccctcccaagataagccgcagagctatatcagcctctgtctgctctatgggtcctgtggatcagtagcaagcaacccagcttttttttattcttagcagtccccagtcacctagaacatgcagggttcatgcttagtggggtgagacagaagccagtcctctggccagctcttggaaaagctagaacattggaccgtgtttcccttctttctctccccaggcagaaagttgggggtttctcttccttgctgagcctgggggaggcacactggccagtgagtgtggtactagtccagacctttgcttttgttctcagtggccctcaacctggttcccttttctgtcagtgtatagattcaggcagctcagaaaccagtttctcaagtagcccccgcaatgtaagtgctagtcttctgtttctctccctagggatacatgttgtttgctcacttcttcatgacttatagctgtcacttatgccattctttaagaggaagtcagtggagggaagtttcagtaatgatgattttttattttatgagcacttttttttcacttgtgaagtctcagtattcagtaggcctcttctactaaacaccagttgtcacaagtcccgtcatgtctaaaatttgctctgggtctttagtgttttaatgacacaaaacccccagggctgtagtggaagccaggtctgtcatgttctggtatcatcttggattgactagaattggtgatccagaatcctaggtatttattgttgcttcttagatttttcatgatttatcatttttaaatcactttattttgttttgttctgtttaggtttttggatatgagtaataaacactacatttgtagttctgcaggtacaaaggtgtgagtggggtgccttggcagaatgcaggtcaattaaattgatccaaatttgtgctattaaagagtattttgggggcgagagggagcagacttactccaacccataaaacaccattaagtgagaaatggtcttgctaatagactaatatgcccaagtgccaattttctttgcacttgctataatttttctcacttcataatggaagatgatcaaaatatttagcaattggctggctttcaaacatcaaaagagtctagcatcttaatagtaaaaaggaaatttctaaaacttaaatgaatccttgtcatgtgaaatcttaaggactttatgaaagaaggaactttttagaaagaaacatctaaagtgtccagttaaaagcaaaaaccagtgtgaaaagaacaggaggtccaagaaagctgaaaaggttggcatctgcctccagttctaatgttaagggacagttagttggtaagagaataacatccctccaactaaagactagcatttcagaatttccagaagtgcagctctgcataattatatctcccttttgtgtgtgtagctatttctcttctcctctgccttgtttcacagtgctacttcatgagaatataaaagaagataaacacgtttattatttgcctaatagaatcttatgttgtctcttgaattagcaaaggtttcgtaaggggaacatttcatatttcagtttgttttaaaaaatgaaataaaattgctttttacttctacacaagctttgattaattttttttgagtcaaaatccacaaaaggaaaaaaaaaaaagattgctggccaagctttaaaatagtggtaatttatcagtgtccacaagccaattattttatctaggatcttgcttgggattagagatgccccctctcccaaggcttggatatttctgtgaaactactctttaattcattgttgttattgtaccttcctccactctgcccacacatcttttttgggctctcttggatggaaagacaaatttcataggtgatttaaatgaagccctctgggaatacatgaattcaaaactcttcagctgttcttctttgaatggaagggttgtcatagttgcccactagagaataaattatgctggtctgcagcttaccagtacatatttggtagtagtctagtagagtgaaattaagcctagggcttgatctacttaggactccatatctggttctcctcatttcaaaagaaaagaagaggaaagatatacaagattatgcagaagagaaagcagtagccttattataaatactaatttaaaaggtacatgtgaccttattaattaaatgttatttattgatgtatacataatatatataatgtatacttatataggtacaattacatatataataatgtatacactatattgtataagtatacattatataactatacatagtacatatttatataagtatacattatagtataaatgtacagtatatatttattataaacaaatgtttatagatatagtcagtccctgacttaccatgatttgacttaggatttttcaactttacgatggtgtgaaagcgatacacattcagtagaaaccatactttgaattttgaattttgatcttttcccaggctagagataggtatattaaatacattttggcttatgatattttcaatttatgatgggtttatcgggatgtaatcccatgttaagtcaaggagcatctgtaatttttaataattaatatattaagagtctggactctggtgctttcctttgccacatattagttccattatctttggcaagttggctgagccctgtgcttcatttttcttcttgtcaaatgtgactaacattggtaccaacctcagggttgctgtgaggatcgaaagagttaatacatgtaaagtgcttagaacagagcacatactaagtgcagtgtttatttgaaccacatgaaattgccaatatttgtccatttttgacttaaccaaaaatgtcagtttcatataattcaacttaatagtgacaacttattaattttttaaaaattgttgccattgttgaatcaatattacatattaagaatgtgatttactgaccaaaatccattgaatcactatgactggggatacagcctgggaaactaagttaaaaccagcataaatctccctaggtgactgagctgagcagctaggttttaggatttcttgacttacagtattgctcaggagacttcttatagtataaagagaacagcattgataattaagagaatgagtctggacaggaatttttgcctcaggatgattcataccttgagtctcatccatatctgatttaggtgatatttagatgagactttagattttagactttagagttggtactggaataagttaagacttttggggctgttgagatgggatggatgtattttgcatttgagaagaacatgaatttgggaggttaaaggtggaatgcctggagtgaattttatcccccctaaagtcctatgtcgaagccccaaccccaatgtgttggtgtttgaagatgaggcctttgggagataattaggtttaaattaggtcctgacagtggagccctagtgatgggattagtgtccgtatgagaagagataccggagcttatggtcactcctcaccccctcatgggaggacgcagtgagcaggtggttgtctataggccagaaagagagctttcagcataaacttaccatattggcaccttgatcttggacttttagcctccagaaccatgagaaaacaatttctgttgtttaacctgcccagtctgtggtattttgttatggcagctcaagctaagaaatgctttcctgtagtcttttgtaccattgctgtcattcatttcacttatgcataagcattcataagcgtgcatttttatacgcatatacataataagcatctataattgaatacttcgttattatttttgtacaaagtgttatctgttaaattaacaagaaaaagtttttattacagtttcacatattccttctccagtactcttcctttctttacgtagattggagtttctgacctaaattattttcctcctctctgaagaatttcttttagcatttcttgcaagggaagtctactgaaaacagattccttcaatttgtgtttgtctgagaaagtccttatttctctttcacttttgagggataatttctcaggatatagttttaggttggtgatgattttctctcaacactaaatatttcggtgcactctctgtggtttgtgagaagtcaggtgtcattctttgcttctctgtaggtaaggcccccactacagcttctttcaatattttttcgttatctttgattttatgtagtttcaatatgattggctgaggtgtctatttgttttgtttttgcatttatcctggttagtgttctccgatcttccaggataagtagtttagtgtttaacattaatttggagaaattcttagccattattatttcttctgctcctttcattcttccctttctggtattcccattatgtgtatgttacatcttttgtagtcatcctgcagttcttggttattctattccatttttcctgtctttttttctctttgcttttcagttttggaggtttccattgacatgtcctaaagctcagagattcctcagccgtgttcaatctattaatgaacctatcaaaggcattctgttatagcggttctttttatcgctagcattcctttttgattcttccttagaatttccacctctctgcttatgttcccatctgttcttgcatgttgtctactttttccattagagcccttagcatataatttttaaaaattgctggtccgataatttcaacatttctggtatatctgactttggttctgatgcttgctcagtttcttcaaactgtgtgtttttccttgtggtttttttgttaataactggaaatgatgtcctgggtaaaaggaactgcagtaaataggcctttaggtatgggcagaggggacacattctatagtcctatgattaggtcttttagcgaactttgcccctggactgtgaatgttactaacgctcctcagttttcccctccttagatgggacaggatggctagagggctagagttgtgtatttcctttttccagagtcagctgggctctgataaaactccagtagattaggctctgtaaaatagtttcttctgagggagggctttgttgagaacagactactctgggccagtgcagtggctcagacctgtaatcccagccctctgggaggccgaggtgggcggtcacctatggtcaggagtttgagaccagcctggccaatatggcgaaaccccatctctactaaaaatacaaaaattagctgggtgtggtgtggtggcgcacacctgtaatcccagctactcgggaggctgaggcgggagaatcacttgaacccaggaggcggaggttgcattgagccgagattgcgccactgtactccagcctgggtgacagaattagactccatcttgaaggggaaaaaacaaaacaaaacaaaaaaaacagactactctggcttatttagaaatggttacttttaccctcctactcctggaaggactggggggtttttctccaatattcactgtgagaactttgaagaactcctggaactaaaactcacagaagtgtgaggacatcctctccatgcctgcaatgacagggttccctggagtttttgactctcagacttgcccacactgagccgccagcaattcgtcaattacagctcaggttctcccaccccagcactggttccagcacaggtttctcctctggttcccatggaggtttctgtttgtgggtttctgttccagtaagttgtgattgtctgtattacccccctctctctctccagttcggggagagcagtttgccctgtgaccctgcttttctgctggatctacgaaaagttgttggtttttcagtttgttcagctttttacttgttaggacagagtggtgacttccaagccccttacatgctgaatcggtcccctgtattcatctttgcttcctaaaagaactcaacctgttgtctgttttatccttttcataatatgtttctttgtttttcctcctggggtgctcttacttaggctggcaagacttgcttatttcctggatatccataccattgaaattatgctgtctcctcctcaactaaacgaatcctgaatttatacagtgtactgaaattgtactgtctcctcctcaactaaacagaatccagctgaatttgggctactagtaaattagcttaggtaattagtaaggtaccattctgttagtcacatctgctttgtctttgactgggagaacatttacactgccttgagtgtggtgaatttagtttgtgcccatttcctgcttaaattgttaggatatattatgcggaattatgctgtaattgcttcactattttattagctccttgaggtcaagaaccttcctttatatatattgttcttagtgcctgccacaaaagtgcttgttaaatgtgggacagaggacattatttacagaattaagatatagaagtccctaatgtgataacctggatatatattttttcttaatatgtgtatatatattatttcaaaatttatattttcaaatgataagcagtagagatatctggcaggtttatacagtacccagcccaagtgtatgtttcctgtgttttgcagatggaggacacagagtgatgtatgttgcttgtgtagttgtggtatcctaaagacttacaatatttatgttttcctttccttaaaatgctgtttaatcacatgtgtaagtgtgcatagagtagaggtactagaaatttaagcttatgatgatataccttagatgacggaaatagtctagggcttaagattttgttagaagtcatattcctgtattattaatatagcttaattaacattatgttgcactttgtgttttgcagactgctctctctgtataagaaaatttctgtcctataaaactcagtgtccaacttgctgtgtggtgagtttttgtttcctttttttaaaacttactgactgctgcaaatatttctgctttgtgtatacgtaaaagcctgtgtatatatagggtgatgtgtagttactgaattaagctatatgaaagacattttcagaaaggacctctaaagtacatgtaagaagagctgggctttgttcagtttttttgttaagatttctgaaaacctaaatgtattttaggaagtagcactctttaattcttatgacccatgtttttatggcttctcatttttaataatttctcactttggtagaaactctggtggtatgattattcatttgcaaagaactgtctaagtatttgtgcagaaggtaaatatgcatggctgttgggcttaatccggcctatctgttcccttacatctttcccctaccagagcttcagggaaaaccctagaaagtttgttgttattgtttctgaaacttttcaagtagtgggaacaggtggaaaagtagactaaaagggtaattaaacataagtgggaataaagaaagaagagacaagtgaggtctgacagagccgacactaggactaggtaaggagtttggttagttttgcctctctggtaggtatgtggtgtcagggtgtcactgaacatttcgaactatttctctatgtaagaaattttgtgatttggctcttaagtctaagatctttacgatatgttacactgcttttgacaagatggtctcatcgctgagataaactgtgtaccattcatgccaaataagtactgggtttgtcacttttctcttgcattcctgaaaaccaatcttactttaaaattctccttgaacacttagtgcctctcccagtgttagaacttaaaagaacatttctcttctgtttttccggagaaatttctgagaaagctgagtgctggcattttgaagaaagattcttgcttatattaggtttgattgtagtcagtacagagtatatatgattataagagaagctctggagagcttttatcagacttccagtcagcagatactgattcactgttttaaaatttcatattagcatgagataaatgaactttattttgaggctgccttagaagacttagtgggatggagaacctcaggaggatgggtcagacattttcaaaaacaagattatgacaagttgattattgtttttgacctttttccatctgttgtttgttttttctagactgtcacagagccggatctgaaaaataaccgcatattagatgaactggtaaaaagcttgaattttgcacggtatgatttaattttgtgactaacctctaactacttttgccttttatatgtgttctctctttactttgtgcacctttggattagggaatgcaggattgcatattttatagtcaaagaagggaagtaacagtcattattcacacatggaaaatttactagagtaagattttcttcctttacttaacagaaattctcctgtagtatagaataattaagagttaaaacgcagatttgaggacttccttacttttgggtgctctgaagatactccttttcctgcccaagccctagaatcagccatttctccaaggagctcctcttcttggagaatagtatttagagaccaggatctggtgctgggtatgcttgttgctactggggtgtcattgcttctaggccctctcaatggacagagctaagtaatatatgtatgttatatatatgtatgtactaactcatgtatatacacatatctataattgattctgtctgctatatattaatctattaattcttaatcggatttattcagcatgtattaaatggtatggcatttgaaatatgtaattgcttgtactttataaagctcagatatgcaactttacttcctgtcaaatgcatgaatgtgtgaaagtgagtttggtcacccaaagggatatgaaaaggcatgtttcaatatcttggattacttttagttttaatcttgcaagtcaagcaagaatttttatgaaggacgtactggtttagatagtggtcaggtgcccctgtagttaagtgtaatcatgtgttgcttaacagggatgtgttctgagaaatgtgtcattaggcaatttggttgctgtgtgaacatcatacagtgtacttacacaaaccaacatggtatagcctactacactcctattctatatggcagggcctattgctccttggtaacaaaacctgtacagcatgttactatagctaatacggtaggcagttgcaacacaatggtacctattagtgtatctaaacatagaaaaagtacagggaaaatatggtataaaagataaaaaatggtacatctttatagggcatttactatgaatggagctttcaggactgaaagttactcttgatgagtcaatgagtgagtgataagtgaatgtgaaggcctaggcccttaccatacactactgtagactttataaacactgtacacttagactacacactaaatttataaaaaagtttcttcaataattaaccttactgtaacttttacactttgtaaacttttatatttttttaactttttgactcttttgcaataacacttagcttaaaacacaaacacatcgtatagctgtacaagcatctttctttatatccttattctgtgaggttttttctgtttttaaaaattgttattattttttcctttttaaactttttcttaaaaatgaagatggaggccgggcttggtggctgacgcctgtaatcccagcactttcggaggccgaggtgggtggatcacgaggtcaggagatcgagaccatcctggccaacatggtgaaaccctgtctctactaaaaatacaaaaattagctgggcatggtggcacacacctgtaatcccagctacttgggaggctgaggcaggagaatcgcttgaaccagggagttggaggttgcagtgagccgagatcacgccactgcactccagcctggcgacagagtaagactccgtctcaaaaaaaaaaaaaaaaaaaaaaaaggaagatggaaacacacacattagcctaggcccacacagggttaggattatcaagatgtcacttagcaatgggaatttttcagctccattatcgtctaatgaaaccaccactgtgtatttggtctcttgttgaacaaagcatgttggaacattctatgaggtaccttatgttgcttttaaaaatataaacagatttctttcaatagaattacacatttctttattggtttgcattctaaaaacgatcaaatttagtacagttgtctctcagtaaaggggattggtcccaggacccctgagaataccaaaatctgtggatgctgaagtccctgacataaaatggcatagtatttgcatatgcacatcctcccttatactttaaatcacctctaggttacttatagtcctaatacaatgctatataaatcgttgtcatactgtgtttttaaaatttatattatttttcattgttgtattgttacttttattattttttgaacatttttgctctgtgattagttgaatccacagatgcagagctggtggatgggaagggccgactacagtttattgtttagccaaatggttctagactgctgtttacatgtttctgatcagaacaagcattgcaggactttagttacagaagtccatggaattgattgcatagatttaatggctgcccatgtctacccaaaggcctattttgactcttgattcttagccccattctgaagaggtaaggttattgtatagttaacagatggacaagacttttccttccttccttccttcctccctccctccctccctctctgctttcctttcttcctccctcctttcctttctccctccctcctcctttctccttcccctctctattcctccctcccccgtctattcctccctccctttccttcccttcctccctttcctctcttcttcttgctctgttgcccagactgcagtgcagtggcatgatcatggttcactgtaacctcgaactcttgggctcaagggatcctcctgcctctgcctcccaattagctaggactatgggtatgtgccaccatgtccacactgaagaaataaacaaagcttccttaaatatgtggtagaatttaccagtgaagccatctgggcttggagttttctttgtggaaaagttttaaattatagcttctgtttctttaatagataataagggctcttcaggttttctgtttctttgtcagttttgatgaatagtgcttttcaaagaatttgtccattttatctaaaatttaaaatttgttgttttaaagtgttcataatatcctctaattatcttctttataggatttgtaacgaggtcttcttttaattctttgttttggtaatttgtattttctctcatttatttcttgttcagtcttagtagggattaacagttttgttaattttttcaaagaaccaatgtttggctttgcttgttttctcttgttatctcttctatttcactagtatctgttattagtttctctcttctttgggtttagtttgctgttcatttcctaaccttttaagttggaagcttagagtggtggtttttactttttctattttcaataattttccctccagggacagttttggcaacccttcatgctatcgttcagtttagaatatttttctagttttcattgtgatttgacatgcggggttatttagaagtgtggtgctttatttcttaacatttggagattttctagttatttttctgttgttgcgtttcatgtaaattcggtagtggtggaatctatgggttgattttttttttctatcagatttgaaaattctcagccattggtttttctagtattgctgatttcccattctttctttctgttccttctgggcttttaattatgcccaatatctcatacttttttgtgtttgtctttttcattcatttttctctctgtgcttggtttggatattttctattgacctgccttcaagtttgtattgtgtgttgttatactcatccaatttagatatggtattttgcagttgtagaatgttcattttattcttttttatggattttatttctcataatacactatctttttatcccttttcttttttttttctttaacatgtttatcatagtttgaagtccttacctagagatgctattctttggattacctctgggtctgcttctattgaatattttatctcttgattagtggctactttttcttgcttctttgcatgttcaataattttaaaatatgtgctgaacattgtggttgaaacgttgtagaagctgtgaattgtcttcttttgaaagatgtcacattttgttctaagaggcagttaaattatcagctcttcatctttgttctgtcaaggcctggtataatgttttcttaggttaggtctgtttgagctttgtttatatttcttcagtgtggtccatttttctaaggtgtggtctttgtggggtgtcacttgaatgtccatgatcttaccaagatttctcagctttggctgggctccaatgcgaacaactaactttccagcactgacgtttgggattttaatttaccagtatcagcttcctagtgggtctcctgtgtttttgtctaatcatgtgcagccctggaaatgagcaggaatggatgtgaatttctaagcagactggtggggttccctttcagtagctaccacgtgtcaaagcactctgacccctcaatcctggccagttttgttcagaactctgatctcttattttctctaacaagtaagatcaatgtttcctgtttagacttcactttagtacccattcctagaaaatgctcccagggtaaagtaagtcttgggggaaatgttggactacttcatgttttcttctttttcagggattgcagccttgtgttgatttcagtccagtgcctacaaagagttgttttttatgcaagttaggccattcttacattgctataaagtaaacttgaggctgggtaatttacaaagaaaagaggtttaattggctcatggttctgcagctgtacaagccatctgctcggcttctagtgaggtcttgggctgcttacagtcacagtggaaaacaaaagacgggcagcatgtcatgtggtgagagtgggagcaagagagacagagtgggaggtgccacacccttttaaaacagatctcatgagaactcactcactgttacaaggacagcactaagggaatggtgctaaaccattcatgagaaattcgccctcatgatccagtcaccttccaccaggtcccacctccaacactgggaatcacatttcaatgtgagatttggtggagacgacatccagactatatcagtatattttgttcggattttaaagttacttatggttggagattaggtctcatataagctgttctctgtggcctaaagctgatttcctttcattttgttttattgacacattaactgccttttaagttagatttattgctttgagttatactagaagaaactttggtttggttgtcattatagtataggtcctgtatttcagaaaacaaggttaattgggaaaacagcttatgtcagttaatttatgatgtaaaattggatctcttaattgtctgttgtgttctttgtgcttcaaggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaaggtaggaagttattttcatatgtggaaatatggacatcttttcatccacatgacataagaataaataggcagcatctttgagggggaaggaatggtaaaggacaaaccagattttaccatatcacaaacctcagacattgttgtagatatgtttgttctctttctctctcagaaacaggaattcaggctgactgctacaaaaaggaaacaattttaattagttcagccttcaagtatggcagtagctttctgttttcagcttttaatctttcttcccctcattcaacatatcagttcccatttaatcttgaaaagctctttttatcttattttaccaccacttgaatgcctcctcactgttctgcctgccatataaagcctgtgacaatttgaggcctaacctagtcatcccgccttattgctcacctctctgtctcagaagtcctgctctagcctccccactgttcctccagtacactgaggaattggcaaactacaactggcagatctaatctggcttgccacctgtttttgtaaataaaagttcacatacccaccctattctctgtgactgctttcattctacagtggcagagttgcatggttgtgacagaggccataggatccgtaaagtctaaattctacctggcccttcactaagaatgtttgctggcccctgttctatacctttccagactctatccagatcctcactattcatttgttatgttagaaaacactgtctcacatcacaaaagtgctatagcacttgttttctggactgttttgtatcccatttgcttaactgtttgatgaatatgtcagcttgtttaactttttgtttctgtatcttctttccagtgaagtttagagcaccttttaggcagaaactcttagacatctttggtatacccataccacacgtagtgcagagatgtgagtgtgtattaaacttagattgaaattagtttattagtacttaacgtgtttacatcttttaaagatatataaatttcacttatattttctactatgtctatccttagtctttttaccaattgacagttcttattgtagtattttttagcttgatggttaactgtttttcccctagcggaaccttttttcccaaatgaaattttacgataaaccataacgtataaaatagataaaacagattgttctgttccacctgacctccttctgcctattatccatggtggtctgtaggccccgagatacccccacagatccctgcaactttatgaaatagtttgagaatgactgtgttccttaattttaacattatatatggaatcatcagtgagagctaaattaacaaatttgtaaccattgacaaaattgaactcaataaattattaaactacctttccttcactcggcccttgggccaggtgtgtcttacttaagtcgttactattgcttctgggctaaacatggatagctcctaagggttgggaaaatttaagatgagttctatagtttggtcataccttggtagaaaagatgtaaccgaaacatttttaataaatgaactttcaagcttatttgcagtctctttctctgggaccaggacttcaattttgtgacttcccacaatttagccattacccagtaaccagtctgtcccactcctgttgtcccgatgggccattctttttcttttctgcttttctaagtgcatgttaagttgggattcttttttactttacttgctgaaaagatgccagtttacatacttttgccccttctacaattaataaagtctctctttttctttttaaaaaatacagtggattgtcctgtttgcggggttaacattccagaaagtcacattaataagcatttagacagctgtttatcacgcgaagagaagaaggaaagcctcagaaggtaaggaagttgagcagaaccattgagctactttagctgggtgcctcttgtgcttacttgggggaaaattacagtattccttttatcctggtgaccgtatttcctgctcttacttgctttcttctttactcctgttggccacttcttccaatccctctcctctgttctttcttcaactcccactttgccaaatatgattagctatattgaatatttgaactgctactaaattttgacttaataagaaattagtgacttcaaattcaattctttttaaacttgtttttttctcttagattttaaaaactaccaaaaagcctcttggccaaagaaagcaagattagactctgaatataagatataaaaaacctttctctgatctttaggatgctcagaagttttaaaatttaaaattgaatttttcaaaaaattttgactaggaaattatataaatatatatgatataaaaaggtacaaaaatgcatatatgaaatgtaatgtcataccccacaccacccccccatcctccaggtattgtagctaataaattgtcagctcagtatttacatctaaacaactgtgctgttctacctcccttgtacatgaaaataactgtaatttctcatgctagtccactattgttacacatataagttgttcaggaatgaaatactagtcaaacttaaattgcaaggcattacggaatcagtggataataagcagaagacacaatttagatgagtctggtgatgaagggagaaagatgagatggtagtttggagaagcagtgagtggcataaagatcaagggttgttctttttaaaaataggagtttaagccttcagtctctttccttccactatttccagggagagagcagaggataaatggaagaaagtgaggagcacaagagcccagtaatgaggttatccttgacatgcagaaaggacccttctgaaacaggaggcaagggcaagataataggtgataattcagagagatttggaaaagaagaggagggaagctgaagaaattaatggtatctgagaagtggggatgaaagaatgatttgcttctatgttcagtctgttttgaaggactttgaagagtattttccaaaaaccatgttaataagacagagccatagtattattttttgtgattaaagaaaatacatcacttaatttttatgagtaaatttggagtgaatgcagattctgagggtcagattcatactgttacaacttacaaaagctaacatataagacacaatggtgctttattaaggtagacatacttgagtccaaacctggggcagttttacatgcacagtactcccacctagtgggtaagtttgttaatgagaataaaatttagatttttaggttgcttagtggtgatttggagtaaatgaatagtcctaaggattatttcccataagccacgagagtttgatgacctgcttttctctttagaaatgcatgagttgggaatatagaagctgagtatattcttttggaagagtaaggaatctgcactgattatcttgcatggactcccctttttctagatccatccatcagttcgaatacatttctgatacatcatttctgatgctgtcagtttgtttaaagacatactcgtccatgtgtaattaagttctaatagtggtttaaattcctgcttcaaagaacactatagtcctgccagtgctctgtagtgaacttataagcactacctcctggatccccctcttagtgtgttaaaggctttgagaagtcctacattaagggttactgttaggttttgtttaatttagtaatcctaaatttatttgaccgccaagcctttctgttctcatcacttccatcttacaaaactggtgtttgtggagattctgaagacaacactgggccatgttcttctttagttgtatcttggccacagagtcaggtcatagagaaaaggccctgtgagttttcctgtctcctccacaatattctgacaggccatctgctgaatgtgagtggcagcccttaacccttctatataaaaccatgtcagaactgcctcagattctgaggccccttaaatgtattactcagttccactaaatcatggaagaaaaatcaatgtcattttcgtgtttggggaaacatttatcaggtttcatgttttaaaattcctgatagaaattgttgatctctggtggtgctttttattgtaaatgccagtgaacagtacagttcttcactggaatttcacagtcacagtttaatcatctgtccttgataaaacaaatattttagatacagacgtaatgaatcatctctccctgtgtgcttctgtaaacacaaaatgattcagctgttgctacctactgagatttcattttgccataattttatcaaccttgtagagtcagatgggttgtcattgtaagaagagcaattttcagaaaaatataatctattgagagtttgcaggtcttttcacagttaattagttatttctggcttttagactttgttaatacagcataaaagacataatttatttggggaatggctctgttggttaatagagaaatttttgattgttttcagtctatacctgactgtaatatttctctgtttgattattggaccgtttatatcagatttactctggagaaccttgttgaaaatagagattttagagctccacttcagacctgaaccctaattggtggatggtgtggagaaggggatggagaatctgcgttttaaataaactctttaggtgcttcttaggtacactaacgtttgggacagccttgtgtgagctagttatatgcaaatcctttgtaaaaacttgttttttggataaacctattatttcaagtttctgttaattttcacctgaatctttgctattcttattttgaaatgatagcaagtgtaatgacctccttgagcacatttttgttaagcatctaattgccataaagctgagccaggtagagaacctgctataatcaggtgaaatgaattaaaactcactaagaagttcctgtttatggaattgcttaagtcattggtacttttatgtagcttgaattttagcccactagaatttctagcatgctttaaagaggtggaaaattgaataggtctatgtaagtgtgattctaagtgaagtcctcacagcatattccacaagcgttacatatatgtcttctaagtgtgcctctttaggtctgacctctttttgagacgcaagtctctcacttctggtgccacctaggcccctgtgtctgaatgtcttaccagcacctcagatacatcatgtcagacactcaactttatccacaaacttgatttttctctcccctttttaatctaatggttctactattttcccggtcacccaggtgttgaatcagaatttatttgccattttacatgaaaagcatttgataattcacaataatcatcaggtatcttccccccttttcagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcaggtaaagtaataaaacagtgagttatgcttactttctggataaagcaattttgtgtagctcagaaattataaaccatagaaaaatattgtaaataaatacatttttgatagataagacgtgcaaatgtgttccttcaaaaggtacctagagtatgctatgataagccagccttcctctcagcctgccttccaatccccagatcccttctcagaggcaccccattgccagtttctcatgtgcctatctagggagaatgtggtggggaagagtggatctggagagcctgggttacagtgcccgtttttcagctttgtggcttggtgactgtgggcacgttacttgatatctctgtacctcagttttctccttcataaaataagggttataataattactcacttcataatgttgagtgaaataaatgataaaaggcatgaaaagtgcctaacacagtaccttagcaagtagttagctttcagtaaatgttgccattatgattattgtacacaaacatatatccttttcattactgtttttacaaaatgatagtattctgtgtagtgcactatttagtggttggttcttttcattaaaccacacacatacattggagttctttctattaacatatagaattgcctaatttttaaaaacttggagaataacatgcaaacattaaaacacacaaattataagtgtattgtttggtgaattatcacaaactaaatttcataaagtgaaatgtcattgtagccagtactgagatcactaccagtgtcccaaaagccctatctgccccctcccattcactccttcattctcacatttgaccactgtcttgacttctaaccccatatgttcattttgcctatgtttgatctttaaataaagggccaatagcttatgtattcttttgtgcctgccctcatttgtgcaacattataagattcattcatgtttttttatatggtcatgtttttttcatttttgttgctatatggtattccattgtataaacgtatcatcttatccattcagtgtttaataaacatttcattttgttcccacttttcctctattaataatgctgctacaaataatcttttatatatcttgtggtgcacataggtgcatgttgctgttggatatatatatacaggaatggaattggtgttatatatttgcagatattcagctttcatggatacagccccaaattcagtagtcatgtacactttcatcaggagggtgtgagggtgtcagttgttctgcacccttgacaacatcaccactgttaactctccattttagccattctagtgggtccatggtagtaccttgttattttaatttgcatttccttaatgacttataaattttatatgcttgttggccatctggatgtcctctgtagtgaaatacctgtttaaatctatgtctaattcttctgttctgtgggcctatttttattcttatttgtgggagtaattgaaatttcctggataaaaatcttttgctggatgtatgtacatttccaatttcaccttttcactctcttaatggcatcattgaagagtagaagttcctaaaatagtccaattcattacatttttccttttgatcagtgctttgccttagcctacttcaagatcatgtggatcttctcttgttttcttttaaaactttattgttcttgctcctaaattttgatgtacggtttatctggaattgattttagcatatgttgtgaggtagaggacaagattgtcttgttttctttccatatgaataaccaattgatgcagcaccacttattgaaatgccatcccttctcccactgaattgccagaagtcttggctgagaatcagctaattgtacatgtgtaggcctggacattgttttgttccattgggctattatttaccgttgagcaggataaataatgtgtgtcttaagtactttatgagtaatttataataggtcttgctgtctggtaatatagttcttccagttttatttattgaggttgacttgttttttctaggccttttgtatttccatataagtttttaaattgggattacattgaatttatagatcaattttgagatagttgatatctgtatagtatttgagtcttccaattcatgaatatggtttatccccttttttgtctttgatttttgtcagtaatgttttgcaattttcagtgtgaaggtctcacacatctttttaaagagttattctctgatatttttgatgcagtggtacacgatgttttattctaaaatgtcaatttttattagttgcttgtacagaaaaatacaactggtttttctatagtttccttatacccaatggcttgtcgctttttgtatgtgccctttttattgatgtgtaacttactcacatgtaatacatcctttgaaagtgtatagttagatgaatttaggcaaatgtatattgtcatttagccattgctctaactgaaatgtagaacatttccttcatcagcaaaagttccagtgcccctttgctgtatattccctctcttttactctaagacctcaggaaacactgatctctttttttgtccctataattttaccttttctagactgtcacataaatggaattacacaaattgtatagtatgtagcattttacatatggcatctgtcacttagcataatacttttgagatttttccatgttgttgcttttaccagtagtgcatttattttttattttattttattttatttatttatttatttttgagacagagtctctctctgtcggccaggctggagtgcaatggcgcgatctcggctcactgtaacctccgtctcccaggttgaagcgattctcctgcctcagcctcccgagtagctgggactacaggtgcctgccaccacgcccggctaatttttgtatttttagtagagatggggtttcaccatattggccaggctagtcttgaattcctgaccttgtgatctgcccgcctctgcctcccaaaatgctgggattacaggcgtgagcccccgtgcccagccagtgcatttattttttattgccaagcagtgttctgctttatagccatgccacaatttgtatatcccttcacctgttgatggacaactggactgtgtccagtttttttattatcagtaaagctgttatgaacatgggttcacaggtctttatgtaaccatatgttttcatttctcttgggtggagtggaattgctggtcatatggtaaatgtaactataagaacctgccatacagtttttcaaatgactgaatcattttgcattgtgagagagtcccacttttgccacacccttgctaacacttggtattttcattcttcttaattttagccattctagtcaatgtgtagtagtggtatctcatgatggttttaatttgcattttcctgtgactagtggtgtctgctatcttttgatagttttatttgctatttgtatattttctttgataaaggcttggttgaaatattctgccccttaactctttttattgatttgtaagttatttatatattctggatactgaatttttaaaatatatgtgttgtgaatattttatctttgtatgtggcttaccttgtcattttcttaatgatgtctttgaagagcagagagttttaattttgacgaaatttaatttactttttttatgatttatgcttcttgtgtatcatttcatgattttttatgtatacagttgtgttgcatgtcaacaaaatatttgcttatcctaagatcacaaaaaatttctcctgtgttattttctaggagttttataattttagcttttatatttaaatctatgatccattttcatttagtttttctgtatggtggaaggtaaatgtcaaatgtcaaagtttatttaaaaaatatgtatatctagtttttcagcaccatttgttaaaaagactatcctttccccattgaattactttgccctcattgtcaaatcctatcggccatgtatatagcatgtgaatctatctagaatctattctgttccactgatctatatatctgtcctttcactcatgacacactcttgatttctgtaactttatagtaagtcttaaaattatcaggtagtataagtccttcaactgtgttctcaaaattgttctaggtcctttgcaatcccacataaatgttagactcagttttgttgttgttgttcccctaagaaatgtcaggctattatccattcttgttgttcactgttttctgaaaactgagtgtagaaatagccactttcacttcgccccgatgttacaggcatagcagagcatctgcatctgtgcagctggcaggtccaggacagcatctgcagggcagtcagtttattagtgtgtaccttttgggattttgagtgagattacatagatcagcttagaaatgatatcttaacaatattaagacttttaatgcacagtcgtggtatggctctttaggcctcctttactttctctcagtagtgctgtctacttttttatgtgtgtgtgttccatgtattttgttaaatgtatccttaaatatttcatgtcttttggtgctattgtgagtagttttaaaatttttatttctcattgtttattactattttaaagagtcattttgacatttatttttgtatatttacttgtatactattaactagtgaaactcatttctaattgcttttttatagatttcataggatttttatatacacaatcaagttacatgccaataaaaacagttttatttatttatttttttcagtcgatatgccttttatttatctttctacccttggttagttgcattggttagaacctccagtgtgatgtggaataaaagtggtgtgggcaaacatcctttcctttctccaatcttttttttaaatgaatttcttaagaaaggatctctgactttcatctgatttttcaagggtctgtctccccagaaggaagaataattgccttcaaaaatcatttgagtgacagtactattgcatcaatatatgttcttttaattctggaataccccaacttataggtaaaacatttagtctttcactattaagtgtgataggttttcatagatgccttttatgaggttgaggacatttcttcccttcctagtttattattatgaaagtgtgttgaattgtcatttccttattctacatctattgagattattatatttttatttattctgtgatatgatttataacattgagttttaatcagtttattgaaatataattcatataatactgagatataattcatactcacctgaagtgtacatacagttcagtggttttcagtatattcacagagttgtacaactatcatattaaattttagaacattttgttaccctgaaaagagcccagtatccattagcatcattatctaccaacccttccagccctagatagccactaatttacttctgtctctatagagttgtctattctggatatcccatttaagtggaaccatatagcatgtggccttttataaactaacttctttcacttagtataatgttttcaaggtttatctgtggtcaatactcatttatttttcattgccaaataatattccattgtatgaatatgtcacatctttgtgtctgttcgttagttcaaatctgacatttttccactttttggctattataaataatgctgttatgaacatttatgtacaaatttttatgttgacatatgttttcatttctattgtgtctttacctaagagtagaattgctgagtcgtatggtaattctattttaacactttgaggaattgctagactattgtccaaagtggctacaccattttacatcctactagcaatgtataagagttccagctgtgccgggcgcagtggctcatgcctgtaatcccagcactttgtttgggaggccgaggcaggtggatcacctgaggtcaggatttggagaccagcctggccaacagggtgaaaccccatctctacttaaaatacaaaaaattagctgggcgtggtggcaggcgcctgtaatcccagctactcaggaggctgagacaggagaattgggtgaacccaggaggcggaggttgcagtgagctgagatcgcgccattgcactacagtctgggcaacagagtgagactccatctcaaaaaaaaaaaaaaattaattccagttgctccatgtccttgccaacatctgttagtctgtctttttcctagtgggtgtggtattgatttacattacagtgattaatttttgaatattaaactaaccattcatctttagcaaggaatgtgttcatttcatctaagttgttgaatctatagccagagggttctttttgtttttgtttttttaagtaacattttcttgttaaccttttaatatctatggggtttgtggtgatttactgtctttcattttctatactgaaaatgtgtcttcttttttcctgattgttctacctataagttattaatttttctcatttttctaaagaatcatccttcagcttcatttttctcaaattgctttttctcagtttttgtctgttttcctatttcattgaattccagtcttttatgatttccttctttctacttactttaggtttaatttgctcttctttttttagcttattatggtggaagtttagataatttcagattgttctcgatgtatttaaaatacagatttttgtctaagtgctattttacctttattcacagacattgataggttgtatttaccttcccatccagttaaaatattttctaatttttgttgtgtattcttctttgattcatatgttaaatagaagtattgtttaatttttaaagatttggttatttcttagatacctttttattattcatttctaatttaattcaatgttggccaaagaacctgttctgtatcatttcagacctttcacatttactgagacatgcttcataacttaggtgttaggtcttcctggtgaatattgcataaatacttgaaaagtttgcttttttgtgcagtgatctgtaaatgctatgtaaatttgcttgatagtatattcaagtcttcagcatccttgctgataatctgtttactgattctatcaattactgagaagctttttgaaatatccaactatatttatagatttttcattttccctgtcaatattttcagttttgttatattttgaatctcttagtattattatgtatcttcttgattagttagcctgtttattattatggcatatatgtctttgtctctggtaatattccttgcctcaaaaatctatctgatatgagtatagcaacgactttatttcatttttctttaaacctattataccattatgtttaagctgtgttttattgtaagccgtatatggtttggattttattttataatttaatttgacaagctctaccattaaattgtagggtttaaactattttaatttcatttattctatttggttgggtttatatctgccatcttgcttgtttgctgttctatcattcttttgttttttcttcatttcctgcttttttttggattaactgagtattttttagttttttatgttatcttcattttacgagctatacttctttttgtttttttgtaggggtgattgttctagtttactatatgcatttttaacttatctcagtctaccttcaatgaatagtacactacttcatgtataatggaaggaccttaagactttcattcttttttttttttttttttaagttttagggtacatgtgcacaacgtgcaggtttgttacatatgtatacatgtgccatgttggtgtgctgcccccactaactcgtcatttacattaggtatatctcctaatgctatccctccccactccccccaccccaaaacaggccccagtgtgtgatgttcctcttcctgtgtccaagtgttgtcattgttcaattcccacctatgagtgagaacatgcggtgtttggctttctgtccttgcgacagtttgctgagaatgatggtttccagcttcatccatgtccctacaaaggacatgaactcatcattttttatggctgcatagtattccatggtatatacgtgccacattttcttaacccagtctatcattgttggacatttgggttggttcctagtctttgccattgtgaatagtgccacaataaacatacgtgtgcatgtgtcttaatagcagcatggtttataatcctttgggtatatacccagtaatgggatggctgggtcaaatggtatttctagctgtagatccctgaggaattgccacactgacttctacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatggtgagcattttttcatgtgtcttttggctgcataaatgtcttcttttgagaagtgtctgttcgtatccttcacccactttttgatgggtttgtttgtgtttttcttgtaaatttgttggagttcattgtagattctggatattagccctttgtcagatgagtagattgcaaaaattttctcccattctgtaggttgcctgctcactctgatggtagtttcttttgctgtgcagaagctctttagtttaattagatcccatttgtcatttttggcttttgttgccattgcttttggtgttttagacatgaagtccttgcccatgcctatgtcctgaatggtattgcctaggttttcttctagggtttttatggttataggtctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtcaaagatcagatagtcgtagatatgcggcattatttctgagggctctgttctgttccattggtctatatctctgttttggtaccagtaccatgctgttttggttactgtagccttgtagtatagtttgaagtcaagtagcatgatgcctccagctttgttctcttggcttaggattgacttggcaatgcgggttcctttttgattccatatgaactttaaagtagttttttccaattctgtgaagaaagtcattggtagcttaatggggatggcatagaatctataaattaccttgggcagtatggccattttcatgatattgattcttcctacccataagcatggaatgttcttccatttgtttgtatcctgttttatttcattgagcaatggtttgtagttctccttgaagaggtccttcacatcctttgtaagttgggttcctaggtattttattctctttgaagcaattgtgaatgggagttcactcatgatttggctctctgtctgttattggtgtataagaatgcttgtgatttttgcacattgattttgtatcctgagtctttgctgaagttgcttatcagcttaaggagattttgggctgagacgatggggttttctagatatacagtcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataaatagctcttcttattttgaggtacgtcccatgaatacctaatttattgagagtttttagcatgaagggctgttgaattttgtcaaatgccttttctgcatctattgagataatcatgtggtttttgtcattggttctgtttatatgctggattacatttattgatttgcatatgttgaaccagccttgcatcccagggatgaagcccacttgatcatggtggataagctttttgatgtgctgctggattcggtttgccaatattttattgaggatttttgcatcgatgttcatcaggggtattggtctaaaattctctttttttgttgtgtctttgccaggctttggtatcaggatgatgctggtctcataaaatgagttagggaggattctctttttttctattgattggaatagtttcagaaggaatggtaccagctcctccttgtacctctggtggaattcggctgtgaatctgtctggtcctggactttttttggttggtaggctattaattattgcctcaatttcagagcctgttattggtttattcagagattcaacttcttcctggtttagtcttgggagtgtgtatgtgtcgaggaatttatccatttcttctagattttctagtttatttgtgtagaggtgtttatagtattctctgatggtaatttgtatttctgtgggatcggtggtgatatcccctttatcattttttattgcgtctatttgattcttctctcttttcttctttattagtcttgctagcagtctattaattttcttgattttttcaaaaaaccagctcctggattcattgattttttgaagggttttttgtgtctctatttccttcagttctgctctgatcttagttatttcttgccttctgctagcttttgaatgtgtttgctcttgcttctctagttcttttaattgtgatgttaggatgtcaattttagatctttcctgctttctcttgtgggcatttagtgctataaatttccccctacacactgctttaaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaagagtgctttacttccaactatggtcaattttggaataagtgtgatgtggtgctgagaagagtgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggcctactttgtctcttttgatctttgtgggtttaaagtctgttttatcagagactaggattgcaacccctgcctttttttgttttccatttgcttggtagatcttcctccatccctttattttgagcctatgtgtgtctctgcatgtgagatgagtttcctgaatacagcacactgatgggtcttgactctttatccaatttgccagtctgtgtcttttaattggagcatttagcccatttacatttaaagttaatattatgtgtgaatttgattctgtcattatgatgttagctggttattttgcttgttagttgatgcagtttcttcctagccttgatggtctttacaatttggcatgtttttgcagtggctggtactggttgttcctttccacgtttagtgcttccttcaggagctcttttagggcaggcctggtggtaacagaatctcccagcatttgcttgtctgtaaagtattttatttctccttcacttacgaagcttagtttggctggatatgaaattctgggttgaaaattcttttctttaagaatgctgaatattggcccccactttcttctggcttgtaaagtttctgccaggagatcagctgttagtctgatgggcttccctttgtgggtaacccgacctttctctctggctgcccttaacgttttttccttcatttcaactttggtgaatctgtcaattatgtgtcttggagttgctcttctcgaggagtatctctgtggcgttctctgtatttcctgaatgtgaatgttgggctgccttgctagactggggaagttctcctggataatatcctgcagagtgttttccaacttggttccattctccccgtcactttcaggtacaccagtgagacgtagatttggtcttttcatatagtgccatatttcttggaggctttgttcatttctttttattctttgttctctaaacttctcttcttgcttcatttcattcatttgatcttccatcactgataccctttcttccaattgatcgaatcggctactgaggcttgtgcattcgtcacgtagtttttgtgccatggttttcagctccatcaggtcatttaaggacttctctgcattggttattctagttagccattcgtctaatcttttttcaaggttcttaacttctttgccatgggtttgaacttcctcctttagctcggggaagtttgatcatctgaagccttctcctctcaactcgttgaagtcattctctgtccagctgtgttctgttgctggtgaggagctgcattcctttggaggaagagaggcgctctgatttttagaattttcagcttttctgctgttttttccccatctttgtggttttatctaccttttgtctttgatgatggtgacgtacagatggggttttggtgtggatgacctttctgtttgttagttttccttctaacagtcaggaccctcagctgcaggtctgttggggtttgccagaggtccactccagaccctgtttgcctgggtatcaccagcggaggctgcagaacagcaaatattggtgaacagcaaatgttgctgcctgattgttcctctggaagttttgtttcagaggggtacctggccgtgtgaggtgtcagtctgcccctactggggggtgcctcccagttagggtacttggggttcagggacccacttgaagaggcagtctgtccattctcagatctaaagctgcatgctggaagaaccactgctgtcttccaagctgtcagacagggacatttaagcctgcagaggtttctgctgccttttgtttggctatgccctgcccccagaggtggagtctacagaggcaggcaggcctccttgagctgtggtgggctccacccagtttgagcttcccagcctccagcaatggcaggcacccctcccccagcctcactgccaccttgcagtttgatctcagactgctgtgctagcaatgagcgaggctctgtgggcgtaggaccctccgagccaggcacgggatataatctcctggtgcgctgtttgctaagaccgttggagaagcgcagtagtaggatgggagtgacccaattttccaggtgccatctgtcatccctttccttggctaggaaagggaattccctgaccccttgtgcttccccggtgaggcgatgcctcgccctgcttcagctcactcccgctgcactgcacccactgtcctgcacccactgtccgaaaatccccagtgagatgaacccggtacctcagttggaaatgcagaaatcatccgtcttctgtgtcgctcatgctgagagctgtagactggagctgttcctattcggccatcttggaactgcccctgactttcattctttgtactatttttgtcatagatttttcttctatgtattttaaacactctataataccttgttactgtttttgctttaaactaaataaaaatggaaaagataaataaaaaatggaaaagaaggtctgtgtttacctacacatttaccattttcagcattctttgtttctttgtgtagatctgggtgttcatctggtgtcattttcttttgcctgaaaaaacttcattttttcctggatttccacagtgtttggacatttcctgaaaaactttatttgttcattctgtcttgttttttttttaagatagggtcttgctctgtcacccaggttggagtgcagtggcgcaatgatagttcaccgcagcctcggactccaggaatcctcctgtttcagcctgccaggtagctaggactacaagcgcatgcccagctaatttttgtttgtttgttttgtagagacagggtctcactgtgttgcccaggctgatgttgaactcctagcctcaagagattcccctgctttagccccccaaagtgcagggattacaggcatgaacattgtgcctggattattcagtatttcttgtagtgcagatgtgctgttgagacagattctctcagcttctgtttgtctgaaaaagtcttaattttggattcttttaaaaaactttttatttggaaatttataggaaagttgaaagactatcatagtgaatgcatagactgtaccctttgtacagatccacctattgttagcattttgcctcatttgctttatgaattactctgttcctctttctctctttttctgtgaatgtgtgtatgtgtccatataattacacacatattttcttctttaactgtctgaaaataagttatatagtgtttaccctttaccccgaaatatgtccttgtattatttcttaagaaaaaaagattctcttttattgccactgtagttagtacttgtagtagatttgactttgttataatacttttattcatctatccagttttgttagtggacccaataataacctttgtagattttttttcctgcagtacatgatccagttttggatcacatattgcatttcgtggtaatatcttttcagtctctttcaatctagaataattcctcagcctttctttgtcttttatgacactggccttttaaaagaatacagtctttgttgtgtgtgtgtgtttttcaagtaaaatcttctcattctggcagaaaattcagattatgccttcctggccagaatactaaaaagtgatgttttgtcttcggaatattacatctagagccatttgacatctgtgtacccctcatttgtgatatcaggcctgatcacctggccagtttctctctggtttatactttacatccgctgccttgctactaataagaagtctgcagagacacttcaacactatgtagctattctatacctcattaagatttcacccctatatttagcatcctttggtaatttttctctaaactattcttttctgtgatagttgcaaaatgatgatttttcaactttagcattgctttcacagttgctaattgatacttggcatgattctgaaaacaagagcccttccctctgccttattattattttctttttcttttttttttttttttttttgagacggagtctcgctctgtcgtccaggctggagtgcagtggcacgatctcggctcactgcaagctccgcctcccaggttcacgccattctcctgcctcagcctcccgagtagctgggactacaggcgcatgccatgcctggctaatgttttgtatttttagtaaagatggcatttcaccgtgttagccaggaaggtctcaatctcctgacctcgtgatctgtctgcctcggcctcccaaagtgctgggattacaggcgtgagccactgcgcccggcctgccttgttattttcttatttgtctcttatgaatatggattcacagatttttaactcattacttctcttaattattttcgtgtttgtatttttccacatttggccagcaggagtgtcttcattctaattcctgtcctcatgacatacccccattattttcattaccgtcttcttatttctaacataacaagatattgcagacttttcttgctcttccatgccccagccctgaaatcagccatttctttgaggagcgctggtcctttttattggtgaaaccaagatatggctaccagctatgctcattgctacttggtgtttttgcttctaggctatttgagcagatgaagctgggaaatatatgcatatatgtgcatatatatacatacgcacacgtggatacatatatacatacacatgcatgtatgcatatatatacatgtaaatccatgtacacttacatgtttcaaggctctcaaaagtatttcatactgtagcagttttgttttgtctccagagcattaattgcctgttggatcatttttatgatggtagctttaaaattcttgtcagataattccagcaactgggttgtctcaggtattggcatcttgtcttttttcattcgagtcgtgattttcctggttcttaatatgtcaagtttttttttaaattgtattctgagtattttttatattctaatgacattctaggttctatttaaatattctaatttagcaggaagtcatcttgtttaagtttagcatgcagatcctggcctatttttgtaggctgtggttctaatgatgatttagttcccagatcccttgaaatgttattttggtctactttatttaattgctacctagagactgttgtgaatacctgatattccacactgtggttcagttttcaaaccttttggcatattaattgtaaacaatttcacatgttggtcggggatgccctgcacaggctgaaggaattcttttctccagtttccttctctttgatattctcttctcagttattagttgagagggtgcagttgtcagctgccatcattggatggggtgtagaagtctgagctcctcactaggcttccactgacattgttgctatgggaggacatcctgcactaggaccccttccacctctggttgatgggtagaagtccatgctccccacttgctctctgataatactgcacagggcagggagcatcagcagtgttttgcttgggtaggtcaagtattatcaaggtttctgggtaccctctttttcagtcctttgcttataaagagtagatttttcttgaggcttttttgtctgtttctcttgatggctctggacttctccagagcctagtctataagatacagaatacaaagacaccccagggtgacacacagtgtcattcctcacatgctgagatcttagccagtccatcttcctctttctactttgcagagttctcttatagttgtctgttatatatcagggtttttagttgtacttagcggagaaatgagtctaatccatcttgtttggaagaagaaatactttttaatgtattttaaatttctgttttaggggcaaacacatttaagattatgtcttcttggtaaattgacccttttatcacgatataatttccctttttttttttttttttttttgagatggagtttcactctagttgcccaggctggagtgcaatggcaccatctcagctcactacaacctcctcctcctggattcaagcgattctcctgcctcagcctcccaagtagctgggactacaggcatgagccaccatgccgtgctaatttttgtattttcagtagggacgggatttcaccatgttggtcaggctggtctcgaactcctgacctcaggtgatccactcgcctcggcctcccaaagtgctgggattacaggcatgacccactgcgcccggcccctaatttcactctttatccctgataacattcattgttctggagcctattgcgcctcatattaataaagctcctccaggtttcttttcatgactgtttacatgagacatctctttccatacttttatttttaacctatctttttatttaaaatgggttatttttgatagtatatagtttggtcttgcttttttatccaatctgacatcctctgtctcttaattggtgttttaaaaccctttctttaatgtaaatactggtgcagttggctttgaatttaatatcttgctgttttttcctttgttccgtctcctttttgttatctttttttgctgttttttggattgagcatttttattattatattttatttctattattgtcttattactttacctctttttcaaaaaattttagtgttctctctagggtttgcagtgtacatctttcattagttacagtcaagtaattatacagcctcacttgtaagaaacttttaacagcatactcccaactcctaattctttgtattgttattgtcatgaattccttttacatatactgttaaaccattacattgctattgtttgtccattaaacagttatcttttagagtagttaaaaacgagaaaaaagtatattttatacttatcttcatgtttaccattttcaccagttttcatttcttcttaggtaagtttctctctggttcttctaattgaagaacttgttttaatactttttgtaatggagggctgctaataatactttctctcagcttatgatttcctcagaaagtttttgtgtttcacttttgaaagatatttttattagaattctggattggcaggcttttttctaatgctttaaagatgtcactctattgttatctggcttgaataatttctgatgagaagtgtaatgtaattcttgatttttctttatataatgtgtctttttcctctgatggccacatgattttgtctttgtgtctatatgcatgttgttgtcattttgggtttgtttttatatctgtgttgcttgatctttgaaattcttgcatttgtggtttggtgtctttcttatatttggcaaattctagacagttcttcaacgatttcttctcctcccttttttcttcttctgtgatttctattatgtgtatatttcttgatattgtcccatagctcttagaggctctgttctgttacaattttttttctttttcctttttttctctctctgtgtttcagattggataataccaatccaattttaggttcactgattctttccttagctgagtcaagttatctgttactgtgttggttttttgtgtctatatctatatatctaacatttctattttattctttctaaaaaaaagtatttccattgaagtaatttctacagaaatgccccatctgttcatgtatgttgttcatcttttctactagatcctgtatcatcttaatcataatttgctgctttttcatgtttaagttttgattgaaagccagacagtgtaggtaagagtctgaggtgccagacttttttttaaaatgtagctatatatcactcacaacttaggttttccctatgagcctgtgcctcagagagggtctctctccatgttcatttctctcctagaagtagattgctgttacgtatcacttggatcatgctaggtttgtggcaggcagaaaaggagggttctctgttactctgatttagcttcagtcttaggcaggtctttcaatcctgcatctcagagctggggctttttcagcgatcctgcccctctctcactgccaggggcaggggtcctctatgggtcagggcccagaatggtttcctgatcctcctgaagggtagagggggttttttgtttgtttttgtttacttccctcagcaaccgatgctctggggataacatttttgctgacctttcgtcagtggcttaatgctttttttcttcagggataaagatgtgtttggggcttcatgtccatcctgcagtgggggtggttctcttttgccaggaatggatctggaggaagatcttttctaatttgctgcccttccccagtgagctacagagagactgaggactcttgtgggtgcccactgaggtctgtagaaaatagcctgcaaggccaggtgcggtggctcacgcctgtaatcccagcactttgggaggccgaggcgggtggatcacgaggtcaggagatcgagaccatcctggctaacatggtgaaaccctgtctctactaaaaatacagaaaattagctgagcgtggtggcaggcacctgtagtcccagctactcgggaggctgaggcaggagaatggcgtgaacccggaaggcagagcttgcagtgagccgagatcgcgccactgcactccgtcctgggtgacagagcgagactctgtctcaaaaaaaaaaaaaaaaggaaaatagcctgcaaatggatgtgatgcccgctgtgtccaagccacccaggatttttatattttcatggtagctcacccttggtcttttgcagttcatcaaaaagtttagctgagatcttacccagagatagggtggtaccaatttttctctggtgtactgtcctatgtcaaccagtgctcatgatccctctctcttctaaggcactcatctttgtttaggtttcaggctagttgattgccctcttactttagctctgatggattcaagaaaaattatagttttataagttatcccgctttttctcgtcattagggtgagagtgacattatttatagctctctacaacctaaacagaatcagaaatctccctgaagaagatttaagccactaaattctacccaatcctaatatagttttctttttttttttttttttttttgagacggagtctcgctttgtcgctgggctggagtgcagtggtgccatctcagttcactgcaagctccgcctcccgggttcacgccattctcctgcctcagcctcccaggtagctgggactataggcgccccccaccacacccggctaattttttaaaaattttttttatttttagtggagacggggtttcatcgtgttagccaggatggtctcgatctcctgacctcgtgatccacccgcttcggcctctcaaagtgctgggattagaggcgtgagccactgcgcctggcctagttttcttaatatcttacaagaggacatgccagatgttctctgtctttagtgatacttgtattaatggattggatagaatgcaaatggtccctgtgtttttcatgttattccatgactcagtttggaaaggagagaaccactagctggtcatcttcacagagagattttttacattgtttctactgattttacaatatcaaggaggcaaaaggtacctctcagtgctcagaaaacgtaaactttgtattgagacagttgcattcttaaatgatcgtcataaggtctgtggtttaaaaaaaataaaactttaatggggattatttcaaacatatacagaaatagagaaaagagtttactgatttccccatatgcctactacccagcttaaacagttatcacactgtcttaatgttgttttatctaccatttacacccctttttcttccatggattattttgaagcaaattccagatataatttttaagtataaatgagggttagggattgtagatttttatttcctaccatatgcatttcagttttaatgtattgactttggatgcagaaagatagcatttgcaaattctgtgctgtttgcattcaaaggcatttaatgtttgacagggtgtattccagatctcttttatgtatgtaattggattggtaacatacctacagacaaaggttctggaggcaaggacatttttcctggtatttgtagacctttttctctccttgaacagtagcctgttgtactgcatttagtacattggaatttgagcagacatcccctaataattgaactcacactaaaaaattaattttcatatttcattgagacttctgtttagacctgtatattcaaaggagaaagcaaaatgacttgacttgactcttgtggttatacgttgaacagcatgtgcatgtgtaagagttcagtgttttaactccatgttatttttttaaccttttgttttgaaatggtaattgattcacagaaaaattgtaaaaatagatcagggagttcacatatacccatcacccatcttcttctaatgttaacaacttaaataattattgtacagtgattaaaaaagacatgtgattaacctagtggttattttcttattttaacagctgctgaaatagttcaagaaatcgaaaatatagagaagactaggatgcgtcttgaagctagtaaactcaatgaaagtgtatgttaatgggctatttcagtatatggatagaaatgaagaaagtttaataccctacaaaaattaaagcaagccattattaaatttgttcatttactaacacatttccacttagtgtattatgatttacttgcaactcattttaggacaatatttgattgtacttagcagtcttctagcacaaaatgcaatccaaagtagagtttgttcatgagctagagttctatagaaaatgcctgtgcctgtgcatcaggcagctttgatattggtcctttctctgctggttgtgtttgataagctacctctaaggacctctaagctactgctagggacctctatgatccctttttagctctggcattctgcaactctatgattatacttatggaaatgttaagtaattataagaggataaattaagtaatttgaggatggaatattctcttgagctttggagggaatcagagacctaaaattcttcactgttgccttccactagcttgatgccccaaacttgaagacaggataccagtgaagaaaatagtcattgtgtcctgtgacactggagaaagtgttttggtctcttccaagtagacttttttttttctaggccatttgtagtgtgtttgtaaggagaaagcaatggttaccttaagaaagtaagtttgtaaccaaataagtaggaaaaaaatgggatttacattgaccctattattacctgtgtgctaactgtaagatgggaactgcagtgaatcatggaagcagatttctgatcttttaagtctgaggtttaaaaagtggacctagaggcttaacttactgtgttttgtattattgcattttctatacatactacttttctataatgacctggagaagttagattggaaaggagagaaggcagacaagaagatcagccttactaatagctaagtgtcgttagtcttctggtttcaaatattgcctgttgtattaatgaatgtgggatattaaatattgaaaatagaaaatttattattttgttaatatataattgaatcatgttgcattttctactgatgagaaaaaataatgagtaaaatgtataccatttctggtatttaagggaagtacataggaatgattcttcctaggtctatataaaacagatgagagatcattttcctctattttaaacactcacatttgagatttgaaggtttgtaatatttccctttttgtcattttggggagatttttattaaggtctttttttgattattttaggtaatggtttttacaaaggaccaaacagaaaaggaaatagatgaaatccacagtaaatatcgtaagttgcacgactttatttaatttgtaaagagcttcagttgctgtttttcatcttaagtaatttttcagaataatgttttatattaaggttcaattcaaacttttgttaacattacttaagagattgaattttaattgggtgtttacttagtgactttttttgtattttatatgcctgctttttgatttttatgactagcattctactttgagcttatcactaagcactttgcaaatattaattagctgctctcaaagcatttctgtgaaaagaagctgggattaaaatggaaacattcgggactctatcctgtcctcaggccactcagtaacaatacttctgtataggatttcaatgcttctatagcttgcaaatttgtgccaaaaatagttttcattttattgcttgttagcaacctcccaactttatcacttccttttccttaaatggtcttcgtgtatatctttcccagggctaacacattactgttttgtcagatagctgttactctttgtgtggtggttggattttagtttaaatttaagtgcctgacgaacagtagatagttaatagatgttcattgaatcagtattcccaggcatggtatgttttaattgaggtaagataatttttttctctcttcatttcttaaactctgaagggccaggttctgtagtgatgtattgtgggagggaggatgaagcctgcaggtgtgattgcctgtgccttgctagagtaggaaaaggaacctagaggagtcttggattatggactgaacaacaaaagtcaccattgttctgttgctggacagataagtatgatgtgaacctctttgatcaacttgtaggatgtcagagtgatttttctttagaaaggagaacaaaagagaatatcaaatgatcagtgaattggcctggaaaaataaggatcactaaggcctgtgaaaataaggaaaccagaaaacttgcattgggagaaagtaatttaaataactgaaagggtggtatctaataatcctcccatattaagaaaaatttggactatattcagtcaagtaaatattcattgcccaccatttagatatctaaaaagtgtaactttactaaataggtggtattaatttatttagccttaaaataaacctcaaaagtcaagtgcttcacaaagcttagatgcttagccttttagtttattcatacattttgatttagtgtcaggttctaactatactattgatatatcttcatctttaaacattttattaatgttttacatgtagtttttaaaaaatcatttactttttatgagccttatcatataaaagagcagtctcttgcatcctccaacaacctgcctctattcccactccctagaggtaacaactatcaagccatttggtgctacttttggtaattaccttacaatttataaaaaagtattttttctgctacttcttgaagtttttcaatttcacattaactattgatgtgctaatatgaaagatggagatttagctcatttatatatcctgagccctacctttgcttcccttccatcctttaaatattatgtcataagtttttgtaagctcagtatttagttagatacattgtttatggctcaagccagacaatttgcataagatggttataattcctttcatcaaaacattctgttgttcttttttttttttttgagatggaggctcgctctgtccaggagtgcagtggcgctatcttggctcactgcaagctctgcctcctgggttcacgccattctcctgcctcagcctcctgagtagctggcgcctcctgagtacaggcgcctgccaccacgcctggctagttttttgtatttttagtagagacggggtttcaccgtgttagccaggatggtctcgctctcctgacctcgtgatccgcccgcctcagcctcccaaagtgctgggattacaggcgtgagccactgcacccggccttgtttttcttataactaataattctcttttgtttgtttaactatttacctagtactaatatatctctaaaccttccaacagaagtgtaaatcactttccaatacatttacacacattgattataactcattattttctcaagaacgtctctcctagggccacccctagcctctgttgtcctgttccagtctactatgcttgtcctttttgccttctgttaatacctggctgctcttctggaatttcttgtcaccaactttctgggaattctgctctcctccttcctgtgttggttcacttcttccaagttccaagtctccctcttctcttgccttgttttggtagaatacatttgccaggaaacttcctgagaaacggtgtatgcaagcttgtctaaactgcggcctaggatggcctttgaatgcagcccaaaacgaatttgtaaactttattaaacattatgataattttttttctcttatcagctattgttagtgttagtgtattttatgtgtggcccaagacaattcttcttccagtgtggcccagggaagccaaaagattggacacccctggtatagaggaatttcttgagatatataacattccatacataacaggaaataacccgtttattattgattgataatttggctgtttgtagaactttaggttaaaaagatacttttctccaaattttcaaaggtattcttccgctgttttctactttccatcactgttgctaataactagcttgccattctgattctttatctttcatttgttacttttttttttttatctgcccatgttcagttcaccatcaagttctgtcagtctctatcttctaaatatcccccgagtccgtacacttcttatgtatcactttgctctctagtcatcccccatctactcttgccccttcctaatactcagaagccaaaactgtcttccaaaactgctgagtcttcacatcatgccatttctgccttgctgccctcctgccattgtaaagaactcttcagtgggctttcgatttctcttaagctacagtttgtaaagtctgttatttcctgtatctggacctgcctacctctctagccttgcctcttctcctccccttactccttgtattccaatcactctggttatcttttacctactttaccaagtccttcactgttttagggcatttgttaccctcttctctctttgtctggaactatctctttctctaattgcctctgacccccctatctatactccccactctcaaccagctcaactgtagtttccctgggaaacccattgtgatctctaggacaaggtaagattttctttctatgtgcacttacattatcttgtgttttttcatagtactattccattcattcagccatcacaagtttgtcaagtacttagcacgtgccagacactgtgctcggagctggggatataggaatgaacaagacagacaagaagcctactctgttggagtttatatctttctagtattttaggaagtgataagtgaaaaaataaagcaaggaagagtataatggtcataatcattatttattgtgcaattaattacttatttctaattaatttctaattatgtgtttttattagtgtgctagggttgccaaaacaaaatactgcatgcagaccgcatggcttaaataacaaatttattgtcttgtggttctggaagctagaagtccaagatcaaggtgtcagcagggttctggaggctagaagtctaagatcaaggtgtcccgagcttctcagggccatgcaggaaggatctgttctaggtctctcttcttggctatagatggccatcttctccctatgtctcttgacatcgtcttccctctatgttgtctctgtgtccaaatttcccccttttataaacatatcagtcatattggattagggctcatcctaatgacctcaggggtggctcctctgtcatttccctattataagcagagtcctgaggtaggaaaaaaactctctcacttagaaaagaaaaaaaaaaaagcttaaagtgaatagttgggggttgggggcctgggggaagagcctcttgctctctggaaatgggttcctttaatcactctatgtctacctcaattcagatcagctagacctccatgaagggaaacagaaccaacattcctttaacccaaaggagagagagaggtggcagggtcttggaaaagagacggatccaacaattccacattttaactcaccctttgtcatatcctggatgagcccccgtattatgggatagttccctggaccttgaccccctttgtgggtgggaactggagtagatcctttcactcagcgcactgctggccactccttgcaagagggaacgaatgctggaaccagccagatgctcctctctggtgggagcaggctctgtgcaggccccgtagcagtgtcctagcccctgccctttcagcatgtgggttcttgtccagcgtcttagaaaattgaggttgcacaaaccgattagtgggtagtgtatgtggaggattttattgggtgatggctggcagcggatgggagttggaaaggggatgatgcgggaagaaggtgatctttccctgaagctgcaccatctgaagttagctgcatctgtccgtagtctctgatgctcagctgcttgtatccctgacgctcagcagcttgcatccctgaccgcttgcatcagccgcttgtgttgctctgccagctgaagtgtttttatgggcaaaggataggggcatggcagaccaaaaaggcaatatttgggcggtgagatggggtcagctgttttcacttagggccaaggtcccaggttaagggtggagtttagccaggagcccagccattctgtatctcaaggacaccaaagagcctttgtttatgtgggtcatatctgttgatatgtatcacattatcaattaaaacttagagggtgtctgtttccagccatggaataacttcatttactctcctacctaaaacaagcaaaatgaatgtacaaaacatatgaaatagcaattttcaagatactggccacaaaggacagggatccttgagaggtaagcaaaaaatgcgatgagccttataatacagtttcctggctgtagtatgggcaagtgggtattccaggcaaagcctggagactctaagttaaggagaaagagctgagagatcagaggaaccaaaggagttagagtttgcaggacacagtactggaaggagaaacccagtgatctgcagagagttcaccttgagtattcatttggcatgcaaaatacgttctctgaccacagtgaaattaaattagaaatcagtaacaaagcccttgggaaagtcaccaaatatttggaaattaaataatccatttcgaaataacccataggtcaaagaagaaattaaaaccaagaaatttcaaaaatattaacaataaacccattacatgttagcataaataacatattttgattaaaaaaaaaaaaaaactgtttccccctctccaaaaaatagaaatagagatttctattagcccagatggaataacagagactatatttactctcctccatgaaaaaaaaaaatctagaaaacgaggtgaatgttgaatggtttttcagataatgggaaacaggtagcacaggactgtgatctctgagatagagagaaaacaaatcatgacttaggccaaacgttgctgtgaacagacaacattacatttcacagagatagaagggaacaggggtttcacagcttggaagcagcaaaccttgacaagaccagccttattagagaggtcagaagtgtttagagttgattgagaccaaattggaggtgaggaaatgagaccattaaggtagacaacttttcgggggaggttttactgtgttaaggagagcaaaaaaatagggtcatagctggaggggggtgttgggtcaagggagggttttgtttgcttgttttttaaagtttgttatttaaattgggagatatttaactcagtggctttctgacctttttgactacaacccacagtgagagataaattttatattactactaactgtatacatacacatgactgaaacaaaagcttcacaaaatggtatttaccttttccatttttaacgcattctgatactttctattctctttattatttcattaagaaaaaaatgctggtctggatttactgagttattttcataattcacactctaggttcaaaggcacagtctctctgttcacagcttcatgatggaatcctgagcataagttagaggttagcctttaattatagcaaggacagttgtttcatggtaagaacaagggaaatagatcataagtgcacagacaaggtatactggtgcttggaagatgacagagtttctgttagaatgattctatatttttcaaagtagtgtgaggccaactaagaggggccacatggggagtgtcgaatatttgaatgaagagaagaaagtgtgagatagatattttggagaatagtagagcaaactttactagagaaaggtgcaagagttttatagcagtattgaatgcccatttgagaattatgatcatgaaattaaagtgtcactagtcagttcagggctagatgaataagcctgtagtgaacattagccataactgttaaactctgttcttcatccacatttagctggttggctatcataggtgatatgatggtgaaagaaatatatgggattttactttggaaaacactgactccaaactcatttcttgatttaaagtagaagaagtatctcagtggcatcactgtagaagggtgtgagtcttttctactcttgagagagcctgtttttagtcttttgtaccactgggttctgggttcttgggcagacccagagacactctgactgtaagggctggtctaaagaagagtagttaaagtgatcagggagtaaagggcttgatttcgttctaaaaaagattacatttaaacttagagaggcacaaaggatggtatgattcaggtattcaaaatctggaagaaaatgagttgattgaacgtgtacttagtcatggacactcccacgactagctgagccacttaaaacttttaagaggtaaatccaggacacatgcccaccagaactgagattttaaactctgcagtattccttgccaaatggcagatcttctaaaatgaagtaaagaagtaagtgggaacaatgttactagtcttgatctgttgacatttttcattttctgagtaggggttattggaattctctggctaaagccagagtagtggctgccatttacttttggtttccagcctagctgtggggtaattagatttaaatctgggattttattacttcagaagataataagtcattaagtctccttaactgttaatgtgattactttagcaaatttcttgactaattcttaaatctccagtctttatgtgtacagtggaatggccttagtaggaaaatagcttagacctggtctaactaaattatgtagatcccatagtactgtgtcaccctcgcctaatagaaactacataatgatgatggtagtgttagcccattgattctaagcagccagagaaatacaagataattatcctcaagtgcgtagagtgaaataggacctcaaagaaatcacctagcttgtgtcctagataggatctcacttgtttgtaaagagttagttttttccagtgatctttacggccagcatatatttcttttgctgacactttaattggtcttttatttaaaatatgccatacattttatagcccaacattagtttcactagaagttttcatacatgtaccatacacataaaaatattgtaattaggagcattctttcctgaatgtctttgctgtgcctgtcaatattcatgtataggaatccaactattttcttccttgtgcgtcacaatttagtgttttctctttttgcgttaaaagataattttcaaaaacaactaacatcattctcatatggatgtaaaatgaacatgtgtttttattaaagatttaaactcattagtagagagaagactgatattatgaggtgatcaaagaaggagccaaagaatcatcacatttacagatgaggaacattgaaatgaatgtataatgagcaaaaaactggcttcttccacattggaggaggaaagtcaattgaacctccacccaacaggattttgcatatctatagacaagaattattttccattgctctcagttatctacaacatacagagttataccatagctcaaaggcagtgaatggctggaatcttgggagagtagatttagacaatgccatagttcaactgaagcacaattttttccctacacccagtaaattccctatgccttagtattatgctaaggaaaatggaagaaaccaagtgataacaagtacattgttgatttttgtatgaaaacagtgtcaaaattttgttttaaccatttgtagtatggttctccctaaaaattttataggatttatgacattactttggactgtggcctaagtatttaacgttgctagataagtaaactgtgacctcagctgcatggttcagaatcacaaatacatgccctaaagtccatacagtaatgatgactggctgctctttattgaacagattggtacattaataatgatgatcttgaggtcagggttaattatattcaaaggtgttaaaatggtagtaaataaagattagagttagtatagtatcgtaagataaggtagaattggttgggagagatcttagaatcttaaaggggctctactgggaaaccggccggaaatgtgaagaaaaaaaggagagctggagtagacggacattcctttgttatgatgattcaactttcctagaagcttctattttagattcagcaaatactcttagttctcttgtatcttggaagttagaatggtatcatttgtatatatttaagaaagcgggcatctttcatgctcttatgattatgtaaaagcctttctagagaatggagtttgggaagaaacctagagtagctaactaggaatatcatgtttccatatttgtatttgaggaagggagaagataaaaagaaggttccatgacactccagccctttgtattcttatgcttggcagcttttaaatttattgcaagtgattcctaaggatgctgttcttgagcaagcttgtacacctctgttttttgttttttgttttttttttttgagacagagtcttgccctgttgcccaggctggagtgcagtggtgcaatctcgggtcactgaaacctctgcctcccaggttcaagtgactcttgtgcctcagcctcctaagtagctgggattataggcacacaataccacacctggctaatttttttgtacttttagtagagatagggtttcaccatgttggccaggctggtctcgaactcctgacaaatggtccacctacttcggcctcccaaagtgctgggattacaggcatgtgataccacacctggctaattttttttgtatttttagtagagatggggtttcaccatgctggccacgctggtttcgaactcctgacaagtgatccattcacttcaggctcctgaagtgctgggattacaggcgtaagccaccatgcccatcccttgtacacctcttgatattcagtttgtcagttgtagatggttaactttcatagtcctagctttactgagaagatcttttgaatttcaggtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggtaagagactataattaaaaacagacatatgtcgaatttcattatttacttttaatatgaaaaaattaaaccaaataaatttactttggagttcttagttctttgaaatgagaaaaagtatttttagacaaacttcatgtagcagtttgtaaactagatttattactatggggaaagtggttggaagaatgtcctgaagaaacaatctctttttgtctatcgtcctttcagttaatgataaatcataaatttctttgttatttaagcttcaggatgttttctaggtatagaatttattggtggagatcctgtaaagagagtgaattatttttgtgatagaacactggtgtttactttggatgaaatgttctgccaaacagtctaaagctaacatacctggtaggctaatacagagcacgttccttaactttgatccattttaaaatttgaaattgatattttaattctattgcctgggctttggaccagtgaacaaaaaagaatcataatgggggaaagtgcgcaagaaaattgcttattatgtttttctatattgtggtaaaatatacataacacaatgtttatctttttaacccttcataaatgtacaagtcattggcattaagtacattcacaatattgtgtaactatcaccactgtctatatccaaaacattttcatcattcccagcacaaactttgcactcatgaaatagcaactcttccgtcccctctgcctcatagccctggtaataacaattccactttctgtgtctatgagtttgcccattccaggtacctcatataaatggaattgtataatatttgtctttgtgtgttggcttctttctctaagcataatgttttcagagtccttcaatgttgtagcacattttaaaattttaaaatattttaaaatttttgattaaacagtattccatagtatgtatatgtcatattttgtttatccatttatctgctatggttatttccaccttttggttcttataaataatgctgctatgagcattggtggtcagatatttaagtttcagcttagagtgcgatttctgattcatatgctggttctatgtttagaaccttttgaggaatcgttaaacttttccatagtggctgcattatcttacattcccaccagcgaagcatgagggttccaatttcttcacatcctcatcaatgcttgttattttctgatttttaaattttttaaaaattgtagatgtgaagtggtatgtcattgtggttttgatttgcatttccctagtgactaataaacaatttgtgcataaagtgctgcctcagtatgtaactcatggtcattgaacaactcgaacttgttcatgcagttgttaaaggatatttctagaaactagtttagcacttgagaaaatctgactgaatatttcccattaagaaaagtttttttaattagttgaaactctcttgaatatcattgatggcttgtatgtatttatgaacatcaatattactctttccggggttcagaggtgattgctgcttttagattgctgtgcatgaatgagatgtctgagagggtaaggtatgtgagagagatgaagacagacacagactgactgaaaagatgcattttgtatagcatcatacaaccaatataattgttgctctttagaacattgaagtgctcatgtaagtgaacaagttgcatattctctcaagtgaaaacttagcctgtttttgttgtgtgtctctggggagctctgatgtctgagcctcactcttcggggctctattttggagtcctgcattctgagatctaagggcaagtaggaaggataacttattttttatgcccacagattattgaatgctgtttgttcccaagagggaatatatcttctagaagtgtatgtaagagtggaagaagtaagaaaagaatacagacaatgtgcaaaaataaaagattgttttaagttgaattcctgttccctggtttgctagcttgcttgcatgcacctcactagttgagtaatatagtccctgggtgaaccgagttgactgggggattggctcctcttaatgtgattctggtatctgtttacaagaggagttcctagaggttcaggatggtcatcctggctaaattctttttcccttttccagatatacattagagggtgctgttttgttttgctaatgatagtttattgacagccagatgacattaggaacatatttttaggaattacactcttgtgaagtatgctgttctctcagtgtaacaaaaacttagaactatttctgaaaaaaatttaactgtatgaacttggcaaggttttttgaagaatttgttatgttctttccccataaattctctctgtataatcaaaccttgacaattgtatttttagtgtgctttgttgaagaccacttgcctctacaagtgcttgatgagtgatgtgtgaaagctctgtttctctgtgaggaaacacatgaaaggagctctgtagtattattagcacatgtagcttgcatgtgaggtacctcctcagttcctgaaagttaaggacagcacagatgaaaatcccagcagcgttcatgatgagtgggagaatcctgggcactaaagaatctttcacagatattcttccactcatatttgtagaaaattggccatacccatatgccacatttttgtaaacactgcatccttccagctttttggggtctttatttttatctgcaataagagaccttgaaatctgagaatatgacaaagaatgcacggaaatgtgatgtgtattggatcaaatggaaatattccttatgtctgtttagttgtccttttccatagagaataattagattctagttaacctagaaaaatgtttagaaaaatgtccagatagattcactatcatataatagtagcaaatattgtggttgtcttattagttgaatctgtagtctttttttggttatacttcttatgttggtttgtcagtgttctctgatctatgaaatatgcaagaattccttagtgatatgttaatagaggcctcattagaattacaagattcttcctgcttctggttttaaaataaattttatttttaaactaattaatcttggaaaaacatgggctggacagtataattagatagcaccattgtagtgttaattcttgctctctggctgtcactagagttctggaatctatgtgacatatacttcaactttactaagtgcacatggcagtattaagtgttgcagaagtaataggcatacagaagttgtagattttaaggtactcttaaatttattttttcctaggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaataggtaagaaacatgcagtagttgattattttaaatatctacttcatatgcacatgtagatagataggcagaaataattagaatgtagctttgaggcatggcatggtgtgtcactcttacatttcagtccccttttactgctgggtcttcttcacagtgataacaaggcaggatttgggaaggtagtgcagggatcacagggtgagtttggtctctactctatagcctttatgtagatacttttcctaccgttggaaaagaaagcatgatagacagtgaaatttttgtcaagacgatgagtaaaggagataaaaacaactatattggaaaacagaaatgatcagaaagacatggcgcataggagggttaagaaatgaaaaatttaactgagtaaatagaatagatggggaaactttaaaaatgagaagtttggtaatgagtcattttgaaaagatattttaaaaaatatatagggtttattttacacacacacacacacacacacacacgcatgcacacacacataccagtttttgttccggtctttcacttaatgttatgtcataaatgttacgtttctataggttggcacaaaagtaattgaaaccacagttacttttgcaccaacataatagcttatgtttataattgttattttttaatgagtacagtattctgttatgtctctgcgctataatttaccagacccttcagtttctgttagagctctacatttttcccagtgttctacttatgtacctgatgctatggtaaagctcttcctttgtttctattgtatactttttttttcatttttttgagacggagtctcactctgttgcccagcctggagtgtggtggtgcgatttcggctcactgcaacctccacctcccaggttcaagcatttctcctacctcagcttcccaagtggctgggattacaggcctgtgccaccacgcctggctaatttttttttttgtacatttagtagagacagggtttcaccgtgttggccaggctggtctcaaactcctgacctcaagtgatccacccacctcggcctcccaaagtgctggaattacaggcatgagccaccgtacctggccacttatctttattattctgatatgtaggcattgccctctgaatgaattgtactgatttaaaatgcctacctatcagaatcattgcttattgccagtgttatttaatgacgctgaaacttagtcaagagagacacccatttgattctggtaactgataccatagaaatcaggaaaagattcaaacttagaagggactaccagtcaagaccaaattcctttagtagcatcatactatgtggtatttatttatctggtccaactgggtgttctcagggtggggttaatgagtatattacatagatttggccttgctgtgctgaagacatgccagtcttgtcaccagcttcatactcaacccctcagattctgttatcaaggacgcttgtaatcaaattgaagcttaagtggtagaggaaattttcattttggggatgttccttgtctttcacttcatttttccttgtggggttcagtgttgtaagcgatttctattatccccctatattttattatttgatttttatttgtatcagtcatttatactgctgacagttgaaagaataaaaacagaatgaagcatccttattttgtttccctgcccatttaacttcagagtttggtttagtgtctagttgtagcagtggatattttgctaattaaaaaaaagaatttcctttgcattagactctcagagaggataatcttttgtttcttaagcttgtaagttaaatgtaagcacaaatgtttaattctcttttgaacttgaatttttgtagacatccatgagaactccaatatttggaactaacctaatgttcttattttttttttccttaaaaaaatacagcactttactttttataagaatttaaagtgattgactaaaaggaatgtattctttctctctctttttcttctatctttaatacaatgtttcctaacccttttcttcagcacacatagcaaatgatagtatttctgtggcatgccaggataaagagatgatgccgccatgggtttcagccaccctgcgtctcactgtgggctagggattaatgcctagtgtacaactaccccgtgggtgagggagagaacacaccaaataggaagcttagcttttattatatgaatacaccgttgaacagttgaataggtgggacatacatggacaaataggctcatggtgcttctgtggtagaaaggacagcaagagcatttgaagcgcccctgttttggggcaggtaaggcaatgattgagtcagtcgaaaaagaaattaagtgacttaatctcatgatcctaatgaatggtaaagccagttttctgaattcagatataatgctttcttctgcttttttttgctgttctccaaatctcagaaggcactgaagccagattaaaagttaaatgaacaggtgacatattaaagttacaggtttatgagtttccccactccactgttttcatgtagctccagaaccttagaggataatggaagacagattcagtccaatgctgtttttcagagtagaatctatcatgtttttaaagttaaaaattatcagtgtacatattaaatacaagtttttcagatttagaatttgttcttctgaaaataagagtcctgaatgtctcctggacagaaaaccctggttctgggggttttaggatccagaagacagcatgcccagatgggcttgggttagttcacttgatttgcacgtgaaagatgtgagggtacaggaactgtgtgggttggggtggtcagaaaagagggaacagatatggctatagcaagagagaatttttgcaggttgttttttaggactagatctaaacattttaaaatcagcatttcaactaggattcctggataatgggaaagtccagtgttcggaacagcatgtatagcatgtgacctcttttctaaaagggggaggaatacttatatttgtttggttttgcataaagaaacactagaagactacacaacaaactaatgaaagtgattgcatgttggagatgagaaaacaggttggatgggaacaaaggaggaagtgggccaactcagtatacatcttttatgtcatttgattttgaaccatgtaaatatatcaatctactttaaacaaacaaacaaacaaaaaagagagcaagtactgtttaaaccttactctttataaagttttggaaatcatctcatcagtgttaatcgtcatcataaattggttaataaagtttggtggtgtagacagtaaggaagacaaatatattaatgaaactttgtaatttagagggtattggaattattagaaaaactactaagtaagtgtttatgtttctggtcaaattgagagaaaaaacatcaaactagtggaacaatatcctaagttggaagtgaagtatcttactgtaagtcaatgatggctttgtattttttaaaatcttcataattgctgttggaaagttgacattatatttcattttataacttaaatgtgacattcgatgaatgtaatgttgccacaaaatctttttctactaaacctcattactgtgtgtattttattatagccttttttgtgggaatatttatgaactttagaataccctgaaagctaaatggttcattctgtttcaggtggtgagtttttttttttggaactttctagagaaaatgtgagaacatgaaacagttcttcagtatcttttccatttttgaaagagcttcggccggacacagtggctcacacctgtaatcccagcactttgggaggccaaggcaggtggatcacctgaagtcaggaagaccagcctggccacatggtgaaacctggcctttactaaaaatataaaaattagccaggcgcagtagcatgtgcctgtaatcccagctactcgggaggctgaggcagcagaattgcttgaacgtgggaggcggaggttgctgtgagccgatatcgcgccactgcactccagcctgggtgacaaagcgagactccatctcaaaaaaaaaaaaaaaaaaagcgcttaaactgggtgtggtgcatgaggcagaccatcttttggatgaatggaacatttgttttaggggaatgtatctttgtccaagatactgtgacatcaagtccttgaaatgtgtatgactccttgagatccatgtacctagcagtcagtcttccttgtttcattgtgggaggtcagctcagccattggctttatgactctggaaaggtgcctggcacatggaattttaaattaatctcccagagtttcagtttcctcattgaaaaaaatggaataatagctttttttgtttgtttgtccctctaacttccctggatgagtctacaaagcaaattagatgatcatatattgtgaatgctttgtaaatagaatgtaaacttattgttgcttggtttcatctcttgttaaggattttgcatatattagtaagttatttttattattttctcttaagctctcttcattttatctttctttagttctagtggagagcagtgaaactcttagccttgttttttccagaactgtgttgatgtttgtgcgacaaaaaccttattgataagtaggcaggagagcgtattcttaactctggtaaaatcaatagcatttgatttttctgctaccactattgaagcagcacaatgtggcaaaacaagatgagttttgcattcccattcctgtttttctacttactttaatttctctcagcctttgtcaagtggggagaaaacttagggtgcttctgtgaattaaagctaatgtgaaggctggatgtggtggctcacacctgtaatcccagcactttgagaagccaagcaaggcgggaggatcacttgagcctgggagtttgaaaccagcctgggcaacatagggagatgccatctctacaaaatatttaaaaattagccagacatggtggtatgcacctataactactcaggagatgtggtgggaggattccttgagcacaggaggttgaggctgcagtagctgtgattgtaccactgcactccagcctgagtgacagagcaacaccctgtctcaaaaaaaaaaaaaaaaaaaaattaaaaaagctaatgtgtacaaagtaattatcactgtggcctgtagaggtagttgctcagaacatgataattttcgtcattgtcataattgaatgagttttttggaacctggaactttactattctaatacgttagccaactgctaaaatatttggcatataaactattgtttgtcttacagattactaaaaataggggtttgagggaagattcatggtagctgacagaatttatttaagtaccattgtctggtaggcatgttgtcctgcattgatcctccagtgatctacccttgaagagttattgttttaaattggatatactcaaccacgttcaaattagtgccacaattaagggaagaaatatgggcaggtaactactagatgctagaaaaattccacttgtaggtaatccttaatcctcaggatttttatagcagatgtttgcgttttttcctaccccgcagtaccctgtgtacctgccatgctggttctgatgaatttacaccctggtgtcatagaaacagtggaaatcaaagattaaaatagagcacatagtaatcaggttttctcgggcaaattggagcatggtgctgaggcaattattcagataattcagacccaaatctgttttatgaaaatggaactgacatttgttgaacatttactgcgtaccaagctctatgctaaatatttaatgtgttatattgaataagcttttaaaaagccctaaggaatacatgtatcattatcctgattttatatgtgaggatattgacacagaggaaagttaagtaactggcccaaaattacacagtaagtaacagaaatgggacctcaacttaactttgtctgacactgaaatctgagggttttttctctaactaacattaccagtcatacatttgccgtaggtatttgacatcttacttttcagcttcagtagtaaattctttactagtagaatgaaataagatgctacaaaaggaatatgcgaagatagtgttttactttgctgaagaagctgtgctactttccgtcagagaatgacaagagtgagatattacagaaaaaccagcttggccaaggtgtgcatgtgtgtgtgcatgcacacacacagaattagcttacatttctgcaactttgacctgaaaataaggctaaaagctgactaaaaggtgtgaaaaataaattgcaggtgttctaaataagcctattaatatcttcctggaccaaggttgggaattccatcgaattcaagatttgattttgaatctttgccagtgagtctttctcacatgtaatctatatattaatatccactgtagcctggaccagtagggacatcagagagggccatttgaatgcccttccataggggagctgtaacgttcatgtaccaaaccttacattcatccagcttcttgaagcatggtcttccagaatgtttcaagaccaaatagtagacaagctgaaaaagttcctcgttctagactttaaagctgcagttgtgtaggcttgtatatgctctgaccccagaaatatcagaatgagtaattaattttctcctttggaagattttttaaatgtcttgaaagaatgttaaaggaatttttgatcctcaaggcatattaaaatgactaagacttcaaaaatattaattgcttttatccccagggaagcgatctgagtgataattttagtaacactgactgctatacctaagtgtctttttgtaaaatcctatttgtgaaactatgtttaattttaggaatgtggtttttgagcagatatagtaataagcacattacttgaaaaaggaatgagcagttctgtctggtattttaattgtattagcatcaactgtgtttttcagtggtgactagaattggaacagcagatatagcagataatcctgaaacttcattttagataaaattctgaacctcccaaattttgtatcagtccatttagtgatttggttatcattcaggtgagtgcctgaggtggggcagaaggaaagataatgggaattgaagacaccagggagctgtgcagcctggctgggcagtgacattgaagtcacagaggaagaggagattgcaggcaacttctgagatgtgttttttgttaaccacctctaacatctgttttcactgaggtagcatagcaaaaacctcttagatttatgtcattagtgtactgcaaatgttttcctttaacaaatcagtgatttgtggtggtgattcgaaagcccctaggtaaattgatcacagactctactaggttagttgacaggcttggccatcctcctttcttagctagaatactagagatgctttgtaaccttcctgtttaaaaaaaaaattgtgtgtgttgtggagcacaagggggtgttggcaagaagcttactttactctttctccaactctgtgacccctgccaggccccagaactacatgatcctccgcagctcccatttccctagctcgtgggttttcagtaggagcagtatcacccccaaagggtggaattttgtttttcgtgggggtgggaagtgggtaaaaaggttactgtgtatatgcataaaacacagatatatatatatatattttttatatatatatgctttatacatgtgcgtgtatgtgtatctcaacacatgaacaaacagacatcatatttgtggtattaaaatttcatgggattgggggaaaagtgtaaaaaggctgcttaggaagatgatagttttaaaagcttgagaaacagtaccttaagcacatcaggtaaagaagaatggatgacactggagtagagagaagggaatgaaaaggttgggttaaaacagcttcagctttgtttaaattggagtagttctctccaaggtaaggagtagcaggagctggggtcttgtgaatagaagggtttagaacaacttctgttgaagtaggggtggcagggaatctcagcctccctggctagtggaaaatactaaagatggtaaaatctgcctcagtgttcttcagcgcctttggcctttgctcctcctctcctaatggaaactacatttggctctctctttccttgcccacccccactctccctccttcctcttactggtaaccactggtttgctttctgtcactatagactcatttgtttttttctagaattttatataaataggacgatacagtcttcttgttgtctgtcaatactgatgtacatatccttttagttccagttcagacatcataagagatcttttagaagaagaggaagcctgggaagcatcacataagtgagttctcataatcatgaaataagcatgcactttgacctgagaaattatacttctatgcagctgattttcaaacaaaattatatttgtgctttctggtttaaagaagtagtaatcctcatgcaaggtaaagattttcagtttactacttgtttctatatatttctgctaagaaatggaatcctatgtaataactgtagttatgtatcagatgttatttctgtatggataaattgttcttatgggcaattaatacagtcatgcatcacttaacaatggggatacgtcctgagaaatgtgatttcattgttgtgggaacatcagagtatacttacctagatggtatagcccaccacacagctgggttctagggtatagcatattgctgctaggctacaaacctgtacagcattttacagttaggcatttgtaacacaatggtacctgttagtgtatctaaacctagaaaaggtacagtaaaaacatggtattataatcttacgtaattgccataatgcagctagagcgatcttttcaaaatgcaaatctgatcactgttactcatccctctgctctaaaaatcttgaatggcttcttgttccttttaggttcaagaagggactctttaatatgcctaaaaggtcctaaatgattggatctctttctccagactcatctcttattatttacttcatattctctctgcttcatcatatagatgtcttaggtcctcctgcatgaaaagctctctcccaccacagagcctttgaacttgtccctctacccagaatgttctttattttttcatctagtttacacccctactcagcagctcaagttcttcctggatccagtcctcctacagtaggcgcttacagcactgtgtccatctctttccagcacatttatatgattatttgtttgtccatcactcccactggcttataagttaggcattttaaccccactgtcaacatgagcctaactcatagtaaatacatgtgtgatctcatttaaatataacactatgatgtactattatccctgttttacagtgaggaaactgaggctcaaaggggtaagtctccagcccaaggtcatatagcaataagtaataagtgatggagatgagattctaacctaattgtcaaaagtcagcaccctcaaccattaaactctactatctttccaaaggtggagaggcttgctgtgcagttgacattttgtagtttcatagctgaatcactgggagagtggaaaagtatggtgtatccagggcacacatggttttattatgagatatttggtggttcaagcagtagcattttatgtaagtttgagattttggctgcattactgtctctcacctaagcattatttaactttgagttctggaagaggaggagactccttagctaactactttcctcttgtacctcttcatactgaactaaccctgacaccagtgactatgagcccagagttcctgagcccaagcctgctcttgataatgataacttcttaaagtgattactaccagaaagcacttagaaaacaaatcctatcatttcagtttttaaagcgagaaagatacaagagctcatctagcccaacccatttgttttatagagaaggaagctcggctccagagaggtaaactgacccttggtcaaggtccgaggactagttagtgatacctccaggatcagaatccaggcctcctgatttcagcagaatatagaatagtttaaacagccgcagttccttctaaggaagaacttctgctgtgatgtagttttaaaagcagaatcaggaaaagcctccagagctttacttttcaacaaaatgttgcagttctacaaatacccatcttaagcttataggcatttttttgtagtaccacaagtggcatatttgagatgttagtcttagaacataccatatcagttccgacacattctcttaattccacaaatgatttagaggtttcgttagcaacacatggctccatataaagcagggtttttgtaagcagcaggaaacttattttctgcagactggtcttggggtcttctatctacattttgtattcttttatgagatgattagtcagtgtggccacgagacacaggagaggctcaggaaaacttgtttcattatactcacaggtcctagagacagggcatggcacaccgtgcaggtccacaagggaaagacactagcgtggtcaggaggcagaagacaggaacaagggaagtgctttaggctagaaccctgattggggttttctcaggaaaggcaaggcagggtggggtgaacagtgcaggactggctagtttgaataatttcagtggctccaagctataggagtggtccctagttacctagaacctggccctggcatgattaaggcagagggctattgccttttagggtgttggggccagatagaggagttgtgactctggattggttagtttgcatgtcacaggcatactcctggctgggcccgttgctgtctctgagaattgaccagcctctccttatgccagcaggggcaatctctccccagctagaaaggctatatattatgatgtcaaagcatcataatatataggaaacacacccacacaatttttacttagcctgtctgatggttccctgaagactctacttgcaagacttttactttacttgacttggagcttgctcaattcaaaaagccttttctctaagggtgtttgttgaaagtaatgagaggcatttgactagctttgcagctgtctgaggtggcggataacagttggggcaaatgatacgccaaccaaaaagcaacaacaacaagctacaagatatatttacattgaacagaatgaaaatagaaaatggtcctggtgttacttcacattttggggtctcagtttctttacacataaatgtgagtaaaatatatatgcttcagtgagtctaagccctttgctccagatctgcgtctcctccagtgtcccctcttctcagtgaatggtaggatcatagtcctccccactgttcaagccagaacctagcaattattttaaacttctcactctcccttaccactcacctgcagtcacttgcaaagtcctataaataagtggttcacagacttaaaatcacctggaagacttgttagactacagattagtgaactccacccctagagattctgattcagtagctttaggaaggggcttaatgattggcattttaacaagctcctaggtatagctggggcagcttctgtactgtctcaatccctttgtgccactgcttactcctgcaggccctttactttccagcttgcagcaaccactgtctagctgtctctctgccttggtctgttaccagttcattttgccagtgaaacgtaacatacaggtattttcccccttagactttaaagtagctctccaccatccaaggcttttcatgttctggccccagcctacctggctggctcatggaattttattccctcacttccctaccccacaactgtggctttggccaagctgccaagctgcaccactcacagttgcctcatgagttacaccgccttgcctctggcctttgcacacgccgctgcttctgtccaaattgccctttcccctttattcatctagatagcagttgacattcctttcttcatactctgttcagaagcccctgattttgctccagcagcactctcaccctttctagtgagtaagtacactggattttaaatccctagcacctagcactgtgcctgggcagcccagcataggcactcaataaatatgtgaatgaatgaatgtgtctgtctgtcagtcagtcagtcagtgtttatgggatctgagtgtattcactagtagattctatgttcttacttggcttcaagaacctgtgaatgaataaggatcaccactgtaaactaaaaacaaaattttaagccatcagctgactgaagagactcccctattggccaaggggacccatagaaaccttaaaaacagtccctggccatgacagcacaggaggtcagacatgcctcattatacctcctcccttttgcagtgtagacataacaactggccaacattaatgttagaatagagatcataggactgacagaacagatttttttgtggcaataaaataccaaattatagacaagacctaaggccttgccaggcaagggttaagtaaatcaccccacacttaaagagtaattatgttctaattgccacaaggtttttctttttctctagcagctaaacaagcactggccttgagataaacaatgttaaaacaattgtagcacatctatacaactgccagatgctgactaactgacccacccttttccacaagctataactacagcattggtttgacaagagactgatttcaataactttctcctgataagagaccactgaccatggactggttctggctagttttatagtggctgagcagttgggtgcctttatgtcctagaaagaccttttgacatgtaaggcctaactgtaatatatttaaatgttaagtctccaccccagaatgaacatgggttgtgtgaaacatgcatgcatgcattaggacatgcattaggatccccctttatgaataatcatagctcctcctgtaacctgttgaatatgtatgtttggtccacacattcaccctaaatcccttttccctcttccctcccttacagtgcctgtcttttgggctctgccagagttaacacttctcagccttgtcagagtggtcacctttctggctgtaatcatttataagaaataaaggctcctttccaaagttgtaaatttgatttttaagctaacaccacttaaaaatcttgctaactctttgtctctatctcatagtgcctttaaaagaaaattttagaaaataactttctctaatcttataaaatcggaaaaggaagaatcattttctctattaatagtctacatttcatcttaaacccataagaagttgtttgcatgcacttatgagcctgtcatgtttgttaaatgatacaattactgtaattgaaagtacttgcagcaagaaaacagtgaatcccatctttaaaaaaatgaataaaaggaaactcaggcctgtttacagtggtccttgatctgaccactgtctctttaatcaacatgaggcaaggagagccacacaccaagagattctttctatgggcctaccaagaaggaaagtaggtcatcctggaaataatgtgtattggaagcaggctgatgatgaatggccagatctcctaaggcatgtttttgcattcagtagattcaacactttaacagtagatagatgcctcactgtggccctccccaggaatatcctcccatctggctaacatgctattgtcaaattttactaaaagaaattcattagtaatacctgctggagaccaagaatttaaaaacctgctgtacctgtgagatcttatgaagtgttattccagtaagtcaatgtgttacatgcatggaaaaaaatgtgggctgggttattctattaggattcttgcatcttaggggatgaggtgttttagagaattgttctgggagaaccgctgagatccttgccaggaactcccctgctaaggaagtggaagaagtatagatgacttcttgcactacctcaatagctgtgtctgttgccagctatcataaaggcaaatcaaagaggggaaacttggaaagaaaatattactgaaaattgttaaaggattattaaaaacaaggtatgagaatagagagtgataaaatagaagttaaaagtaaggaggaacatcccactaaaacttaagccttaaaaagagtcagaagtcaaataagtaaagatgataaaacattaagataaaaaatttgacatggtgaaagttgagagattttaagaacataaactaaaacatgaaaaaaaagtaaaaatgataagagtgatagcaaaaatggtggaaattctctgctccataaaagcaataacaaaactgcaaaaattgtcagaatcaacttttaggaaaactctgaaaattaaccaaaagcagcagcaatttaggtaggggtcatttattcaagaaaaatgtctgaatctcagtgagaacagtgagctttgtggtgattcgactggctttgttctcatccttctctctccagttcctctatggccttgggagccaacagtctgcagtcatggtgaggaccagcaggctgacagtccccagagaaggcagagcggggttggagcccctttaaagccacattcccagagaatttttacttagcctgtctaatggttccctggaagactctacttgcaagactatctttactttatttttacttagcctgtctaatggttccctggaagactctacttgcaagactatctttactttacctgacttggagcttgctgaattcaaaaagccttttatctaagggtgtttgttgaaagcaattagaggcatttgactagctttgcagctgtctgaggtggtagataacagttggggtaaatgatatgctaaccaaaaagcctaatggtaaaagctgaagaataagatttccatgggggttttgaacagctataaaatattcctgggaatctagagggtcactctcattcatagagcttccgtgcatgcttaggaaagacctaaggaagcgctaaactttcacctctggttaaccatgaggctgtgtgcaagcaggaagtaaaggctaaggcagagttgtccactgagtgttgagtgaatgttgattgcatgccccagcacagacacagaacccaccagcaaagactggttttgctgagtttctgtatgatattggttccagatgtctaaggaactgttcaatcattagtggactacaaagctaatcaagcagacacttttagttgccatatacaacaaagaatacatatttataggattggtttagaaaagtcactaaacaataatagcaaacagcaacagcaacaaatcctggagagatcttgtttgttggttgtttatttttggtatttctcatgactggggttctttgaccaactttgatcttgatttgaagtgtttcaacgtttttagaaaatccacagccatatatatttacatatttattatccatagttctttctctcctttcttccaggtattacagttatacacatgttatgccatttttattgtcccacagctcttggctgctctattctatgtgcaccccctcacatactcctttttctctttgtatcttaatctggtttttattgacataccttcaagttcactaagtctttttatcaactttgtgtattgcacttaaagcctattgaaggaatttccatctcgaaatgggtttttcccttgcttcattgtgtatcatactttttgaatgcgggccatgcagtgaaggaccatagggactgaggtcgatagtgtttgtgcctagaaatgcacatccttctactgggtcattagtgtggggagttgagctgggtaattcagagttgacctggattggagtttcctagtgactaatgtgaccttcagtgcatccacttcaagttactctagcaggtggctgctttgacttctgcttagtgttggggctggattgccagagggtttttctcattgattttgctcccattttcctttcagccatgcttgctttcctgcaccaaataggggcatatcttcaccatgtctgtgtctctccctcagccatttcctgctcctgcttattgcttgttgctaggctgatggtgggaaacagccggggttcactgttatctcagtctagcctgagtcttaggtaggccctgtgtgcctgagtctcaggggtgggcctttctcagcacttccacctcctcccatggtatctggctacttgaccaaacctctgcgtggtgtcagtgtaaggtcatcagctggagatgatttactgcccctcctgtaaggtagaggttttagtttctaccattccccctgcagcagtgaatctttgcctgcgttcctgcaaatgaggtcatatgcctccccttgaggcagactgatttcacctctgttccttccccagaggccataggtctttgctagagccccagggggagtttcctgtgtttccctcagcaactgaaaagcttatgcttcatgggagagaagcattcaggagagcaggcaggacttcttcctgtcccccgtagccactgaagtggcccctctccattcacctgtcctgctcccagtctttcttgtgagcacctgacggaggctcgtggaaaagagctggcaagtgtgtgcagactctccttgtgtcaggggcctgcaatactagcctgtatttaagaaattaggaaaatcttagctgattcttcttacctgtttgtatggcagccacctcgttctccaacactctgccaaaagtgagagaagtgtggcccatctttggaggggcatatttttctttggaattttactttcttagttcctttaaaacctcaggtctctgaaggatcaaacagagttaagattttgttagactgtctggctttttcttgttaggatgggagcagctttttgtttgccgttttttcccagccctctacatgctaaacagaagcataaaactcctaaattttaattcagaaaaaggggttcagagctcatttactatctgtgatctttgctaactcactaattcataaagtggaaatactaataataacaattatgaattcatcaacagaatagaggattatttcgaggttttaatgaaataatatgtgtgaaaacacttgtaaactagaaactgctgtacaataatcattactttccaagatgtcatttcctttttctgtcttcagaaacgatcttcaagacacagaaataagtccaagacagaatcgccgcacaagagccgctgaaagtgctgagattgaaccaagaaacaagcgtaataggaattaatgtgggcttttgctgacttttcaaatgcattgattagaataccgtacttttggttgccacagatagattttctatttataaatgcccaaggaaagatgctaaattctaaatattacggttagctgatattcattcttttctgcttttccagaggggaaaaatgttacaaaatatccttacttggtcagttgcctcctgcctctaaaacatctctctctaaaaatactgacatttcacacaggtaccagctttgcagaggaggtagactctttggcactttggcacagggatttggtttggtttggtttggtttgataattaaatttcagaatgtccttaggccattctccttctcttccatggagaatccagcctcacaaaaggattctttcaacttctttattgcaagaaacagttgagttaaatgtttgtttttggaaaggcgggatgtcagttcacatccttggtgtgtgtaagtaccgatgcacgccaccaccatgcctgtgttacagcagctccatgatggttgttgcccgaggttaatgtagttgtttgttagacctgtgtcttacacatttctcagagtaggatattagtattataatttaaagctacgacagtcacaaagtcacaataacttagaaacattgcgcatattcttctgaaatagcacttaaaaatgattagtgtcagtattttttcacttgggtcaatcaaatctgtaacactgaatccaagctattaaacaaaaagtatgcaatgaatgaattttgtaaatgaatagagagtatcagtttacaataatgttcttaaaacagtatcctctggatagttgagtatgggttagaaatcattgaaatggattggtcagaaattgctatctgtgtaaaatgtctaccagtagccagatgcttccagagttcttaatgcctctctggcatttcagagccagcatcccccaactcccacccctctgccatcacccagcccaaacacatcagctttcaaatgagatgatagtaaatgcggcaatgttaagacaagaaatttatgatttgccagattcaacatttatgacctccccttccaaagactgtctccgttgaccttgtctttttggtatgccttggggtttctgataatgtgtggagtctcattatggctgagagtttagtgttttcacagtgaagtgcagacatttgatttctttatgagttccctgtgttagaaatggctatagaaaaatttgtcataataatttcatttgcatgaaatcctgaggggtgcattaaggaaactaaaagcaccacttaccaaatctatcggcagaactgatgtgaggtaagtgagcatgtcaaacaaaataggagctcacatggatatatttatgtcactgagttgtcagaaattatgtcaaaatgaaaactgtttgtttcatgacaaattatatagtctataaattaaactggaagtaattattactttaattgcagcaaaaggagtttgtgagggagcggtgagacccaagattgggaaagtaggcacatgagttcattcagcaaatatttggttatctatgtctgtcactgtgctgacactgggaatacaaaggtggccaaagatcatctagaacaatggttcccagtggggtgggcagaaagattttgccccccaggagacagctggcaatgtgtggagacacttttggaggtggagggtggtgaggggtactaccagtatcaatgggtggaggccagggatgaggctaaacacccaaccctcatggattagtttgccagggctgccgtcacaagatactgcagacggggaagcttacacaacagaaatgtgtattctcagaattctggaggctggaagtccaagatcagtagggtttcttcttcggcctctctccttggcttccactcatggtgtccttgcatggtcttttctctgtgtgcacatgactgtgcaggactggtgtcccgatttcttgtagggacagcagtcattggatcagggcccatgcgtatggcctcattttacttcagttacctcttttttagatagagggccctatctctaaatactgtcacattctgagataccggcagttaagacttccaacatatttagtggtaggggttaaggggcacgctttagactacaacactccacagtaaagaattatccagtctaacatgtcagttgtgccaagactgagaaacctgtaatgtaaaggaactcccaagtctacctgaaaagtaaggtctaaagagcatttattgagcactatctgttagcacttagcatatgtttaatattcatacattgaaagaaatgtatgttcatatccatctgacaaagattaaggaacttagagtaagtaatagatccaaaattgaaactgataaacttctggttctaaaattcaccttttagtgaaaatacagtttctcaccaaacttacagtaattcagagttattaactctttctacctcctcactcccctcaaagttataacatctcccatcgacatcagctcagaatggcagtgatgcttatggtttgtgggggtgcaggtgagctgctggatgcactttagatggcctagtatgccaggccgtcctttcatcctctactctcgtctttctttttcgacctcatgttgaggattactggtctagttgaaaaaagaattcatacacataagaccatgtatataatagagggaggtatgcctttaaaaacaaaattatatggtaaagactgatgtgtcaacagggatagacaacatagagaaggctagaactgtttctggaaaaaaacccagaaacaatggatttcaaacttcttagcatccgataaaagaaagtagcaattattcaaatgagaaacacttctgtctgttatgtacatattatgaaagtatgaacataagagggaaaaccacaaccattacattttttaccatttcagtaatttttttttggtttttagtctgtttttagacatccttaagaacaactatctgaggctgtaaacaagtatttacattaacacccatgatactgactttatactccctacctgcattgagaccttaaagggggcatttctccattccttctgtgtatttctgggtatccccaggttcagatattcagaatacagatacaagtccatgcttgcatatgttgctgctccccccgacagacttctaccagcatctgccctcctcaccgctgctctgtcacgtgcactgcggctggccctgctggaaagtcctaccttgcctaggacgccatccccgatatagccccaagatgcaaacctgccaagtgctagggcagccctgccttcctgtccatttcagtctcttggccttgctgtgttccaagtggaaatgggagtgtgctttcctggtttgctagtgtactatcacccggaccacagcgtcctgtgcaaaaatttgcttcctctctct

SEQ ID NO: 13336 - DNA, 20684 bp, Human
tgaggaaaacaacttcatctctcagaactctctctgcatacattgtaggtaaaagtctctttttcttcagctttttaatattctttaactttgaatattcaaataaatgtgacagtgtttcacctggagatgatttggtccaattgaaccacatttgccaaaatggcttttattctccccgttttaggaggcaccctggtttgctgcgaagccacccctgccgtcttgatgtctgtgctcagggatggctgaaaacagtcacagctttatcactgaagcaaacgaaaatgtaaatactttttcaaagaagatattgcactattatcaaaaaaccaaagtatttgcttattcatgacacttgagaccaacttaaaggctatttcttttcatttagaatgttctagaattgagcaaagcaaatattctttaaacaaggcctctgtgatgacagatcatttgatatacgactccatttttaaaatatctgtagctcttaaaatatttcacacaaggaatctgaccatttctgtttcgaagtattgggacagggtgcagtgaccctgtgagtcccagcatccccacagtgacaacgagctttccttgatggacacagagcacaggctttggagtctgagacagctggactcatccctccctgccacttagctcctgtgacactcaggggaagtcaccgctctgctgggatttagcttccatctctgtaaaagggggattaacagtgcctcctacacagggtggtgacagcaattaaatgaggaaagcatttagcagaatccctggtacataccaggtacggaaatgtactaggtagagctcttatgcttctcttgcaattgtttataaataggtcttatttattcccagggatgtattcttagcacatacttcattcattcatttgaaaatgcatttattgggtactcacagcagggtagtgtaaacatactcagaatacataacatactcagaataaataaatgcaggtgaatataaagacattctatttcattagttacattgaccttaaaccttctcagacaacagtgggtgagggagatgagagatggcagtgggtagggagatgagagatggcagtggattagggagattagagatggcagtgggttagggagatgagagatggcagtggggggcaggggcaggtgatgagttgcatttttgcaaaagctatataagaattgttatatactgttctgattttttttaatgaacctaaatgagcatggatttatttgctatggagtacttgaaatctttatttgaagacattaagaatccatccaggccaggtgcagtggcacactgtaatcccagcactttgggaggctgaggcaggaggattacttgagcccaggagtccaagaccagtgtaggcaatatggtgagacttcgtctctacaaaaaataaaaatattagccaggaatggtggcgcatgcctgtagtcccagcagtggggggcaggggggtggttcaggagaggattgcttgagcccagggaggtcaaggctgcagtgatccatgattgcgcccctgtactctgggcaacagagcaagaccctggttgaagaaaaaaaaaaaaaaaaaagaacaagaagaatccacccccaaacatatcaagataagacatccattgcttcaaacactgggccaggcagctgtatgttcccgctttcgttttcaggtaagaaaaatgaagacctagaccatggaggggacttgcccagagtccaatttcaagtccagtccggggctctcctcagcatccagcacacgcttccctgactttgcgcaaaggtcttgctcctgacagggaccgaattacagattctgccactttacccgagaattactctccaaacgcactggtctctttgcaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggctgctgtcgccattttcttcgtcatcaccttcctcatcttcctgtgctctagttgtgacaggtgagaaccagagtgtatatacctgtgccttaaactaatacatcccctgtacccagaagagtttctgtggaaagcctgttaggaatggaatcccgccacagagccgtcccagaaacttgtgcattagctttaactctcttctctctgctgcagagcgtctcgggacattctttattcactgaaggaaaacccatatttggttttgctagggagcaactagaagagcccttatattttaaacttcccagaatgaaagtcttgctgttctttcgatcacacccttgtcaaaatggattttgtcttttttcatgtgcgggcattttgaaatcttgtgtgatgcgcatctttttgccaccaccctgcggaagtcacagaatgtttgctgctacgtgatttcggagggattgtttatgattaaaaatgtgtagtgtagaccttcagtttctcaagaaacagattattttccaaggagaggaacatgctgtatatgaaataatcatcagtgtcctttttttagagttatacttctctctctcctctgtctcatataaaatgtcagtacccccaacaagagaaatctttgctcagagagaagttctttctaaccagaagtgatgtttcaggacattctggaactgttacaaagcacataaccttctgataggctagatgccaccagaggcccatgcagaccagctgaccgtcagccagccctgtccaaactctccctccaccatggaagcaactccaggagcgtcacttaaaattctgaaatagcttcctaccctaaaatctgtcaggaggagaaaagccaagaccctctgaacccagctagcctcctaatccctgcccagcctggacccagacctctgtggctgggacagagtctgaatgattgggaagatgaacaaagaggccgcagggccggggcttcccggggcctggacggcctgcttctgtagttactcatgttcccactaggtgtcacccttgttttatagagaacgtggatgggcggcgtattctctacaactgatggctttctttagactgtcccgagtaaaaacaaattctatttttacttgacagactttcccatagactggaagtacatatgactcaccctgagagcatgtacccttcctggcgtgccaaaaatctgtattttctccatcccactgcagtgtgtgactttgcagagactcagataattgtcttcattttctcaaaaaaaaaaaaaaaaaggtataacttactctgctagtttaggtataaacaatttctacgcaggcccaggcctcggtcctctccttgtgaacttgtatgttttttcccggaagaaggggtgccaggggaggtggacagtccctagttgaggcttgaactcctcttccccagcacctgcaaacgggccatcaaatcactgtctgattttgtctttgttgacaaaataaacatggttcttaaaacgagagatttaaaagctgataagaattgggataggaaagggtagtgtgcgcttgattttaagggggcacatttgacattacaacatttcacttttcatttcagggaaaagaagccgcgacagcatagtggggaccatgagaacctgatgaacgtggtgagcctgcgcgtgtcgtctgcctgtctgtccgtgcgtgctccagaacatcagctacttatctaagtgtgctcccatgtgctcacagcctgagtagaacccacggggagagctaagcctaagttaaacggtggcttctgaaatggatgcagtagtgctgctgccggaatgatccttaaatggctccaacctactgcagggatgggacttttttgcctctattaatttgctagtgctgtcataacaaaggaccgcaaacagggtggcttaaataacaagtttgtttctcagttctagaggccagaaatccaaaaatcaaggtgttggcaggattggttgcttctgagggaaagtctgttctaggcctctcctggggcttctggtggtttgcagccaaactttgggtgtgacttggtttgtacaggcatcaccccaaattctgccttcatcttcctatggtgacctctgtgtttcacatcacctcccatctatgtatggctggctgtgtccaagtttccccattttataaagacaccagacatattggactagtgcccaccctactgtagcacgacctcatattaactagcttcgtctgcaatgaccctatttccaaatgagaccatattctcaggtgctgggggttaggacttggacatgaattttggagagacacagttcaacccataacaacaggtcattaagctggagggagcttgggacccacaacaccctaggtatataacctagccttgctggcgttttcccagccctcagtatcttacagggtcctgatgatcctgaggccctcagggatccaccctggcgaggaacagcctgagagtgtccaggtccttccttgtcctctctgacccaggcccgtgcttttgaatggctgagcagtcccagccgctggggagggggcccatcgtcacattagcaaggcagagttcagaatctgccctgagtcctgtggcagtgctaagacagaagatgcttcttgttcaggacatcatttctcaaggtcaagcaaaaactggttgggaggagagggtgcaaacaaggaagcatggatgagccaaggtctggcgtaaaacccgcagccagcagacgtttgcagagatgaccaggggcatctccagtctaggcttcctgacctgccaattctcaggactcctctggcccaagcaggcaggaagttgtcaggactccccgttcctcctgggacccccaggattttccttccctcccctctgcatccacatgcccacctcacccttcgcagctttcctgggccctcatcaccactcctccctttactctgtttctcgccctgttcccatccctggttgtccacattgtcgccacttctcatctgttcccagcgcccctgctctgcctggtgattgctgctgtggtggcctcagcagggagggtgggagggatggagggaacgccccactgtcgcttctccccatgcagactccaggcccctgcctttcgtcactccaccattctcctggtgccagttgggtggtgaggtggggctggggaagggctcccaccgccattcctcacttccttctagagcaggggttcttctgcagtgtggcctggacctccacccacagcagcagcagcacctgggagctccttagaaatgcgaattttcctgggggtgaggcccagtaaaaggctcgcaagcaccccaggtgatccagttgtatgctcgagtgtgagagccactggcctagagcttgggttcccgctgttctactcaaggtcagcagcagccctgggcgagataggaagagagtggcaggtggataaaaggaaaaagctggcttccatcccctgccttcttcctcatccaccatataattcattattgccccaacccatagcctcatttatatggatgtgaatgtctgtgagagagcgcgagcacacacaggaacgcatgcttacccggacactggcacccatgtacacacgctcgcccacccagctctccttaagagcttttcagctcctagatcttatacaacttgcggattcttcatctcatagaagcaaagattaggaatagtagttagagtctagattatggtaacttcagctgtgatcgattatgctgttatgggcccacctgggagtcttccttccccacacccatgcctgcccatttataacatcatttctgggatattagcacctgcattgcaagttcctggcaacctaacacagtgacccatctcactgggggctcatcagacgtgaatgagctgcattggatggaaacagctgacttccaatacacttttggatcattgcacagcatgaactatctgctgtgtattactggcttccaatcaagagtcagagaatttgtgaggccaactagcaaaggtttgtgtgctgtttacatcacaactttccttgtagaatcctggagcatgagatagcctcttggaacgtgcaggctgtgagaagaacagggagcaaatcacatttgcagtgatttgggctgcaacctgagacaagttgggtatttaaagaaatacatgaacaccaacttgctttctgactactcttagctatagctgagccaggcatattgttctaggtagcatctacacattctatccctgcagaaaaccaactattgatgccattcttccctccaaatgtcctaagtttatttgtaagaataagaaagatttgcagagctgggcacagtggctcacgcctgtaatcccagcactttgggaggctggggtgggcatatcgcttgaggccaggagttcgagaccagcctgagcaacatagcaagatcccatctcttatgggagcagccagacatagtggtgcatacctgtagtcccaccgattccagaggctgaggcaggaggatctcttgggcccaggagtttgagacttcagtgagctataatcatgctactgcactccagcctgggcaacaaggtgagacctcatcttaaaaaataaataaataaataaataaaaagtttgcagagctaattttcagcatattattgtttctgtgaacctagcagccagaggctttgctggttctaaaatagtttcagaaatcaatagccttatctatctctgaccagatttaagtctgttcccttcacatgacaaagggtgatgcctttccacgtttctcatagcatggcacacctttaccaataatgatttacagcacctgtgttgtaaggatgaggctgctgtggtctttttcaaccagttcccttcctgccttgagctaagggaattgatatctcacaacctgcctatagccctgtgtaggtcaccaggcaggaagctctgcacatggctttggaagattcccagtgcccctaagattctgggacaacagtgtctaatagaactttctgcagtgctggaagtgttctgtatctcctattggatatggtatccactggccacatgtggctattgagcgcttgaaatgtgactagtcaacaaggaactcaatttagtgtattttattttacttaatttaaatctaaaaacagtagctccccttaatctgtagttttgatttctgcagtttcagttacccacagtcaaccacaatccaaaaataggtgagaaccatacaagatattttgagagaaaggaagagcacattcacataactttcattatattatattgttttattgtcagtggttattgttaaattactgtacttataaattaaacatcatcataggtataacatatatggataggaaaagacatagtctatatagggttcagtactactcatggttttaggcatccactgggggtcttgaaatgtaccctctgtagataaggggggactattataggagattctgttttctgtttctgctgttttaattttttgaaaaagccatggatcttctcctctgctctgcagtccagattcttagcaatgtgatgcatttgtttttgtttttgtttttgttttcagccttcagacaaggagatgttcagccgttcagttactagcctggcaacagatgctcctgccagcagtgagcagaatggggcactcaccaatggggacagtaagttctgcaaaaacaccagctttccacacaggcctcatcacctctggaagtcctaggtttcaaaatacatagctcaaaaagtaggaaatgtgttattgctcagttttagtattcctagcagttttagcagaacccctcatttggatgaatactgctacttattaatccacttctgtgtgccaggcattgttctaagactggtacatgtactaattcatttgctcttttagtacattttagtacatttacatgtactaattcatttaccccacgagattactgttattaataataacactactctgtaagataggtattattactcctcacaatttaaaggtgacaaaactgggcacattgctgctgtaacaatattaccacaaacctcatgccttaaaataacaatttattgacttgcaattctgaggtcaggagtctgaaatgggtctcactgggctaaaatcagggcatccgtaggcctgtggtccttcctgaagcctcaaggagaatccattggcctctccctcattcttcacatccctctctgaccctcccccctccctattcacttatagggacccttgtgattacactgggcccacctggataatccaggcttccctctcatccgggagtcatctaattaacagccttaattccacctgtagccctaatccctccataccctccacaaaacattacacattcacaagttccaggaattaggagacagacatttttcagggtcgttctgccttccacagagatgttgctaatttgcctgatatcatatagtcagcgggctaaggatctgtagttggaaccaggcagtctgatccctgggcacgcactcagtcactctgcataacctctgcatcatgcattgtgtactcttgctgatggaaggagcagctaggtttccttcatgctttagagtttacaccatgcttttacctgaggtaagagggcgtcctgttacccctgtttactgatgaggaaactgtggggtaatcaggacaccagtgcctgttctctgtctaccatgatgtagacaactagaaccagagagcaaaagttcaccccctccgtgatgatcagggatttagaacacacaggggtgttggtaagttcagaaggattgggggatccgttgtcattttttcacataccccttggaaacactatttctaattcccccagagtgagacactaatggaataacttgcttactttgtgtctgcatcctaagggcagggctttctgtttcattgaatgatgtgtctgcagcaccctgcaccatccctggtgcatggcaggcactcacaacacggttgacaaagggacgactgaacagcttcacacaatagcatatctgtggctggccaagaatttcacatttggtttttttctaatttgaggtaggaatgttggtggcgggatgagatggaagcaaggtatgaggtgccagtccctttgtgctaatggctgacgggtgcatgtttgccctgtagtttctattatgtctgccaaacaaaagtcacctgtgtgaaagggggtggctaccaataattccctccacacaggcaggggtcagtggtgctggggactgtggtcactgcacatgctgcctttctggtgtccagcctcccatagttcagcggcatcaaactggtcatcttctggtcacattggacaatctgcctacaagagtctctcattggagtgacattaaggaaagtaattgtgaactacacttagagccaagataacttattaaatcttgtattgggaaagatataatgaacagctttattttaaactgtgattgaagtaggataccaactgatggtcataacaactataatttgtgcctgagacttaaataaaaagcacgcatcttgatttaacctaactttatattacctgattctcggtaataattattgaaagacttgcctttctccgcttttaatgtgtgtgctgctttagttctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaagagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaaggtgggcactggcgtttttgttttgtctttgtgggttcctgttctggttaggaatctagctggccctggagttgttctgggaaatatctgcaaacactttccagtttgttgaatgatgagagctgttttcatgtaagctgtgtttggctttttccccctccaagtaataaaataccaaaaacttgtatttatcaaatatttctctcagcaccttacttggatattttcacattttttccatcatgtctaattagggccaaatcttgtttgcttcattttgatgtccacaaattaaatacagaaactggacactttgcccacacattttacccattctgcttgttggctgcctcagcagcatggtgacctttccccttccaggatccccaaaaatcagcatgcatagcaacaggtaccatgggaaccaactcacaggtgcccctggttatatctgattgtacaaaccttcatataaatcagtaggagatcttattttgtgaccctttctaaactatagcctatacttcctaaatttagatattcaacaaagctgtaaaatgcattagcaatccacaccttctgcatgtgtctgataacttgatatctgagccacgatgaagttcacatccctggttgttaaaatctctttgggatttaactaggcccatctacttcaggcaactaataattaatttctgttttctacacagaaaaagaggaaggttctctcttctattcagttttagtaggaaggacaagtagcaggttagccagtcactagtagccttaaaaaccttccgtagttcatggccagaggtgaaccctcactctgtttgtataaattagaccaagaaaatcattctttgtgctgttctctgaatgcatttcaacttttcatattatccatgaaatcagctgttgagagcaccaataaaagggtttatgaacatgttcataaaatataaaaatgcagtccaattttttgcccttcatagaaccaaagaccataaacctgatgtaaagttcatgctgcctaaaccagacaaagctttttacttacaagcattagaaagataagacgttgagttgtctaaccattgctagtaaacagttctccagatttcacgttaaaaactggaaataatcatctggaaataaaattatccttccacaatatagtaaaaatgagtaatccatcatctttatataaacaaccctaattttaagtgagttgagggtttgaagtatttaatattcattcatttatttaacaaaagatcttaataagcacctgctgtgtgccacacagtcttctagtcctggaaacaaaacatgtacatgaacaaaatccctgccctgtggaacttacatcttagtgggaagagacagacataaagtttaaagtttataagagaaaaaaatagaaccgaataaggggaactgagaaaacaggtggggagtacagttttggatagagtggtcagggtctgcccagctatgaaggtgacgtttgagttaaaggatccaagggggtgaggtttgtgcttttgtggaaagagcacgtgaagcagaggggatgcccagtgtgaggcccctgaagctagagcttgcaactggctttttaagggaagaggaggggactgctgtgggtggagagggaagagcaaggacagcagtgaggagaaagagaaccagagctcgatcctggatggccttggcttatagtctgaacactaataatgtcactagagtcccgagcagcagaatggcacaacctagcctatgttttcaaaggatccctctgactccagttttgaaataaagggtagaagtgaggagaacaattgggtagtgactctaataaaccagattagaaatggcggtggcctggatcagggaagaggcagcagaggtgatgagaaaagctaagccagagccaagagatttgcggatggatcctacgcttagtgagataaagaagaggcagtgatgagtacgaggctgggcccaacatgtgggaaagattgaattgccattaactgaaatgaagaggatacaggcagagcaggttttggggggagaaccagcagtcagtgttgggtacgttcaacttgagataccgattggacttccaagtagagcttatcagatggtagctggattgatgagccgggtaaagaggaaaggccagggctggatttgctgatgtgggagtcatccacagaatgtggttttaaaagtcatgagattgggtgaggtcacaggataggtgagtgtaaatagagcctggaagagctccaagaatagagatctggaaaaggaaccagcagaagagaccaaagtaggaaacaaaaacaggaaagttgtggagtcctggaaggcagtgaagaacgtgtccaggaaggaaggagtggcgggccgctctgccaaatgcagcgggtaggtcagggaaggcgagtctcattggtgcccttgacaagagcagtctctgtggaatggtagaggcagaaacatgactgaaatggattagaaagagaataggaagagaaaaattgttcggttgactttttagaccactctttaaaagattttgctataaagaagtgagacaggctgggcgcagtgactcatgcctgtaatcgtaacactttgggaggccgaggtgggtggatcacttgaaaccaggtgtttgaaaccagcctgggcaatgtagcagcaccccgtctctacaaaaaatacaaaaattaactgggcatggtggtatgcacctgtagtcccagctacttgggaggctgaggtgggacaatggcttgagcctgggaggtcaaggctgcagtgagccaagatcacgccactgcatcccagcctgaatggcagagtgagacgctgtcaaaaaaaaaaaaaaaaaaaaaaaggaagtgagataatgagtaggtagaatttcggagtaggactaggtttgttttggttttagaatgagagaaacaacagcatgtttgcatgtggctgggaatgatcccacactgggagaattcctggctcagtattcacacataggtatgtggagacagggtctagtgtgtaggaaggaggggatcacctgaaggaggaacatggaaaatccatttgacagggaggaaagaaaatagattaacgcagaggctgagggtggggctaagagttgatacaaatttcttctgattccttcagttttcttagccaactaggaagcaagatcatctgctcagagtgaagataggtgaggaggtgttggaagtctggggagaagaggagaagatgcaaagtagactgtgagttgagcagagactgagtatactggggaagcatcggatgatacggagcggctttaagggctcactagagggttgagttcacgtatgattggcagttgactatggagcttaagcttagtaaagcagtacaggacaccaaggagaagggcagactttgaaagcatgaatgggtcccaatggtgttgaaggagcattggaactgggttacagaaggagtgagctttgacaacgagcgctggtctgaaaggggttgcaaggacttgggctggtggagaggctgtggtttagaaaggcctggggtgcagccatgagggtgctgaggccgggggtggacatggagaggggacacagatagagcataaaatcagtgggggaagggaaagtcaaggaactgaagggcgggatttagaagggtacacgtttgttgaggtcaccaaaaattaagacaagggatgtgttagagaatcagtaaaccaagagccaaaatccttcagaaatcaggcagggggcaagacacaaaatgtgagtcagtttctccattagctttgaagtttccaaatgacttaaggatctttctgatgacgccagcaaactgtagaagtataaaattcaggcatttgataaagaaacaccatgtttttaaatattaatcctccatggatgatcaatccttcagtgacaattaggaattgaaacagtagtctaaataattattttggcttctttgtacctacagatgcaaatacaaaattagaggaaatttctctaaggataatactactagatatccccgaacatcatacatgtggtaatagattgcataagtgtttctcttcccataatttcttcgtggttccataaaaatcatttgaaaacgttgctagacagattatgaggaaacatgtgcaaaagaaaggttagattgttaacgctgaattactttccttggcttgtgtttgttctgacagagatttagctcattgtcatacaagtctcgggaagaagaccccactctcacagaagaagaggtaagttttgtttctttttaaaaagggaaaactgtagtaaagaatagaccttccccccttgaataaatgcactgtaatgttaccctttgaaagagctgaaatattctcctatgcctatgtttggagatgaagacttgggatgctggttttataatggcttggagagactgacgggcaggccagacaagaaggatggcaggacaagtagtcagctcaggaaaagaaactgagcaggaaagcagggtcaggaaaaatagagagggcaggggagaagagtgagaagagaaaaattccagcgtgggagcagtcagcagtcaggaagaccacatcagaaggaaatgaatcatgggttggaaaattcaggaaattagaacaggtgagtgtagggaatttgctccagcctgggagacagaaagaggaagtctccgtggggaaatttggatgctgagagcagattaacttcagtaagtacagttccaggcaggagctagggtcagacatagcagccaacaagagcagatcgcatattcccaagcaccagggtgcaaaattcacgagttagattttcaatgaagcattaaaattgttaaagccagtattatacatataatatgaaatatgtgtatatatacatatttcatatgtatatatataaatgttgagctatgctcagagagctaaacaccttaattgatctagctgtatatagcttctatctggaattcctagcagagtaaattgtgtacatgtacaagagcaaagtacatatgcaggtacatcacttcctataggactctgagtaaagcattagaatatggacatagacacccacgttgaatgttcaaagagcaaaaatgctttccctaggtgatattgcccaccctcgtccatgtttctacctccagaatggacctgccatctgtctatctggttgcacagaccaaaacctaggggtcatctcgatacttccttttcctcactgtcctccaacacagtcaattgccaagacccatcagttgcacctccaaactgttttctttgtgtacccacctccctcaagcccactgcggccgcccctccctaggccagagcagtcccctcctgctgatccctggcagctccttggcctccctccactctgttttctactctgcagccaaagtgatcccatctgggacaagaaggtaaaatatataggagttctgggaattaaagactatgtaaaattttaaattgctccttatcttacatttgtttgtattttttgaaacaggacctagttatactgatgaatttttaacatgacagaactatgactcacagacattcattttaggacaaagaggaaaaataaatatgaaagttttttttgtatttatgtaatttaatgttaaacagtccagactgaagctgagatctgagctttaagttctattaccccaatttaacagaatgttatggaaaggattgattagaaaaagaagagaaatggggaaaaggaagagagtaacttatgggaatatagcaacaatttacagactgaggaataatgatgaaagttttaaagagaaaaattgagaagctaaatagcaagggggctggaagagaaacctgtatacaaaataaaaataatagtcataatggtcatagaaaacagtcaaaaggaatatgagaagactcaagaagcttttataaaagttgaaatgtacagtgagaccctctgcacactaggttcattcccagagtcaatattaaattgcaagttaatgaatgaggacaaaggccaagaagaccaagtactcttacaaagagtgaggggcattaattacaaagaccagggggaagaaagctgaggagagaagctaacggtggtgaggggctgactctcattgttacaatctaggtcaaggtacatttgtcctccttgatgttaccaggtgatgaatacgctggtatgccgtctcccctcaccattgtcatccattgtttacctttttataatctgtccacatataatttttggcttggaccaccatttagataatacattctgtgtttgcacttccttataaacagcagtgaattttttttattaaattcaaagaaattataattcttgtattctgagagcagttttttcattaaaacctctaaggtgagaatgttaatcatttcatattcattaggatagtcagatcaacatagtaagagttttccaaagactgtttttctgaactgtaaacccttggattgtcaaggcctcaccaaactgagccagccaccagcctgtaatgaaaagttctcatgcaaatgaccagttagcatgtggcaggcctgtcttaagaagcttttgagacataagaaggcctgtcttaagacaggcctgtcttaagaagctggaaacttcacctgcagtatgtgagaaaagtggaagcaggaaaatgtccctcagcccttgggaagccaggcatctgtgaggaagcatgttcatgtatttcctgggtatttgaatgaatcaaatcactgtgataaaaataaacacaggtaatgaagggtatttttacttatttccaaccgtgatttttcacaataaaataatactccccaaaagtctcctaattagtatatttaatcttcacaatgaatgaaatccctgttgatatcggaggtgatacaggatttattagtgagactgtgggggtgtgcttggaaagccactggctcttaatagtatcctgtaagttgtcatttctgacttggctggttgcaagcgagaatgagttttcccactgaagaaaactagacctggactgtcaatgtctgtttaaccagtaatacgcaactaagtcaagaaataatggacaggaataccctttcagatatatgtgtaccaccaacgagaatccagcaacgggtgttggagaccactgtgatgcaggaagcatggagtagtctaattcagagttcttatactttactggccatcagaatcagcaccggttgctgggccccagccccgaggttctgatttggtggttctgggatgaggcctgagaacttgcctttctgacaaattcccagatcctgttgctgctggtttacagcccacactttgagaatcaccggtctactatgtgttttctgtccttttttgtaaagcagtggagccccttttcaggcaaaatatcattctgataaagaaatgaaataaaacacatgctgtggtcaggtccccggggccttcaggagcttcccactccacctctcctcaaattcctcggcagacccaagagaactgggttttcacggaattaagggaatatgactgatctagttaacatagttgaagatagtgtgtgtaattattctctagtaatgtgctccataattagtacagataagaaagaacaaatctttaaggagtacacacacagaaacccaggagtgctcagtatgtagcttgtcactaaaaagagggagggggaagtcacagctggaagtttattcaactctccctttgtctcctagatctcagctatgtactcatcagtaaataaacctggacagttagtgaataaatcggggcagtcgcttacagttccggagtccacctacacctccattcaaggggacccacagaggtcaccctcctcctgtaatgatctctatgctactgttaaagacttcgaaaaaactccaaacagcacacttccaccagcagggaggcccagcgaggagccagagcctgattatgaagcgatacagactctcaacagagaggaagaaaaggccaccctggggaccaatggccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccagctgtcagtggtctcatctcattagtgaggaaagccaagctgtatggaaaagctgcactcaccaaggaccacaatgcccccggcctaaagtactgccattcagaaaagcaggtttttcttcctctctttccttttctctgtctgctactgactttaaggctttttcccccttgaaatgtccagattcctgtggttcatcccaaggaaattttcacacaaagcttggcctttgccctcaatataggtgttttaggatggtgacaaaccatggctgctgctttctgcccagctcgccagtcctccccaaagagttgcgcatcagcacctggggatctggaccctgcgggtgaagggatggggagggacgtccctggagtctcttctgtctttgttccttcttattttggcattcgatatcagcagcctctccccaaagtacttgaagtcagttttagatgctttattttatttttctagtcaaaaacgtgtttcccccagtgtttgaaaactcgtccgaatcttttcagtattttccatgagtattgtggtacttctagacttgtttaagcccagaactcattccttcaaaacagagagccttaatctttatgttgggacacagaccacatatttggacggcagccatgcatccatcgctgaagggctgtggacatgaatgtgtatttcccatggtctccgctgcccacaccaacagtgtggcatctcataagttaactgctaccctaaggtaatctaagattaaaatgtaaacatttatttttgttatgtaagtttataagatgttttatgttcaatgcctaatttctcaaaagtgccagaaaaaaatgtatattagctattttgattttatgtacaatgatttatactctccttttgaaaagataccataaagcacataagctagatcactacaaggagctgttatcttttttctaatcaagtgtttaaaacactgatggtttttaaagactcacctttttaaatggtacttggagctcctgattcaaattacctagaccccctagagaaataaatggaatatacataaataatcattttcagtggtttatggtgggcaatattgcaatatttgaaatggtaaaaatggaaagaagaacaaaatatgatgagaggtggctgtgaattataaacctcataaaagtgtcataattccattaaggtttaattatattttttcagaaaacagtgatgaattctgtagtccagtgcttgccaatgcaaattgcctattggaatcttcttcctatattttacaaacatcagtggctgaaatagctcagagtaagagctcagcctggtttgaatttaatcatctctttagatcttataaggccagcattaggaaacttgttcacttttcattttcaaaggagcctagttgaagtgctattatgagtgtgggctatggaaagacagcttttcctacactgataaagaaaaaaaatgaggaaattatttcatccccttgtgacatctgtgactttttggatttaataatcttgctgtttttcctctttatgacaaagaatataattgggaggatgaagtgtcttaaaaattgtagagaccagctcactggaatgtttttccatccctgtattcatggcttgactttgtgactgctctacactgcatgtctgacattgcagagtgagctatgttgaggtaaactggttggttgtca

SEQ ID NO: 13337 - DNA, 7060 bp, Human
gcggtcctgagagccaggaggtgcacaggtcacgactcgaaaagtgaacaggcctcctcctctgcaccccccgagccagggccaggatgaccaggctccaagtgaccgtcacagcgttggcccggtgggaggagccaggcccacgccttcatcctgagtcggaccagcagggccttcttcaggtgcttgggttccaggggacagtggcgcccgccattgcactggcctgaacacgggcagggggcgagggtgcagcctccggatgtagggagccacggatcgtgtcggattcgcccacagcaggaggcattggatctccctggctgcacccttgtaaagccacagccccagggcctcccctgctccctgcacccctggggtccagcccaccgcgccaggctcaaggccctttccagggagcccgagccccaacccccgccatccccgattccgcattttcccggagcctaaggagcggggctgggggcccggccgggtgccgcagacctgcgtgagcgcgggggcggggcggtgacgtcatagccgcgagcgaggctgcgcgggccgctggctgacggcagcggagccccgagccgcccgcgcacgcgctcctgcgtcagaggcgcacgggggcgacggccaggcaggaggtggggggtcggcgagcgcatctccgggcgcggagcgccctctgccggcgtcgaggagcagcgcgccggggtccgggatccccagcgagccctcccgcgtcgcccgcgctgtgcccctcgccgcggtcgccgtttcctagaacagctgcacctgcagccttccaccctgtcccgtcctgcacactttctcggcttttactgtgatttatttttggcttttgccaccacctaccactacgacctgtttgtttttaaattttatttatttttttgtttgagacagagtcttgctcagtcgcccaggctggagtgcagtggcgcgatctcggctcactgcaacctcccccccccccccgcccgggttcgagctattctcctgcctcagcctcccgagtagctgggattacaggcgcccaccaccatgctcggctaatttttgtatatttagtagagacgaggtttcgccatgttgaccaggctggtttcaaactcctgacctcaggtgatccgcctgcctcgccctccagatcggataaagtgctggaattacaggcgtgagccaccgcgcccggcctgacctgcttattaatgatctcaaatgtctgctaaataacccccggccccagagtgggattctcactctgttgcccaggctaggcagtggcgcaatgatagctcactgcagcctcaatctccttaggcccaagcgatgctcccgcctcagcctccccagtagctgggaccacaggcgtgcatcaccacgcccggctaattttgattatttgtagagacggggtctccctctgttgcccagactggtctccatctcctggggtcaagtgattctcctgccttggcctctcaaggtgctgggattacaggttggagccaccacacctggcccagagccggaaacttgatgttttcttgatgtctatccagggccctgcatccaatgagcgccccaaaaatctttttttttttttttgtacagacgggtcgggggtgggggcgatctacactattgcccaggctggtttccagctcctggcctcaagtgatcctctggcctcagcctcctaaagcgctggtattacagtcgtgagccaccacgcagccgaatcttgaatttcactgaagttcgttttactccacctcccaggacggtttcaccgcccttatctgaccaccccctggttctgccgcagcccgggccggaacaaaactgcaacccccagaatacctcacgacggggcactgcgtcgtcaacgtcgcgtgcgccctgccgggagtcgtagttcgcgcttgcgctctcgccgggactcctcctcccagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggttcgggcgctgcgggtcgggaccctccgtggccgccgcccccggagtccagggtccccacccccagggcgcgacccccgcttccgggcccccggacccgcgcgccccggaagccgaggctactcagccctggaccctcggccctgcctctgctgcccgagccctgcgctgccctcgtcccgggcacctccccgagataagcgtctcctgggtgccctccccgatctccctggccaaagcctgggtgtcgccggatcgttgcattcccatttcgcggatcagtagaatgaggcgcaactgttgaggaccaaagctgcaacttcggatccctgcgctgggttgtctcagtgcctcacatcagcgccaggtcctgccctgacccattacttagcaggacaggccgagtgcccggtgggcgcggggccggcctgccccgccatcattccccacgctgttgtctgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttggtgagtccggtggagggctgcagggccaggccaggctggggctccacatcccaggtcagtctccgtctcagttgaggctgcgagaaaaaatagttttaggccgggcacggtggctcaagcctgtaatcccagcactttgggaggccgaggcaggtggatcacctgaggtcagaagttcggagaccagcctggccaacatgatgtaaccccgtctcttctaaaaatacagaaaactggccgggtgcggtggctcccgcctgtaatcccagcactttgggaggccgaggcggggggatcacgaggtcaggagatcgagaccatcctggctaacacggtgaaaccccgtctctactaaaaatacaaaaaattagccaggcgtggtggcgggtgcctgtagtcccagctagtcaggaggctgaggagattgtgccactgcactccagcctgggcaacaagagtgaaactccatctcaaataagaaaaatacagttttagcaggtttgtccactgaggagcctgggctggccggtgatgaaagcgaaccagaggggaccctgctctcagccggtttatgactggctctggaccaaccaatgtaggatggtcgaagcaagagatgtaaaaccacccaggcccagtggttcatgcctgtaatctcagcactttgggagactgaagtgggagaatcgcttaagcccaggagtttgagactagccttggcaacatagtgagaccctgtctctacaaaaaataaaaagaaactgaccaggcgaggctgggtgcggtggctcacacctgtaatcctagcactttggaaggccggggtgggagggtctcttgagcccaggagtttgagaccagcctgggcaacatagtgaaatcccatactacaaaaaattagctggttgtagtggtgcacacctgtagtcccagctactcgggaggctgaagcaagaggaccgcttcagccggggaagtcaaggctgcagtgagccaagatcatgccactgcacttcagcctgagcaacaagagtgagaccctgtgccaaaaaaacccctcaaaaaaccatgttgggagggctgatcagattaggggaggaaggtcatttgtgcaggaaaaaaagcagttctaagcctcactggtttccagtggtggccagatttgaactcagcttgcctttggccctgaccccagctcaacccatgggtggtgggtcagagggagggcctctgtccccaggcagtgcttttgggggttcctccagcttctagtcctttcttgcggcccctgttttgttcttctctagcagttgcccgccatgttgggcccagggccagtcctgtgggtctgtttgcacactcaggacacagacttggatgtttgtggagctcctggttcacagggggctctggacttgaccaggggagtccctgaggctgtgcagccctttggggtctcacgccttccccccgccccattcccccagtgagcagcggttccatcgcagtgaacgccgactcttcggtgcagttgttggccgaagaggccgtgacgctggacatgttggacctgggggtgagtgtcagaggggacctgaggctcagcaggttggagctgtccaggctgcgggggagggagcgctgggggaccaggagccgggctggggtcgctgctggcccctcaccgcccctcaaccccttgcaggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcagagccagccgccaaggttgacctcagcttcggagccacctctggatgaactgcccccagcccccgccccattaaagacccggaagcctgactgtgtgctcggctcttgttcctccacctggcccggtgaagccgggagcgtcctgggcccctgctcacgtcctccgtgtcccttgcaaatagggcctttgagctcccctggactatgtcccttagggcacctggaggtccgtaggaagcaggctcgagggggtgggtggggtgcagccaggcgggcaggctgctgaccttcaccctacaacggtggggagggtgaaggtcaccagtgatggggacatcggtcagggaggggtgtccctgctgctcctggcgcctctgccgagttcctggtctccaggccttgaccctgagccctgctggcccttggccctgcccaccagcctctggaaagaggcgggccccacccgctcccacgctggccccgccctgtgccagccggtcctgtgggtggccctgcctggccgggtgccgaatctgcagtgtttttggcacctccgtgggcacctaggcttctgggttggccccagatggagtggggtgggcccaggagggggcggctccctggcactgccccgttgggcctgcctcttctcctttccataaccctgggggcgggcaacactggctccagctggtgtgtggacggcgggggctggggtctcctgacctcctcccttccttgggacagggccctgtgcagtggggtaggcagggaattccaggggggtgagtggggagggtgggcctgcctgtgtcactggagctgggatggtgacagagaggccgccccgggcctgtcagcacggacgggcagctcactcccacgtcatggcactatgcgggtgacttgccacagcttcacttgaggcgaggtgccgttgggggccttgcgactctgaggccgccggtcagcagatcaggtattctggaacagcccacggtcccctgcctggctccccctccacttgggcctcgggacacgagtgaccaggcccccacttctccaggaatccgcagcccagggaaggttgtgtcagccaccaggccacaggagcagcctctgcccaggccccccctcccccccgcccccagttccagccccaggtcttcaagttcctgccaggccaccaggaccctataaataagaccaagggcacagctgggacttagcaggggcccagcgggaggagctgctcactccggggacctcccctgcccccaccaccagggagggtgtgaaccttggagccaggcctcaggacacccgagacacctgacactcggagggaacagcccgtgctggctggatgcgtcctggagcaggaggcagtcagggtggggccgggaaccaggcggtcaaggcccttcagtgagggcagcccctggcttagtgaggcagaacagagcacagggtttgtccccatcacacccaggaacaacccactcaaccatggggacgccgagtatgggaaatggtggggaagcgttttagcatgtttattcatttagactggctctgggcatctggtccccaaagggccacacagtggcccctgtgaagcccagcaagttccgacaacccgtgtcccattccactcccgaccagactgaggtgatggtgtccattccactcccgaccagactgaggtgacggtgtccattccactcccgaccagactgaggtgacggtgtccattccactcccgaccagactgaggtgacggtgtgcaggtggcagagccacacacgagaggcaagaggcagggagggaggtgggggctgctggccactcacagggggccccagtgtcctgcttgggctgctcatttggcaccagtccacggctccctccgccacctttgttctcactggaagcagaatgagcctggccctgtagttcccacctggggccccagcccttcatccaagccccattcatcgaccctgcccctcctccctccaactgggtccagttcactaagctcccagaactgctcaagccattcccacttcctggaccatcgtcttttttt

SEQ ID NO: 13338 - DNA, 25709 bp, Human
tttaacattttgtaataaaattatgcgtatcaaaaaaacaaagaaattccgtgtgtagttcacactcacagcacatctccgtccaggcacttgagagaatgactaggaggggttcttggaggaggtggtctttgaacggagaatccatcttcaaggattctgtctgtaatggtcaccaagtatttcctgagtcacttccatgtgtcctgcagttctctgaaggggcgtgggacctaccgatgccaattatccagcattatctccagattccaagaagttggggtgtgagccagcaatcagtacagaaaagagataccaaaataagtttgagttggggagtgttccttcaacttcagttttctggaagagatcttttttttttttttgagacagagtttcgctcttattgcccaagctggagtgcagtggcacgatctcggctcaccgcaacctcctcctcccgggttcaagcgattctcctccctcagccttctgagtagctgggattacagacatgcacctgtaatttctactaaaaatacaaaaattagccgggcgtggtggcgcacgcctgtaatctcagctactggggaggctgaggcaggagaatcgcttgaaaccaggaggcggagattgtaccaagatagtttgttccagctaaacaacctggcgctagtgcaggaaaaggtggaaggcacggggctagcacaggagggttcaatattttcaaccttatcaagccatattttggcaactcttgtttttcacgagaagcccccgctgggcttgtcccagcgctgtcctgaggcttcccccatgagttccgatagggcagaggccgccctgagcgtttctctttcccctggtccaagagtggctcaaaagaaggatttttgactggaattggccactttgtgttactttttgacccttgacctcgccccaaagggggatgcgggggaggggctctggtaggggtggccccgctccttccaggtccgcaagcccaggttcccgcccaccgggctcagcccaccctgcggccgttcagggaggccgttggcacccgtgacctacgacccccttcccgagccccaccgaggtcacagccgtggcctcgtctccccatgcctgcttcccgccccctgcccgtgacgggcgtctccgaggaccaatgagcgcgctgtatccacccctcgggcggggccaagcgccgaccaatcgccgctcgggcgcccggccgggtccaaacgctccaatcgtcagcggcggcggggcgggcagagggccggggatggcaggttcaaccaacgggtgggcacgtcgtcctcgcgaggaggcgtgccctgcggccgggcgtgcggtgtccgcggcggcgcagggagggggagggaggtaaacaagatggcggcggcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggctcccccagctgtccaaggagcagaggcgcccagtggaatcagcctgtgtttgtttgggccccgagagtttgtgtgcggccgccaacacgttttctgcgcagtgtgtggccgttaccggggccaggcgaaatgtgatttgtttatcctgtcagaggggaaccctgggctgccaaaaataactgtttgcaccggcttatcagtcagcaggagggaaacgtagcctttcctcatttgccagggatgtgacgctggaagcatccctggcccccggggctggaagccctgcccgagggggactgtgcctccctcccgaattgcatccggaagaccttacttttccaactgacttcttcaggcacggggctgccgctgggcatcccggacgcctctgcatctgtgcgcggagaagctcctacctagggcagcactggccggcctgagcctctcccagctggtgggggtggccgggggtgtccctgccttatcgcagccagacacgctgcacctgccgccgcctggcgggccctgcccaggccgtgctcctttcccagccctcttaactttcaaaactttgcctcctgtttccaagaaaggaccttatctgctgggctaggcctcgagggactggcaaggacaccctgcgcagggcaccatgaccttggaaggaggtccggggaggggctgctgcggtgtctgctctcaccttcctcctgctcaggggccctggggctcctgccgtgtctgctctcacctctctcctgctcaggggctctggggctcacgtacatttttttttttttttttttgagacggagtctcgctctgttccccaggctggagtgcagtggcgcgaactgggctcactgcaagctccgcctcccgggttcatgccattctcctgcctcagcctcccgagtagctgggactacaggcacccgccaccacgcccggccaattttttgtatttttcagtagagacggggtttcaccgtgttagccaggatggtctcaatctcctgacctcgtgatccgcccgcctcggcctcccaaagtgctggtactacaggcgtgagtcaacgcgtgcggcctttttttttttttttttttttttttttgagacggagtttcactcttgttgctcaggctggagtgcagtggagtggtcttggctcactgcaatctccgccccctgggttcaagtgattctcgtgcctcagcctcccgagtagctgggattacaggtgcctgccacagtgcccagctaattttttttttttttttttagtagagacggggtttcaccatcttggccaggttggtcttgaacttctgacctcgtgatccacctgcctcagcctcccaaagtgctgggattaaaggcgtgagccaccgcgcccggccagcacgcttcttaatcagcatgcaggctgtgacatgcggaaaccaggggcacaggctctgaagtttgtactctggagctggagcagtcagggttaaatgggagcggctgggaagggtgtgtttccacgaggcctttctgatgtctcagtgcccagtctggacccgggtagaaggtgtggccagtgccttgagtcagtggagcagttgcctgtgcctggtctctgtgagatgggttggtcaggggctaggcagagcctgtgcctggtctctgtgagatgggttggtcaggggctaggcagagcctgtgctgggggtagcaggtgccctctaaaggggccagtgacagtctctctcccagcagtgagaaacccacgcttaggggccgggcgcggtggctcacgcctgtaatcccagcactttgggaggctgaggtgggtggatcgcctgaggtcaggagttcgagaccagcctggccaacatggtgaaaccccatctctactaaaaatacaaaagttagccgagtgtggtggcgtgtgcctgtaatcccagctactcgggaggctgaggcagaacattgctggagcctgggaggcggagcttgcggtgacccgagatcgcaccattgcgctccagcctgggcgacacagcgagactctgtctcaaaaataaataaataaataaataaataaataaataaataaataaatctggcttgagttttgacaaatgtatatgcagggtcaatgggaagacagacgctggagggtggaagcctgactgtgagagtgagccccctgctttcctgaacagtcagtggaggaggtcctgggagctcaggtgagcacctgaacggtagggcagagcctgagggtcttggtggagacaggcaagaaggttgcaggaacctagtctggcccagtgcctgggagaacgggagggaacacggaggcagggaggcagaggggttggcaggacctggactggactgtgcgtcgcagctacccacagcttgaccccactgccttgaagtgagtgatgcaccctcactagtgttcagcgtccaatttcatcctggccctgagtgtgtaacggctttgcccttgcggggccccctgggatgaggggtgagccctgtcccttcctggtcactgtctgccatcaggagctgccccgcttacagctgtgattcaggagccactgcatttcctccagccccctgggtgctgccagggggtcctcctattctgggagctggtgtgttctgactggaggctgccatgtgcagagtgctgtcaaggagaaggggtgtccactgcccagccctgaggcccaaggccttggccagccttgctgccagcgctgcagggaaaaagcctcctttgtgtgtgggaagtttaataaactccgctcagattgtgtctcgcagcgagtgtctggaaccttccagacaagcctcaggcgtccggtcctccagttggtgtggaaagcgtgggcgatcaccaaggggggtgggttggggcagatggagccggcgtgagtcccgtctcttcccttccttcccagaaaggcagccctggagtccatgccttgtcccgctctcaccggcaaaaagtataatcttattagaaataggaaagttccaaaaagcatcaatgagttaaaaagagggctgggcatgttcggtcatgcctgtaatcccagcactttgggaggccaaggcgggtggatcacccgaggttgggagttagcctgaccaacatggtgaaaccctgtctctactaaaaatacaaaattagctgagtgtggtggcgcacgcctgtaatcccagctactctggaggctgaggcaggagaatcacttgaacccgggaagcagaggttgcggtgagccaagaccatgccattgcactccagcctgggtaacaagagtgaaactccgtctcgaaaaaaaaaagggctggggccgggcgtggtggctcacgcctgtaatcccagcactttgggaggccgaggcggtttgatcacaaggtcagaagtttgagaccagcgtggccaacatggtgaaaccctctctctactaaaaatagaaaaactagccaggtgtggtggcacatgccaataatcccagctacttcatctgaggtcaggagttcaagaccagcctggccaatatggcgaaactccgtctctactacaaatacaaaaattagccaggcgtggtggcgcgcgcctgtagtccagctactggggaagctgaagcaaggagaatcgcttgaacctgggaggcggaggttgcggtgagccgagatcgcatcattgcattccaggctgggcaagcctaggagagaagagcgaaattgtgtctcaaaaaaacaattaattaaaataaaatcagtgccataggctgtttctggtaggcagtgggttcctagggtggagcagggaagggctggaaagggtcgcctgtgcccagcccgactccccgtgcttctcgggggacagcacggctagctgctgctgcggagcccacagtggggttctgggggggggggtgcaggcagaaggccgccatgcctccctccccctttccaccccagtgagagtgggctcgaaggcagggagtctgcccgccttgtggagcctccgcagaggcacccagggctgccgtgagcgcacagcctggcggtgtcccacggccctgccctttcctgtcacttccacctgttgcaaaacactgtgctttcgtatcttttctttctacctgtttggaaatgtgaaaatcactgctgccgtaggaaacgggcccagatccgggctgtggctctcccatccgcaccgcccccgcggtgtccagccaggaggtgggaggtgggcggcactcagtgtgcctggttgcggcgatgattggcagatgcttggacctatggtaaagaggattttcgcgagctgggagtcagtcctggactttgtaggtctttacatcccaggcggcctttatggggttccagcatctgctgaggcccctgcgccagccatgtgaggcctgggtgtcctcgaggcctctgtttgtgcccctctctgggcagcgggagggagagctctgagacccagagggagctcaggggctgggcagccgcagaacagcgggggtaatgggtccactgggggttctgggctgtgcacacagtgggcttccggtgcccagccagctggggcaggcctggaatgttggttcctctctcaggatctggggcgctgctgtagctgtcggggaatcagtgaggcggctggacggcccgtatatcccacaaacgccaccgtattgctcaaactggactcaattttcttaacacctttttttttttttttttttttttttttggagacagggtctcactgtatcgccgaggctggagtgcagtggcgcaatcatagctctgggctcaggtgaccctcctgcccccaaggtagctgggactgcagatgtgcaccaccacacccgactagttttttgtagagatggggtttcgccatgttgtccaggctggtctcaaactcctagactcaagctatccgcctgcctgggcctcccagagtgctgggattacaggtatgagccactgcttcgccacgttcacctttatttacttatttatttatttttgagacggagtctcgctctgtcccccaggctggagtgctgtggcacgatcttggctcactgcaagctccgcttcagcctcccaagtaagctggaactacaggtgcctgccaccaagcctggctaattttgtttttgtatttttagtagagacggggtttcaccgtgttagccagtatggtctcgatctcctgaccttgtgatccgcccgcctcggcctcccaaagtcctgggattacaggcttgagtcactgtgcccggcccacctttttattttttattttatagagacaagggcttgctgtgttgcccaggctggtcttgaacccctgaccttaagtaatcctctctggcctcccaaagtgctgggattacaggtgtaagccatagtactgggcctaaagttcaccttttttttttttttttttttttttgagatggagtctcgctctgtcacccaggctggagtgcagtggcgtgatcttggctcactgcaagctctgcctcccgggttcacaccattctcctgcctcagcctcccgaatagctgggactacaggcgcctgccaccatgcccggctaatttttttgtatttttagtagagatggggtttcactgtgttagccaggatggtctcgatctcctgacctcgtgatctgcctgcctcggcctcccaaagtgctggggttacaggtgtgagccaccgcacccggcaaagttcacctttttaaagtgtgtaattcagtggcatatagtacattgacagagttgcacaactatcacctctatcagcttccagaacattcttgttaccccagaaggaaaccccgtctctgtcagccatcactccccattccctccccagtcccggcacccacgcattcccttcctgcctctggattggcctgtcctgaacatttcacacgagtggtgtcacacaccgcgtggccttttgcgtccggcttgtctcacggagtgtgctgtcctcaaggggcatccgcgccgtggcctgggtccgaacctctctgctgttcacggctgcgtcactttccagtgtgtggagggccacgctgcgtttgactgctcatctgtggctggacacttgggctgctcccgcctctgcctgtgaattgtggctgctttggtgcacgtgtgctcagccggcgtccctctagaatccttgagggccttgtttcagccacatcaggagggattcagggaccagggcacgcgggtctggagctgggtgttcctgggtctccatgtgcctcccagtcctgctctgagccgtgggaggccggggcgagggccaggcccatctcttccctgtatgatctgtttctaggcagacggaggctcctagccccacctctctgtgagcttgagtggcgtttatgactctccttcctatttcctgtcctgctaatcaacaagtcagctaaacagtccatgctgcctgggcaagcccagtaggcccctaacgtggcacctcggagcggctggcgatgccccaagagccgggcttccccctcctggaggctcttcctgttcctcgccaagctcttaggtttcgctgggcctcctcttctgctctttttctggctggagacgtcagaggaagcctggcgatctagagaagctgatgtgcacccatcatcccggaggtgactgccaccaggcgggggtggctccacccccactcctcccctggcataaatcgggggacgcacgtgcctgcgcagaatgccttggtcccttttaattaaacagacaacccagtgtcccttggtctatgctgacctgctcaggagtgcctgggctcttccacgtttcagctgctgtgtgtcctgctgctgtgaagtgtccccgttgaggtggaggcagggcagggcgccttcggtgagggcgagtcctcctgtgcccgtttccccatctgtagaatgatggctcatggaggagacatggtgtcggcaggtggtggccggcgcagggaggtttccaggagggagtcctccaccctcatttgcttttagggccgtgcagcctcccgagcggcccccacgaggctctgaggctgcatgcaggttgagctcctggcctcactgcccctcctcagggttaggactgtgctggagcctgggtgggtgtggggtggtccctgcacaggcagcaggaggtgggccagagcggtgctggacctgaaggcccgtggctccctcagctccactgaggaggctggaatagtgtcctgggccaccttccctgccggtagccggctcctgctgagggagggggtgctttcgcctcctggtggagcatcaggctcttggggcctgtgcgtccgagcatctggcctctgctgtctgaaaacagcaccttccccgccccccggccaccgcatctcctctgaatagaaggcaagtcttgcctcccaggaatggcctgtgaccttcatcagcgggggaggttaggggcacacagagccctggggaacaaggggatctggggctgagccgggcctctcgggcccaccccgagctctcctgagcagcctggcaggcaggaaggcgctgggccccggggcctttgccgagcccagcctcaccctcagcgtccccctcaatgccctgggtgcctgccaggctgtggacacaggccctggccagttctataaataaccttgccgggccctgctgggaattggtgccaccaccacatagcccagagagaacggaaacacagggcttctcagcgagcagaccaggcctgcggtgaccagtggaagtgggggacgctttcagggctgggcagcccgacagggcaccgggcacagccaggggccggaaccagttgctcactggctccgcttctgggggactgtgtccctctgtgccccgtccccatcacaccttgctttcccttcatcctgctctcctagcccctccccagactggcggccccttgtccaggcccagccccagcacagcctgcagccctggcagagctcaggccttggccttctgaggttgccctgagggcagtgagcaatgagccctgggactggtgcactgggagggaaaggtgagccaaggcttcctgcaagaggcagccctgagctgggggtggggaaggctgggtcgtgggatacccctgacaccccaagttttttttttgagatggagtcttgctctgtcacccaggctggagtgcagtggtgagatctcgactctctgcaacctccgcctcccaggttcaagcgattctcctgcctcagcctcctgagtagctgggattacaggcgcccatcaccacgcccggctaatttttgtatttttagtagagacaaggtttcaccatgttggccaggctggtttcgaactcctgacctcaggtgatccacctcggcctcccatagtgtcgggattacaggcgtgagtcaccgcgcctggccccccagctgttttttatgctccatgcttgggcttcctgttaagaattaaaaaagaaaaaaaaaactatggagatggaatttacatactgtacaactcattcgttcacagtgtacaattcagtggcattaagtacattcacacggctgtgcaaccactacttctaattccagaacgttcggtcaccccaaaagcaagccccattcccattgtgtcactctccatcccctccaccagctcctggccactctgaatccacttcctggctctggattggcttgtcctggatattgcatagaaatgggatcctgtcggccgggcgcggtgactcacgagagcaagagatccagaccatcctggccaacatggtgaaaccccatctctactaaaaatacaaaaattagctgggcgtggttgcgggcacctgtagtcccagcgactcaggggctgagtcaggagaaatcgcttgaacccgggaggcagaggttgcagtgagctgagatcatgccattgcactctggcctggcgacagagtgagactccgtctccaaaaaaaaaaaaacaagaaatgggatcctgtcatcccagcgttttccgaggccgaggtgggcagatgacttgagcctagtagttcaaacgagaccagcctgggcagcacggtgaaactgtctctactaaaatacaaaaattagctgggcatggtagcacacgtctgtagtcccagctacttgcggggctgagatgggaggatcgcttgagcctgggaggtgcactccagcctgggcgacagggaaaccctgtctcaaaaaaaaaaaaaaaagtgcatcacacactgtgtgtcctttagtgtctcactgtgacatcctcaaggtgcagctaggctgtggctcgagtcagagcctcactggtttttgtggctgagtcttgttgagtgcgtggatgggctgtgctgatcctcgtctgtggaagggcccctgggtggttccacatctcggctgctgtgcgtcctgctgctgtgagcatctcgtgctccgtttctgcgtggcgtgtactgttcctcagggtgtgtacctgggagtggagctgctggctcacagggtaacagacctttggagaagctgcagacgcttccacgcccacccactgggtgtgaggaccttgctcctcgtcatttttgtttttgtttaattttttcttttatgagacagggtcttattctgttgtccaggctggagtgcagtagcacgatcacaggtaactacaggctcaagtgatcctcccacctgagcctcccgagtagctaggacttgaggcacgtacctccacacctggctaatttttgtatttttagtagagacagggtttcgccgtgttgctcaggctggtctcgaactcctgagctcaggtgatccacccgcctcggcctcctatagtgctgggagaaatgaagtgtctgcgacagggcggcagctgcagagggggctgtgctctctggcctgttgtgccccacccttgtgacaggcaggtgggcgtggccaactgggcggcagctgcagagggggcagtgacaggcgggtgggtgtggcaggaccccacaatgtctctttctgtggcgtctccttcttcgcctgccccttcctatgggccatccttccagctcacctgcggcccaccctccaaggagtgggaccctcggagttgggagcccttggctgcgtgggactgtactgtgtgacggagccatcaccagggctccaactcaccctggctcctgccacagtctgggctccatctgtgctaccattgcagtagtctggtttctaggaagcaaaactgttactgagttacaaagctcaattaagagtgtcctttgggaggccgaggcgggcggatcacaaggtcaggagatcgagaccatcctggccaacatggtgaaaccctgtctgtactaaaatacaaaaaaattagccggctgtggtgacacgtgcctgtagtcccagctactcgggaggctgaggcagggaaatcacttgaacctgggaggcagaggttgcagtgagctgagatcgggccaccgtgctccagcctagggacagagcaagactctgtctcagaaaaaaaaaaaagtgtcctaactgtgtcctccaaagccctcgccggccgatgacagactagagggcgctgtgctcccaccccctaccgccctgagcctggacgcgtggcccctgcagggccctttcccacagcactgtgaactcacagcttctctctagggaagggaggaggtacgccacttccacagggagatggggaggccgactccagggatccaggccatcatcctgacgttgggtcggctgatacacccctgtcctctctgtcccagggaaattcaactactgaggaggttacggcacaaaaatgtcatccagctggtggatgtgttatacaacgaagagaagcagaaaatatatcctttccggtgttgggaccgcggggcctccgtgggaggggctggggccctgggtccgcctgcctcgaggcctgctcctcttcccgtctccttgaaggagactggcacacgagggccgtggccttccctggttccccggaagtcagccattgtggcaatggctgcgcagcttgctgaaaggggccctgagccctggcccctgtgtcttgggcccgtggggtgtcaagtcccttttttctcagagtctcctcccaggctaaccaggggtgtagccacggtctgcctgagacaggccacgcgggctgaccgttgtgggccattttggtcgtggctgggcgtgtcctcgtgtcatctgtggacacccccatgggtcttacgggcacagcctccctacggggactttgcttcctaaggccctgtgcccagagcaagagccagaagtggtcctgaggctggggctgtgttccctgagccacgcggtcaggggccctgggaccgtcctgcatgggcccgagcctgcttgggggggcgtccaggaggcaccatcccccgcccatgggcagggtgggggacgtgagccccgcaggaacgctgccccaagagtcagccctgtcctccccttccccgtaggctccttcctcctgggacgctggggcccctgggccttttcagaggggtggctgagggcagggtgggccctggtcccgaggaggggcaaggtgggtgcagagggtccctccagagccccttttctggcccccgtgctccctgggcctgtgagtggggccgccccctgagctgtgtgtccttagcgccccacgtatatggtgatggagtactgcgtgtgtggcatgcaggaaatgctggacagcgtgccggagaagcgtttcccagtgtgccaggcccacgggtgcgtgcgcggggcaggggccagggtggggcgggggccgggggccaggcagggcaggctcctttccgtgaggccacactgcttgtcctgatattcattgacatgaaggcccaagtttttttgtttttttgtttttttgtgttttttttcgagatggagtctcactctgtcgcccaggctggagtgcaatggtgcgatctcggctcactgcaagctccgcctccgaggttcacgccattcttctgcctcagcttcccgagtagctgggattacaggcgcccgccaccacgcccggctaattttttgtatttttagtagagacggggtttcaccgtgttagccaggatggtctcaaactcctgacctcgtgatccgcctgcctcagcctcccaaagtgctgggattacaggcatgagctaccacgcccggccttgtaaaggcccaagtttttaaaaacagttttggggtcccccatgtgtggcatccacaggcagggctgctgccaacctcccgcctccatctttgctgggcctgctgcctgaggccagtggcctgcttccagcccatcgctggcagccgcctgccctgaccagatctcctggatgcaggtctgtggcctcagagtcagggccccttgctgctgcaggaccacaggggcagggaggggcctgctgttccagcaagactttggggtgcagccggcctgtggcccacaggaaaatgagacctgtggacatccggggccctgccagacgtggctcggccggacgagggtggccactgcaggcgcaggtgtggctccctgctggacctagcctttcctctgtcctgtgtgcctggacttctgtgacttcccagctgggcctgtggtgtttgggaggctcccaggcagctgcaaaggggacccctgtgaggggcagggaggcctcggccccaggacgggtgtgtgctgcccgcaggtacttctgtcagctgattgacggcctggagtacctgcatagccagggcattgtgcacaaggacatcaagccggggaacctgctgctcaccaccggtggcaccctcaaaatctccgacctgggcgtggccgaggtaggcacgtgctagggggggccctggggcgccccctcccgggcactccctgagggctgcacggcaccgccacaggcactgcacccgttcgcggcggacgacacctgccggaccagccagggctccccggctttccagccgcccgagattgccaacggcctggacaccttctccggcttcaaggtggacatctggtcggctggggtcaccctgtaagtgccccgcccccccgggcactcaccacacgcacactccgaggggcctctgcgtcttgggcagctgccggcctgtgggcgcagggcgtggccaccggcccagaccctctctggccacagccgctagggggtgcttactttatggaaatgtaactcatacggcagatggtggttcacccgtgtgaagtgcagcctggcccgtcagggatcttcacagagtggcacggccgaccctcctcccagagccccacagggaagctgggcgggtgacagcagctccaggccccttccccgggtgggtccagaggacactcccctcctaccccgtagcctccactagtggaaggtggtgaagacagaggtgtccttgagtccacagggcctctggtccagcagccacgggacgcctctgtccctggggtagagctggggctcctagggcgtcaaccaccttgactgaccacgcctttcttccctcccctcgaaatgaagctacaacatcaccacgggtctgtaccccttcgaaggggacaacatctacaagttgtttgagaacatcgggaaggggagctacgccatcccgggcgactgtggccccccgctctctgacctgctgaaaggtgggagcctcatccctctgcccgcagccccagggaggcggggcttttgtgcagaaatgtagggttgggggtgtcaggtggggggctattggccccgagaccccagcaggcattgagaggactgagtggagaggccgacctccccgcagggcctggtttgccaggtccctcagctccaccctgcttctgggccctgttcaccctccgaactcccaccccagagggcagtgctgccctgcgcctcccccagccccaccctcgggggctccctggcttgcagggtctgtcagggttgtcctgctgcacttcctacgcatggcagcaggtggcactggccgtccgtccatctgcccagtggccttgggagaacggaaccgccctggccgtccagcccagccctgtctccctgccagccgcgcacaggctgtccccggcatgtcccaggagtggagtggcctctgtcagggagaccgcctgtgcgcggggtcccccttaggagcgtccaggtatcacccagggcctgacaacagaggctgggcaggcggggacggttggtggggtctcaggcctgtgcccagctgacaggctcctcgccggcttctcctcagggatgcttgagtacgaaccggccaagaggttctccatccggcagatccggcagcacaggtgagcggcccctgggggcagtggggccgaggctgcagggaggccggccatgtgggcagctggttgagcgggcgctagagcagggcgtggtgggggtgccaggctgggctggggccagaccccgtgcagcgcccgcagttctcggggcccgagtggggtctctgggcagtgtcctgttaccggccagacccaggcgccttgtccgaactggggtctgagtgaggacatgcgtccgtccctgccctaggcatggagatgcgccaggaagggcacagctggtcccaaacactggcgagagcctctctttttcccctcctcctggggctcccagcagcagggtgtggctgggatccagcccagggcccccagctccatgacagggaagacagagcagcggacggggtcagcaggccccacagtgccgcctccctcacttcgtgggctctgctcctctgcaccagcccctggaggcccttgagccgtctgctggagcccctccgagccccgaggccacccactgagaccggctctgggagtgggagtgtccggacccctgaggcgctggtgctgattgtgccttgggggtctctgcacagctcgggtcatctgggcgcctggcggggactggggctgccccccgatagcctcctgggctgggatgtgctcagggccccccagacccccttctggcctttgctggctttgcagccagcatccatctggtgggtgctggcttctgagtgccacctgggacacaggcctcagggtggaggggacatctgtcaggcttggagtcaggtcagcctgcctgctcctagaggacatggctgagcttctgtggtcacagccaccccttgcacggcctggtcccagctcctgagtgtgtggcaggtaccctgggcccagaggagctgggtcggaaaactggaccgccctggtgccagcctgacaggcgccactgcttctgggcgtttgcagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggtgagtctggcgggggcccctgcccggctctgctgactcggccaggatgtcccacgggagcagggtgcctgcctgtctgcaacaaggacagcttctgccctctggtggccaatcccacgtccccaaagcctccagcccacctgcaggctgcctccgccctgcgggccgctgggacatggctgaaaggtgtggggtcagcgggggcaccagcccaggcctgtctggccaggagggttcctcaggcgtctctccgggtgctgcccagccaggcaccacccaccggccttggcctgagtcccagcaggagcaggcgggggagccccagggtcgggggagggtaggtgagagtcagggtgcagggtggcccctcagacagctggcatgagagagggtccagtggccctccctcccgtcgtccctgaggcctgcccgctggccctgatgccggccgcccttcttccctaggtggcgaggaggcgtctgaggcagggcttagagcggagcgcggcttgcagaagagcgagggctcagacctttcaggagaggaagcctctcggccggcgccgcagtagtgcctgaggaggagctcagggccttagcgtaggggcggcccacattggcagccagcccctccccgccatgctcccggcttggctgtgttcggcccagggctgggccgtgtcataaagagttttgcagtgtatctgcagggtggatgcttgctgcgctcgggctggagcctgagggggctttctgctttactgtttcagcgggaagtggtgggcaggggccggcctgagaaggggggtacgccaggcaggttgggatgtgaggacccagtgcacagggtccacccccgggcccgagggtcccagaatagtgggggccctgcagagagccccccattaggtccctcagcactcctgggcccctcatcaaacccctaggctcagctcagtagctggtccccaggagagtacagtgtgggggcccccgagagcacagtgtatgggggtccccggggggtacagtgtctgggggccccccaggaggatgcagcatgtgggggccccccaggagggtacagcgtgtgtggggcccccaggatcacagggtctcagctcctgggctcttggatttgcagcaccacgaccatcgcgtctggtctgttggaacgggaggtgctgctgggtaccctggtcactagggtgtgctgggaggtgggggcccctcatggtgcccatccttggggcctggctgcaatttgaccccaggcccagggtcttctgcctttcagagccctggtgccctgagacgggcagccaggcaaatcccaggcaggagggccagttagggcagggccagcccaggcaggttgcgagagtccctactgggacgtggaccacacgctgacccccacggccgcccctgcaggccaggatccctgagccaggacccggcactggcttccctcctggggaccctcaggcctgtgtgagacctgggctgccctggggtgaggtgcctgggaggagagcaggggctgggccacctttttcatgaccctgctaagcccactgtgggtggtgaggaggagtacccagcagggggaagggccgccagaccactcggcatggctgaggcctcagtactcagtactgggtactcaggtggacgcccctcccactgctcagatgctggggacaggctcaacttcaggcttcagcgtgagccccgtccctgacctgcagagcccccttgcgttggggcaggacagcccggcgccctcgggtcaggccatcctctgcgctctgccggggctgctgcatcggcctctgcgtgcctccactttggcctcacgtgtccctacccaggatgcgggtcctgctgccaacacccagatcccagggaaggggcttgggctagatcctgggcaccagtgcagacaggagtgtggggtggggcaagggcccagtggcggctgtgcccgctgatgcagagctggggcaccttgtccacagggtctgccccaccagagacgggctgggcccaagctcagacctatgggtgcaattggtgcctcctcaccaaggtcttttttatctttttttttttttggagacagagtcttgctctgtcgcccaggctggagtgctgtggtgcgatctcggctcactgcaacctccacctcccggattcaagcaattctgcctcagcctcctgagtagctgggattacaagtgcgcgccagcatgcccggctaatttttgtatgtttagtagagacgggggtttcaccatgttggtcaggctggtctcaaactcctaacctcatgatctgcccacctcggcctcccaaagtgctgggattacaagcgtgagccaccgcgaccggcccaaggtgcttttttaaagctagtgacttcctgtgcacatggggtgggtgtgtggcaagttctggaagctgctgagtcagccactggtccattctcggagctggggctctgcactgggcacatgagctctggggcagcccggggcggcctcccactgacttcgcccgggaggggcctcggggatggctcggcagccagtgtgttcgcggagtcctcgccaaccaccacggctcctcgcagggacagtacgtgggcagcttcctgcactttcccctgccattgtgagaacagtgtccacctgggcagggtgggcagccccaggcctgtgggtttcaccagggtgctggtgatggttggtggctagcagggactgggggcagctgggggccctggcaggctgagctctgctccccgcgtggttctgtgctggcatttcgcgtgcctggcctgagcctggcccgagcctggccctcctgtgtcctcacagatgagcatgtggcggctcctgggcctctagaaccaaccatgggccagggtgccccaggggagcacgggagggtcctgccttgtcagcttgcctcctactcgtgaggttcctgcagtcagtacctgggtggggtcccacctgcggccatggcaggtgcaacagacgtggtggaggggacactcctgcccaggccatctgcgggaggctcagccccggggggtgcctcccagagctgctggggggcagcatttcaggctggatacacctgggcctgacccgggggcgggcatggcctgggcagcagctgtaagtgcgtccccgtggtgggggccagccaggtccctgtggctctggggttgcgcccctcagctcaggccacacttgccgtctccctcccaggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcaggtggggcgcggcggggcccgggtggggcatgtggggacaacgcctggatgccacagccagccgtgagcatagcccgcgctagtcagtcatggtgaccgtcacgtggctgcgcgtggttgccatgtggcctttgggtggcttggccacgtagcgatccccgtggagggtgccgtctcggggcctggtgtctggccagcgtgctggtcatggaggcctacgtgtggcggggctctgggggggcgtgccgtcctcacagccacctctcagagtgggtgcattccgaggaccctgccctgggcctggcgccccctccccatgcccgcgccgcttccaggaaaggcttatgctgggctcagcccagaggcttttgagcaccagtgggtggtgggtggtggggaggggccgcggcctccatggctctgccggggtgccgcaggctctgagccagctgccaagtatggctgaggctgagtcgtgccggacgctgccctgtctctccctgtgtgcctgcctcctctcccagccccagccccagccccgggtgggagacggagtcccagaggtgtcagagacccttaagtcacctgccgaggatgcggggtggatgggggcccgaggctgaagcccctgccttgccacagcccctctcccaggttttgggggccaccgcctgagttacatgtctgtcccccaaatgggtgcccacagcccatccaccagcgtcagagcccgccaggccccactgcaaaaggccacacaatgtaccccgggagtgactcaagggtggccttccctggcctcccctgctgccccccaggagtccggtagccccatgactgtacctcagcttctccatcctcccaggggcccgcgggaggcggagaaccggtgcccaggctgacctcttccgtcttccttccaccctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctggccgtctgggttttgttcgcgtctcaacgtggatggggcggcagcggggcgggcgccgttgacatgcggagggcagtggggactcggggcgcgggagggccggggccggctccctcagggccggcggcagcagcggtggcggcgcggttattgctcggaggcggcgcgggctgccgccagcacacgccgcagtgaggtaaacggtctcggaggtcggcagtcacggtgttgagccgcctcccggcccagggcggcgaactcgtctgcgaccgttagcgccccgcggcccccgcccgggcgagctcgcgcacgcgcccggcacgcggcggctccatcgggcccagtgggctgcgcgaccctcgggtggcgggccctgcgactaagcggccgccccgtccgggactgagggcgagtgatcgttgtcctcaggagcccgaagctgagagccgttcacgccccttccttcccgcccagccggggtctccgcggcccgcgcctcacgacgcccagcacccggcaagcaccggaaagagcagtgcacacttcggcggcgcgagggcggccggggctctgcgcctgcgccctgaagcggcgagcgcgcctccgtcgcccggcgcgtgcgcgaagggcccgcggtccccgcgcattcgcgtcggggcgtcgcgcccccacgtctctcccgccgccgaggccccgtgcggcgccggagaagctgccagagagatgggcccaggacgcgggacttaggccgggctgtggtcgggggacgtgggggcggcggcgaccaacgcgggagtcgccacgacgggctcggcgaggcgcggcggaaagagtctctcgtcgaggccagccgccagcttgtccagcaccgacccggatggtaggacgcacaggcccgagccggggcaccccccgccgcccggctcctcctcgatgacggggatggcggggtcgtcgccggcgccgcccagggtgcgaccgtcgggcgggccgtccacgctgtcgccgcgccgcaagggcgcacgcgcgggtcgggccgcgccggcaggcggtgccggggttccggccagggccggggccgcgcgggcgccggggtcgctgtgctgccggccacgctgccactgtttgcgggcgtgcgggtgcgcgcgggcgcggtgtcgcgcggcagccggcgtgtcgtcgaagtgcgggtcgtggcgcaggaactcgtggaacagcgcgtccgtcttctcgtcgatgctgtagtcgcggcgcgggcggcggggccaggcgcgcgggctgcggggccgggcgggcgcggcaggtggctcggtgtcgtcgcctgcgccgcggccctcgatgctggcgtagccactgtccatctgcagcagccggcgcgcctcgccgtccttgggccgcggcgcgggcggggagggcggcgggaaggcgggcgccgcgcccccggagcctgagcccgagctgtcgccgctgcgcaccgagtcgcggtcgttgccgctgctgctgtggtccgaggcggccgcatgcagctcaagcgaggcgcgcaggctccacaggtcgcggtagctggtctgggcctgctcggggcccgcgtcccgctcggcgtccggctccagtggcggctgctgctgctcaggccccgcgctgcccgcgccgcgctcc

SEQ ID NO: 13339 - DNA, 7822 bp, Human
aagcggcaggtgtgcgcaggtgcgtgtcaacgccaccctgggaacccaggatggctgcggacactcacggagcccgcacccaggaacccgctcgtagtaagcgcttaataactaggcactggctgaatgaatgaatgaatgaatgaacacggcgcttcgcaaaaccaggaaaaggcagaggctcacagaaccagggaacgatgggctggggggagcggcaagaattacgcaattatgcaggggccgctgtgactaccaggcaccccctccaactccccccctacaagggctgctctgggtcagagaacgtccaccgcgctgactgctggggctgggggctgggggcgcagatcagaaagaatgggcctgaattgctcccaggctgggcatgtggcgcccgcgtctggggctccagtgggtgggtggcccctcccgcatggacggcgggcgcaggggagctcggtgctgatgtctctctcctttaataaccaccctgcgtgagtggctgacgcagcagccggctgccgctgacggggagtggggcggctgtagtgggggggcccgaggtgcagagggggtggtgatgaatcacacagctgctgcctgggggagggggtcttgagcccatgaggggtcccagagaccttgtcactggagacagcgcccctggctacccccacctcgatccacttgagggtggaagtgagtctgaggtcaggagtggggccgggatttccctgggatgagcagcaaagcgggggtctctgtacgccaacttcccccagcttgtcagcagagggtcatccctccgaagactttctggggcagagaagcaggggtccgcgctggcttcttccaccagggctgggggaggcggcggcatgagatgactcctgggcgaggagcaagtggtggccatagagggccccccagaggctttggggccgccgaagagtagtgagtgagggtccttgtaaagctggttctccagatggcggcggctttaagactcccctccgccaaccaggctcagtaggggaggcctgtggaaggagagaaaaggcctgggtggaggagcagagtgggcctggccccgcgtggggagcgagtgcgccgttgctgtgcagcacggtgggaggggaggccgagggccgggcggagtgctggggtgcagtggggactcggggtgtccgcctgcacccgacagcagggacgcacaacactatccggccaggcgagtgtgggggtgtgggccacgcacccagccgtgataatcgcggttccagtgggagttaggcttgggtgcgggttggagtttgtaggcaaactgggttgcgtaaagttggggtgcaccaaagtgtggcgatgtaggaagaattgggattgcgaatattggggttcgcatgaatggggttgtctctgttggggttttggtgggcatggggttgatggcaggaatggagtgctggggtgctgggaaaactgggacgtcggttgtattggcaagaatatcacgacaggtgtcggggttcagatgaagttgggatgtctgacagccgggtcttggttgggtaggggatctgggctaggttgttatgtcgggactgctggagcacaggcaaagtcggggtcccagtgacacccagaagtccccatgaggcctgaggcctgggaatcggggctagaggcccatttgttccccgccgcaggccagggagcaggcacgcgtaactgggtcagccccgccccgccccgccgcgcgctggtcacgccccctcgagcgcgggtggaggactgcggactgcaaacgtctcggccaatagtcgagcccgacaccagtccgcgggagggggcggaaccgagatagactcggcccccagctcatgaatataagacgcaggcgcgccctctgattggcccaggatgtgtagggggcggggcccggcggaagcgtatataaggccgggctcggggacgcccccccctcactcgcgcgttaggaggctcgggtcgttgtggtgcgctgtcttcccgcttgcgtcagggacctgcccgactcagtggtgagggccctggctgcaccggctccgaggagctcggggcggcgggcggcctgcggcggccaggcgaggcggggccgcagcggcacgcccctgggagggggcgggcccggggtggagtccgccccgccggcggcgagggacagcgggagattgggccgagtagcggccagagggcctctccccgccggtccgggccgccggcgacccggttgccgccgcaaaatggcggccgcgagctcgaggctgtgcccagcgaaatggcgggagcgccgagttcccggatggagtggcgcagggtgcgcgcggggcgcatgcgcacgcggcgggggcggggccacgtggcgcccccggtctccagggccgctttcccggccttggggctggaggtatccacacaccaacgcttttgcttaccgagccttagtttcctccttttcccattgcgattgcatgagggaaaggacggcctcgtaaatcttgggtaggcgtggcccgttctagtgtggttcctcgtctgccacgtcgtgctttgcgcccaaagtttggtccaagttggcacagctcccagtgccagacttccaagtctagttctcagagccactgggtggcggccattcccagccagtgaatgctttgtctgtgtcagcactgaccgcccccttaaatagccagttctcctaaatgccacttcccctgcctggaaatcctgccttatcacttccggggccatcccttcccgattcccggcctaggtcctggctatggaagtcagtacctgccctgaggtgccccccaggacggggcggcctccctgacagccagcccccccccagtctcaggaggcattttacagtgagcagaagcacgttctggtccagcaacaagtagatgtcagttggttagggtaggagttggcacccgttcggaaataggagaacctgagagtgcagtcctgcccagggcacaactggaaggctgtgggggaagggagacacccattgtggaaatgggtgcggcctgccttcagtcttgggggtggatggagtaaattatttgaattaagaagtcctaggtggctgggtgcggtggctcacacctgtaatcccaaaactttgggtggccaaggtgggaggattgcttgagcccaggagtttcagaccagcctgggcaacagagcaagaccccatctctactaaaacaaatttaaaaaaattatccaggcgtggtggtgtacacctacagtcccagtttcttgggaggctgaggtaggaggattgcttgagcccaggaggtggaggctgcagtgacccctgcactccagtctgggtgacagttagacacactgcccccgaccccaaaaaaataagtcctaggtatgagtttgagataatgaaaaataaaaatctgattttctaatatttcccctaaaaaacacatgtcatttacataaaataggaagcggggagaggtggtgagagatgacccctgttgaggatttcattggtgtctgccacaggccgccatggcatcagatgaaggcaaactttttgttggagggctgagttttgacaccaatgagcagtcgctggagcaggtcttctcaaagtacggacagatctctgaaggtgaggctgctgctgggcccgcggccctgggcgggggggcttgtgctcctcctacctggaagtacagctgggtgctgactgcagacctctctcccctgcacagtggtggttgtgaaagacagggagacccagagatctcggggatttgggtttgtcacctttgagaacattgacgacgctaaggatgccatgatggccatgaatgggaaggtgaggatcagggtgctgagcaggagtcccgtctcgaggatggggcacccacctgctaacccgtcccgccctctgtctccagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggtgagtgccatgagtgggtcccttggggatgctgtgaggtactgctggtgggagctggtacttactttttcctgtatgtgcaggaggaggggaccgaggctatggggggaaccggttcgagtccaggagtgggggctacggaggctccagagactactatagcaggtgagggggaggccggcccaagcacaggggtggttgcgggatggccagcttccgtcccgggtcccaggtccctgggggagctgagatgagactggctgggcaaggagcagaggcaggtggggacccaggccaagaggagaggagactgctcaggacattcgcagaagcgggagggcctgggggacaggctggtggagattttgaacaatttccaagatgctgccctgctggggtccttgttgtgtccccagaagggacggctggcatgggggctggcggctcagcctgttgtggcagagcagaagtagacgggtaccttccggtactcaacgtttgtctgtcttgcagccggagtcagagtggtggctacagtgaccggagctcgggcgggtcctacagagacagttacgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgtaagtgctttcgggaagagtggcatgtggcgctgagccctgtcccgggcggcacctgggcgtttcagtgagtcctgctctcccgcacctatggccccacggcgggcgcctttcggtgtgtgttgggtgcagggcagcgcctcccgggagcgccgggtccctcgcctggagcccgcgcctgttctccctcccttcctcctccttccaggaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaagccgagtctgtggttcaggggggtctgtcggcggagcggggccactggaagaaaagcctgcggacctcggttcagcgcacgagtaggacccgacagggaagactgcaagggtcattgtccgagcagtgaccgcggggggctcgccactgagggggttcgcagcgcggagactccagtctcgcgggatctgaggcgcactcggcttcgagggagcggcggccgcgcagccgctgtcaggccccgtcttgggccgagtcccgggttccctgtagcaggctggggagcggggcgccaccttcctgggccctggacgtggccgacgcgttctcagtgtccgtgaggccggggcaggagtggcgg

SEQ ID NO: 13340 - DNA, 6817 bp, Human; identical to SEQ ID NO: 12039

SEQ ID NO: 13341 - DNA, 15273 bp, Human; identical to SEQ ID NO: 12356

SEQ ID NO: 13342 - DNA, 6029 bp, Human
ggccgctgcagcctgggtccagtggcactggccgggggagaccgctccttggacaccaggccactcctcctccccgcctctcccccgcccgcgcctctcccccgcccgcgcctctcccctgcgcgcctctcccccgcccgcgcctctcccccgcccgcgcctctcccccgcccgcgcctctcccttgcccgcccctctcccctgcccgcgcctctcccctgcatgcctctcccttgcccgcccctctcccctgcccgcgcctctcccctgcgcgcctctcccctgcccgcgcctctcccccggccgctcctctcccccgcccgcgcctctcccccgcccgcgcctctcccctgcgcgcctctcccctgcctgcccctctcccctgcctgcgcctccgcccggtgtgctgttcccccagaaagccaggtgccctcgcctcctccggcgcctcccctgacctcactggaagtggcgaggacagccacagccctccccgattcactgttctccactgaaccgcgtgctcctctcattcatggggccctcctagcctcctcccacccagaaagatcagctccccagggcagaggatttttgtctgtgttgttcgttattggactcatgtggcttagaacgggactgggcatacaggtggtgctcagtaagtgcttggggctgggcactgtggctcacgcctgtactcccagtactttgggaggctgggatgggaggatcacttgaggccaggagtttgggagcagcctgaccaacctagtgagaccccatctctataaaagacattttttttttttttttttttttagacagagtctcactcagtcatccaggctggagtgcagtggtgcaatctcggctcactgccacctctgccttccaggttcaagtaattctcctgcctcagcctcctgagtagctgggattacaggcatgcaccaacacgcttggctaatttttgtatttttagtagagacggtgttttgccacgttggccaggctggtctcgaactcctgacctcaagtgatctgctctcctcagcctcccaaagtgctgggattataggagagagccaccgcgtccagcctacaaaagaaaaatttaaaaatcaaccgggcatggtagcacacgccaagccactcatgagctgagatgggaggatcacttgagcccaggaggttgaggctgcagtgagctgtgatcatgccaccacactccagcctcggcgacagagcaagaccccatctcaaaaaaaaagtgctttgaagatgaatgaatgggccaggggcggtggctgtaatcccagcactttgggaggccgaggcgggcggatcgcctgaggtcaggagtttgagaccagcctgatcgatatgggaaaccccgtgtctactaaaaatacaaaaattagctgggcgtgacggcaggtgtctgtagtcccagctacttgggaggctgaggcagcagaattgcttgaacccaggaggcagaggttgcagtgagccgagattgtgccactgcactctagcctgggcaacaagagcgaaactccatctcaaaaaaaaaaaaaagaaaagaaagaaagaaagaaaacatgaatgaatggccgggcactatggctcacacttgtaatcccagcactttcggaggctgaggaaggcagatcacttgaggttgggagtttgagaccaggctggccacctcacccaatgggatggctccgggaggttccagtgagccgagatcacgccactgcattccagcctgggtggcagagcaagactccatctcaaaagaaagaaagaaggaaagaaaatgaatgaatacaatagtgacaaatgggacaaagggggtcgtggggcccaggcggagggagcggcatccgcggcgttttgaggtggtgggtgtggtgggtgtggtgggaggcgcccgggcggccaccgtgacctggaagcagcgtctcaccgccgcctgccttctgccccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcgtaagtaaccgtgcccccaccccgggcaccgggctgccatgaggggaggagggcggcggccagggttccacgccacctcttagctgtgtggcttcatgctgtgcctcagtctccccacctggaaggtgggcacacccaacacccaacgggcaggctcagcggggtgggggtgctcacattgcacctggctgcttgggtgggtctgggggttccctgccccccactcccctctaggaccacaggaaggtgtgggagacccatccgccctcaccggcggccccttccagaatccaggactccaggtatccagcgggaggcccataaatgcccagttcctatgaaagacctcagcccctccctgctcacactttttgtttgtttttgagacggagtgtcgctctgttgtccaggctggagtgcagtggtgagatctcagctcactgcaacctccgcctcccaggttcaaggtattctcctgcctcagcctcctgagtaactaggtgcacaggtacctgccaccgtgcctggctaatttttttggtatttttagtagagatgaggtttctccatgttgaccaggctggtcttgaactcctggcatcaagtgatgcctggctggtgctcacacattttaaagaaaattccaggccagcagtggtggctcacgcctgtaatctcagcactttgggaggccaaagcggaaggatcttttgagtccaggagttcaagaccagcctgggcaacatagcagggtggcatctctacaaataatttaaatattagctgggcatggtgatgtgagcctgtaggcccagctactcaggaggctaaggcaggaggatcacttgagcctggggagttcgaggttgcagtgagctatgattgtgccactgcactccagcctggagaacagagcgagaccctgtctcgagagaaagacagccagctactcgggaggccgaggcaggagaatcacttgaacccgggaggcagaggttgcagtgagccgagatcacggcactgcactccagcctgggtgacagagcgagactctgtcgcaaacaaaacaaaaacaaaacaaaacaaaacaaaaggagaaagaaagaaagagatagagagagaaagaaagaagaaagaaagaaaaagagagaaagaaagaaagaaagaaagaaaaagaaagagagagagagagagagagagagagaaagaaagaaagaaagttccatattggaagcattttattctgaaacagctgtggctaccccagcccccttcctggctgcctggggccagcccgggtgactggctgtccccatcctcccgggagactcaggtggcccctgatgggtgactggccgtccccatcctccagggagactcaggtggcccctgatgggtgactggccgtccctgtcctccagggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactccccctggctcctgtctgtccttcccatatagggaggggagggggaactgcccaccgtgacctcaataaacgttgaaactccccctggctcctgtctgtccttcccatatagggagggaaccagggagaggtcccctgggttcaagtccccgagccccaaactcaggatggggggagtcggagcgggggatgggggcccaggttgcagggggtctctctcctggatgctcgtggctgtgggttctaacccggccccatcagggtggccctgggcaggttgttattcatctccgtgcctcagtttcctcatctggaaaatggactcgccccagacgtttcctagaactgtccctgctggctcagggactccttgaggaaggggatggggatggggaagcagcctggggggcttcctggaggaggtggcagtgccagagctgcatatcaaggtgtgaacagaaacatccgaagggctgccaggcagggggcacagtccaggcagagacctgagggctagaggccaggggacggggaggagggcaggcaggggagggatgtgggtgcaggggaggggtaatggggttggagcgctatttctcgtaggaggggtaggcagggcaggagttccctggtagaagcatgagcaatgaactgggtgggggggtggccagaggggaggtccgaggcggggaagaggtgggactcacagtccagctcaaagacgggcaagtggccactagaaggaggcattagccacagagaggggacgacctgctccaggacacgtgtagagaagaaatgaagctcattgctggtgttttttttttctttttaatatttttttgagacagagtctcgctctgtcacccaggctggagtgcagtggtgtgatctcggctcactgcaagctccgccacccgggttgaagcgattctcctgcctcagcctccggagtagctgggactacaggcacagaccaccacgcccagttaatttttatatttttagtacagacagggtttcaccacgttgtccaggctggtctcgaactcctgacctcaggtggtccacccgcctcagcttcccaaagtgctgggtttacaggcgtgagcctacttacttatttacagctggcctacttatttatttttgagacagggtctcactctgtcgcccagtctgtagtgcagtggtgcaatcttggcttaccgcagcctcaacctcctgggctcaagtgatcctcccacctcagcctcccgagtagctgggactacaggtgccaccacacccagctattttcttagtttttgtagagacggggtctggctgtgttgcccaggtgggtcctcagtgactctttacatatgaacacctccaggtcactgtaatcttagcaatctcctggcctcccagaagaccccacgtccccctcggagtctacacccgctgtgaccataacacccctaccttccctgccacagttaatggtgaaccagctctcaaagcaacactttctttttttttttttttttttttttttttttgagacggagtctcgctctgtcgcccaggctggagtgcagtggcatgatctcggctcactgcaacctccgcctcctaggttcaagcaattctcctgcctcagtctcccgagtagccgggattacaggcaggtaccaccacgccaggctaattttgtatttttggtagagacggggtttgtccatgttggtcaggctggaattcccaacctcaggtgatacacccgcctcagcctcccaaagtgttgggattacaggcctgagccaccgcgcccggccagacaacactttcttagctaagaactttatgaacgtgaatttatttcatcctcttgacaggtttatgtgatggatcctacgattataattttacagaggaggaaactgagtcacggagagtttatttcaggggcctgaagttacacagtggccaaatggccacaccagaaccaggatatgaa

SEQ ID NO: 13343 - DNA, 18955 bp, Human
  misc_feature (1)...(18955): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtgagcccccccaccactccctcgcctgtgagttcccccaccactccctccctgtgagtcccccaacactccctccctgtgagccgcccaaaccactccctccccgtgagccccccaccacttcctccctgtgagctccctgtgaggcccccgaccagtccctccctgtgagcagtaatggcgccactgcactccagcttgggcaacggagtaagaccctgtctcaaaataaatagggcgggagtggtggctcacgcctgtaatcccagcacttgggcaagccgaggtgggaggattgcctgaggtcagagtttgagacacagcctggccaatatggcaaaaccatctctactaaaaatacaaaaattagccgggtgtgatggtggcgtgcacctgtaatcccagctactcaggaggctgaggcaggagaactgcttgaaccctggaggcggaggttgcagtgagccgagactgtgccgttgcactccagcctgggcaacagagtgagactctgtcacaaaaaaataaaaataaacaaataaataaaaataaggctatcacagggttttggatgtagcatttaataggtgctctgtggccaggcgtggtggctcaggcctgcaatcccagcactttggggggccgaggcgggtggatcacgaggtcaggagattgagatcatcctggctaacatggtgaaacagtgaaaccccgtctctactaaaaatgcaaaaaaattagccggacatggtggcgggcgcctgtagtcccagctactcgggaggctgaggcaggagaatggcgtgaacccgggaggtggagcttgcagtgagccgagatcgtgccgctgcactccagcctgggcaacagagtgaaactccgtctcaaaaataataataataataataataataataataataaataattaaaaattttttaaaaacagaaattaaaaatagaagctctgtaactgccagtgcactctgtgaagggggctactctgagacccctctatccacaggtccatcttgagtggcctcttcccacccagtggtggctctgccttcatcctgggccacgacgtccgctccagcatggccgccatccggccccacctgggcgtctgtcctcagtacaacgtgctgtttgacatgtgcgtctcggcaggcccagagtgcagcggtgggaagggactggacgccctctgggactctgcctgccatgtgggtcactctgctctgtgcactggccgcaggctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgagcccatccccaagggaggtcacctcacagggaggggcctggggattcatcctgaaggcagggggaagccgggtactgaggtccacgtgggtaggcaaccttgcccaaggctgggtgtgacacactgaggtcccttccccatctctaccaggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtaagagctggggattctgctcgaggggccagaaaaggcttctgacaaggaagtgctggggatggggttttgaggaatgagtaggagtttgctacatgtggaccccacttgttgctatggcatttaggggctactgctcaaataccgagacagtaagagttggggatagacagaggttcccctggattctgcctgaagggccagaaaaggtttccaacaaggaggttctggggatgaggttttgagggatgaataggagtttgcttcatggggcagacaactcctggcagaggccccagctcgggcaaagacgcggcggcctgatggtagttgtgggttggtcccccgtgcctaggtcgcacgctgatcctctccacccaccacctggatgaggcagagctgctgggagaccgtgtggccgtggtggcaggtggccgcttgtgctgctgtggctccccactcttcctgcgccgtcacctgggctccggctactacctgacgctggtgaaggcccgcctgcccctgaccaccaatgagaaggtggggaccggccttctcctgacccctgacccccgggactctgttcagccctgaaggccaagccacttggtgcctctctgcccgcaggctgacactgacatggagggcagtgtggacaccaggcaggaaaagaagaatggcagccagggcagcagagtcggtgagggccggggtgggagacccaaggcgggtgggcagtggggtggctgtgccttaacttgaggaggaggagggggagggggaagaggaggaggagggggaggaagcggcagaggaggttgaggcggaggaggagggggaggaggagggggaggagtaagaggtggaaggggaggcgaaggggaggagtaggagggagaggaggagggggagggagaggaggagggggaggagaaggggggaggaggaggggaagggagaggaggagggggagaagaaggggaggagtaggaggggagcagaaggggaggaataggagggggaggaggagggggagggagaggaggagggggagggagaggaggagggggaggagtaggaggtgagcagaaggggaggagtaggagggggaggaggagggggagggagaggaggagggggagggagaggaggagggggaggtagaggaggaggaggagggaggagtaggaggggagcagaaggggaggagtaggagggggaggaggagagggagagagaggagggggaggagaaggggaggagtaggagggagaggaggaggagggggagggagaggaaggggaggagtaggagggagaggaggagaaagaggagggggaggagaaggaggaggggaggagaaggaggagggggagaagaaggggaagaataaggggggaggagtaagggggagggggaggagaagggggagaagtaggagggagaggagggggaggagaagggggaggagtaggagggagaggaggaggagggagaggagggggaggagaaggagaggaggaggagagcacttgagaacctgagatgatgcccccatccctgggctgagccggaaccatgagactaacttgaacactgaccccacctttaacccaaccagggctgagcccagagacaaacctacccctgacctccaacactaggtccagcactgccctcaagatctctttttgtttgtttctgagtcttgctctgtcgcccaggctgtagtgcagtggtgtgatctcagctcactgcaacctctgcctcctgggttcaagcatttctcctccctcagcctctcgagtaactgggattacaggtgggttccaccatgcctggctaatttttgcatttttggtagaaatggggtttcaccatgttggtcaggctggtctcaaactcctgacctcaggtgatctgcctgcttcaaccctcaaagtgctgggattacaggcgtgagccactgcgcccggccgcacctggcctacgttcttaaccctgatctctgtctgccgggacagtcccctcacaggtcaccaatgcctcttccccagggagactggggtggggcgtgagccggggctccctgaagcacccctttgtccacacaggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggaggtgtgaggcctgggtggtggtgaggtggggccaggaggagggcttcctggaggaggtggtgttttgaaggatgaatagcgtgtttatgagcagcaaggacattcagggaggaggcatggcacatgaggagctctggtggctcagatgtcccttgggaaggcctgggggacccatggtgtaggaggggtggggggctcacaagcccccagttctccctgtcggtgtccagtctctgagcccctgcttgtctccccagatcttcctgaaggtggtggaggagtgtgctgcggacacagatatggagggtgcggccacagctccctgacccctgaccccagtccagagtgggaccagaggccaggtccccatccctggcttagtgtggcccaaggcatagcctttaccctatacctgattcctgatcccccaatccgtgaccctcaactttgaccctgacccctgatggccctgcagatggcagctgcgggcagcacctatgcacaggcattgctggcctagacgtaaccctacggctcaagatgccgccacaggagacagcgctggagaacggggaaccaggtaagtccttcccagtggccctggggtcctcccagccacccccccacagcagcgtgagcactgaccctctcatccctcacagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccaggtgaggagggctagcaccagggagtcgcatgggagtccctgagttccctaccctggccgtccactcagtggcctaatccaaacccttacccccgtgtgtattcccaacccaaagcacatttattgagggcactggggagccatgggtggttgtagagcaggagcagggacaggtgcaagcaagcctggagggtggatggaagcagcagctgatgggctggtcccccagatcgtgctgcctgccctctttgtgggcctggccctcgtgttcagcctcatcgtgcctcctttcgggcactacccggctctgcggctcagtcccaccatgtacggtgctcaggtgtccttcttcaggtgggtgcagaaggaaggggctggtggcaggaagactagggacctgggggtacagccctgaccctacatctcccctcacacacagtgaggacgccccaggggaccctggacgtgcccggctgctcgaggcgctgctgcaggaggcaggactggaggagcccccagtgcagcatagctcccacaggtgaggcgtcttgttggcctggacctttcccctctctggcctcagttttcccatctggtccctggccagggagcctcagggggcacctggagcatcccctgtgcccacctgggagctgggagcctctgtggctccaggaacccccagaagctgggtgcccacagaccttcaccttgaccctgcagcgcccttgagtgtgcacagcccattgtctgcaggttctcggcaccagaagttcctgctgaagtggccaaggtcttggccagtggcaactggaccccagagtctccatccccagcctgccagtgtagccggcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccaggggtgagccatgccctgggactcagtttccctggctatagcatgggtccttgggttgctggggctggtgtggtcctggaggaggaagtggaggggttggatgcccagcttggggctacgggctgggagtctcgcgtaccttcctttcctctttttttttttttttttttttgagatggagtctccctctgttgcccaggctggagtgcagaggtgtgatctcagctcattgcaacctccacctcccagtttcaagcgattctcctccctcagcctcccgagtagctgggattacaggcacgcaccaccactcccgactaatttttgtatttttagtagagatggggtttcaccgtgttgccaggctggtctcgaactcctgacctcaggtgatccacccgccttggcctcccaaagtgttgggattacaggcaggagccaccgcgcccggctttctttcctgtttttgtccacccttgactctgtgctcccctctcaccatctctctctctgtcccacatccctgtctgcctgtgtctctgtccatctctcccacagcctgaagactaagaagtgggtgaatgaggtcaggtgaggaggggtctagcttggggtcccctgccccagttccactcccatgccctctgcctgccccctgggagctctcccggcccccccggccctcagctccccttccctgcctgcatggccccacagatacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggatgctcaggacagtctcaaggtgggaactgggggggcaggtgggcgtcctgtcacagcaaggtccaaccccattgctctgaccctatgaccttgacccccacccagatctggttcaacaacaaaggctggcactccatggtggcctttgtcaaccgagccagcaacgcaatcctccgtgctcacctgcccccaggcccggcccgccacgcccacagcatcaccacactcaaccaccccttgaacctcaccaaggagcagctgtctgaggctgcactgtgagtccctccaccctgcatgtcctaccctgcacgtcctaccctgcctccatttctctgtcgtttggggtggtgggagctggatttgaaccctgacacactcttgctttataaatgggggatagaaactgttcctctgctccctaagccagggaaatgggacctcctcagactcagcgggccccagcctcccccacacatcctcatcccaccaacctttatcctgcctgagacctgtacaacctctgctgccaaatcccaggcaccctcatccctaaattgcccctgccatctctgccactgctgactgccccatagacctttgtcccatcaatggcgtgttcagctctgctctgagcaacccatgcaccctcaccctacaacagctctcatgtcttcacctccaggatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatggtgcgggggctgcttggacgggtgggggcccagccactgcttgccactgccctgtctggccccttgtaggcaggggcttgtccaagatggcctgggtaaagtcttgaggattgtgggagactttgtgccttcctactcaaaaagcaaggaggtcagggtgggaacagggctgagggtggcagtgcccacctctttaggctgataaaggtaactgccatctccaatgcagtgtaactacttggtgccagcatgcatcgtggtgctcatctttctggccttccagcagagggcatatgtggcccctgccaacctgcctgctctcctgctgttgctactactgtatgggtgaggcccccagtccctcagggcctattcttactgaccccttactgccttccacattaatgctgctgagatagaactctgcagtgactcccaaggagaggatatggaggtctgaggtgatgccgtgtgtgatccaattcagtggtgtgccaaggtggccttaaaagctcatcttatcctgactcatattagtagagttctaaggcagcccatgcctgtaattccagtactttgggaggccgaggcaggaggactgcttgtggccaggagtttgagaccagcctgggaaacatagagagacccacctctaaaaaagaaagaaagagagagaaagagaaagagagaaagaaaaaaaaaaaaacagaaatgtgctttgggtgaaaatgtcaaggtctaaggcagagaagatgggaatggagatttttattcctctcagggcttctcagtctgagtggttactccagtgactcctattgtcccttcagctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcaggtggggcaccacgaggctggggcttgggctgggttgggtcgttggactcagcccctgaccaacatccgtctcccacccttgagcagaagctgcaggaggtgagccggatcttgaaacaggtcttccttatcttcccccacttctgcttgggccgggggctcattgacatggtgcggaaccaggccatggctgatgcctttgagcgcttgggtgagaacttcctgtcaggtggggccatggctacagatagctagcacccttggagacctagagttaattatacagagtggagaaaaacagccccccagggagacagccagggttcttaggtggccctaaggttgggccaagttggaggtacaagaaagcagccataaaaagctaattcttagattacatcacaagaggcctcttctgttttctatgccaattagactccagctgagtggcctatccaatttgtgttcctttcccttaagaatccagagtgacatggatggagaaagggccagaaaccaagactctcatggacccagtccctcctttctatatccacaggagacaggcagttccagtcacccctgcgctgggaggtggtcggcaagaacctcttggccatggtgatacaggggcccctcttccttctcttcacactactgctgcagcaccgaagccaactcctgccacagttagtgaggtctatggagagggtggcaggggccaaggacctactttaagcccacagatattctgtccccaggcccagggtgaggtctctgccactcctgggagaggaggacgaggatgtagcccgtgaacgggagcgggtggtccaaggagccacccagggggatgtgttggtgctgaggaacttgaccaaggtaggtgtggtcaggtcgactgctgggtggggggtgctcccactggcccactcacctttctgaaagacctgcactctcccaggtataccgtgggcagaggatgccagctgttgaccgcttgtgcctggggattccccctggtgaggtgagtccaggggtggaggccaggtgcagggacagtgagtggctgccctactgcatgccctgcccatcatcctttactgaacacctactgtgtatccaccaccttttattgggcacctactgtatgccaatatttgtgctcctatttttattttattatattattatttatttatttatttatttatttatttatttgagatggagtctcactctgtctcccaggctggagtgcagtggtgggatctcagctcactgcaagctccacctcccgggttcatgccattctcctgcctcagcctcccgagtagctgggactgcaggcgcccaccaccacgcccggctaatttttttgtatttttagcagagacggggtttcaccgtgttagccaggatggtctccatctcctgacctcgtgatccacccgcctcagcctcccagagtgctgggattacaagcgtgagccaccacacctgccctattttatctttttttagagacggagtctcactctgtcgcccaggctggagtgcagtggtgagatctcggctcactacaagctccacctcccgggttcacaccattttcctgcctcagcctcccaggtagctgggactgcaggcgcctgccatcacgcctggctaatttttgtatttttagtagagacagggcttcaccatattagccaggatggtctcgatctcctgacctcatgatccacccgcctcagcctcccaaagtgctgggattacaggcgtgagccactgcgtctggcctgtgcatttatcttgagccaacaaaacctcattaagcacctactgcatgcttacctctgttaaacacacactgtgctcactaaagaggtgtactgaatacttttgtgtccatcaacgtttatcaaataccaatagaatttattggacccctattgtatacacatctacatcaagcacttgctcacagccagcatttatcaggcacctgctttgtaccagttcacattcaagcacctactatatacaaatgtatttgctgtgtgccacttattggccacctactagggctggtacacatctgcaaacaagtgctgtttgttagcacacattgcagtatatatatatatttttttttctttttttttcttttgagatggagtctcactgtcacccagcttggtgtgcaatggtgtaatcttggctcacggtaacctccgcctcccaggttcaagcgattctccagcctcagcctcccgagtagctgggaccacaggcacatgccgccatgcccagctgattttgtatttttagtagagacggggtttcaccatgttggccaggctggtcttgcactcctgacctcaaatgatccacccaccttggcctccgaaagttctgggatcacatgtgtgagccaccatgcccggcctttgtttttttctttttttttttttttgagacaaagtctcgctctgccacccaggctggagtgcagtgtcacgatctcggctcactgcaacctctgcctcccaggttcaggcgattctcctgcctcagcctcctgagtagctgggattacaggcgcccgccaccacaaccggctaatttttgtatttttagtagagatggggtttcacaatgttggtcaggctgatcttgaactcttgacctcaggtgatctgcccacctcggcttcccaaagtgctggggttacaggtgtgagccactgggcctggcccacagtatatctttactaagcacctactgtgtgctggccaacctctctaccttgggctgactgtgcacctagcctaagtacacacagtgtgccaggaaacatatggagagctcatgccctgatatttgttgagcactgctgcacacgacctttatagggtacccactgtgtgccaaaagccattccctgctaagtgacagctttatgcctcgctacataccccaatatctgcctagctcccccggggccccacccacggccttccatgtggacactcagaaatcagaggtgctgaggccaggcgtggtggctcacagctgtaaccccagcactttgggaggccaaggcaggaggatcacttgaggtcaggagttcgagaccagcctggccaacatgccaaaaccccgtctctactaaaaatacaaaaattagccgggcttggtggcacacgcctgtagtcccagctactccggagcctgagacaggagaattgcttgaacccaggaggtggaggttgcagtgggccaagatcgtgccattgcgccggggtgacacagcaaggctccgtctcaaaaaaaaaaaaaaaaaaaaaagaggctgggtgccgtggctcacgcctgtaatcccagcactttaggagttcaaggcaggcggatcacaaggtcaagagatcgagaccatcctggccaacacggtgaaaccccatctctactaaaaaaaaatacaaaaattagctgggcatggtggcaggcgtctgtagccccagctacttgggaggctaaggcaggagaattgcttgaacccgggaggcagaggttgcagtgagccaagatcgcaccactgcagtccagcctgggaaacaagagcaaaacttggtctcaaaaaaaaaaaaaaaagaaatcagagatgccggaaccagggcctggggcctcactgagcaccatctgtgggcatccctgtagtgttttgggctgctgggtgtgaatggagcagggaagacgtccacgtttcgcatggtgacgggggacacattggccagcaggggcgaggctgtgctggcaggccacaggtgaggggtgccaggtagggtcagggtggggcagggttggccctgacgtccttgtgcttccccacccctccacctccagtgaatggactgggctcactgccccacacctgcatggtctctgagacccctgcacctctacctcccacacgcggaccaggccctgagacacccctgtcccttatcagcgtggccctggatgggtgggccctgagacccctgtgttagccaccagtatggtcagggactagccagctctctgagcccccggcgcccccatccccagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccaggtgagcccactttgtccccaccgctctcacctcccagggcccacccgacccaggccgtgcctctaaagcctggcccaatcccgcactctctcgccttggctccatccctgtccctgcccccagaccgtgcttccttcccctatacctctgtcccccatcctggtccaatagggatgtggctagcccgcctctttgccccgcaacaccaagttccaccattctcattggtccacccacccttccttccgctgcacgttgcccctctctccttgactctgccttctgtggccctgcccacttgctcctcttctgcctaccccctagggcttcgcgcctttctcgctggggtcacggtcacattctcactctggccgttcccagtttgcagccgtttcactgcctcttccatctgcttgggggtcttgtctttgccctggcccgccccaccctcacactgtcccaccccatgccctttctggccctgcctcatacccatgttggctccacccacaccatggccctgctccatacccatcccagctccacccataccaaggccccaccccatactcatgctggctccacccacaccatggccccgccccatactcatgctggctccacccacaccatggccccgccccatactcatgctggctccacccacaccatggccccgccccatactcatgctggctccacccacaccatggccccaccccatactcatgctgtctccacccacaccatggccctgccccatactcatgctggctctacccacaccatggccccgccgcatactcatgctggctccaccagtgtggccccgccccatactcatgctggctccacccacaccatggccccgccccatactcatgctggctccaccagtgtggccccgccccatactcatgctgtctccacccacaccatggccccgccccatactcatgctggctccacccacactatggccctgccccacacccatcccagctccacccacaccatggccccgccccatactcatgctggctccacccacaccatggccccgccccatactcatgctgcccccaccacactatgtcccattctcacatttgccctgccccatgcccattgtgcccctgctccacactcaatgctggccccgccacactgtggccctgccccatactcatcaatatgagtccccatgcctactctggccccaccccacagaccgctggctcgggcctggcgcgtctgggactctcatggtacgcagaccggcctgcaggcacctacagcggagggaacaaacgcaagctggcgacggccctggcgctggttggggacccagccgtggtgtttctggtgcgtgggagcggtgcctgggtggggtggggcctgcgacggaggcggggccttgcttatgggatcttccgtgctccccaggacgagccgaccacaggcatggaccccagcgcgcggcgcttcctttggaacagccttttggccgtggtgcgggagggccgttcagtgatgctcacctcccataggtggccgggctctgatgccctgggctgtggttaaggtgatccaggcctggagagagagccccaaagcacaaggccacaggggatggggggtcctggccctagtggggcgagggcgccaggccccggggtgtaaggacacacagaggtgggacgcggcgccgggatcagaacggtctggggaagagtggggagatgtccacaccagaagggtggcccaggccgggggaagcaggcagtgtggcgccaggcacaggtggccccggcctcacggagctcgtggtgccgggtcccgacagcatggaggagtgtgaagcgctctgctcgcgcctggccatcatggtgaatgggcggttccgctgcctgggcagcccgcaacatctcaagggcaggtgagccggcgcggcctccaggcaggtgtggggtgagggtgggcacgtaggtaggctcaggggagaggccagacgtagagccgggtgaggaaagtttggctccaactggagagatggccaaggctttagattgtcctgcaggggtgactgagggggcgagacaggctggggtgtgctgggggcgcaggaccaggaggcgtgagccgggggctctgggtggatttagaagacacaatcaggtgtgcgttggagtaggtgcagcctggagaggtgagggtggattgatgggtggagttaggggagggcctggttagtgggcggggccataggaaagtggggcgggggtatttattgtgtgggcgggggtagagtgcaagggcgaaagaggagtgtccgaaaaaggagtcaagtggggtgatagcttcgagagcaacctgggcaacctagggagaccccatctctataaaaaatttaaaaattagctggacatggtggtgtgtgcctgtggtctcagctacgcgggcggggggtggcgggggactgagacgggaggaccacttgatcgctagggtagtacaagtatggggcggggccagagagtattaggggctggagggtgagctgaggtgggacctgggaaaggcccgatccggtagccctggccccactcactgcagattcgcggcgggtcacacactgaccctgcgggtgcccgccgcaaggtcccagccggcagcggccttcgtggcggccgagttccctggggcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtgatcacggcgccggggtcgggctgggggaggcaggctgggggccaggcccgtgggctgaccgtccctcttgtcccctctgggctgcccaccgctaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtgctggtgaaaccgtgtgcatgtgtgtccttgagccaggctgcacacatgtccacacagctgcctgcacatgcgtctggatatggctggccccttgcaagctgagtgtgcacatacgggccaagtggcgattcataggacacaggtgtgagcgtgcctacagctgaccggatcccagctgtaaatgcctctgtggccagcccaggagttggggatgtgagtgcgggcctcataagggcctggtcacaccgtccctgtccccacgtccctgcgtgcctatgtggggctggcgcctaagggcggtacctgtaagtgcctggccataaagtggggatgaggtcaggactcaggaatgtcctgggaagcttacaggagcccggtgtcccggagcacaggccagggccgggccagaagcccatccgacatccagctgaccctcaccctctgaccccagccctcagcgccatgagtcgggggcaaagagttctcaagggtctgctgggctgggtttgcacttggacctgggcctggagagccagacttggagcaaggggctgtggccttcatgtcctgtgccccagagatctgcccctcccacccgaggtaggtgggaatggggtttgggaaaggaaagaggttggggttttgggattgggggtggggttctggaaggggacagcagggagacttggggaggggggagagagttcacactgcggggtgggggttgggggaaggtaggaggctgggatctgtatgcctgcagatgccccagctcttggccaatgccgcctcaggctgttatcagcaacgggtgcctgcgtcctgctgcccagcacgtccggtggtccagagtcactggaatgcagcttgggaggcggggctggggaccttagctaagggcaggtctggggcaacatgatatggcccacagggctgctgagaggtaaccaggtgtcctcagcatattctgccgatggtggggtccacaccacactttggggacccctgtgcaggcagcccaggaccaggtggacgtggggacccagacggacgtggggacccagacggacagggcccggtaacctggattgttctgacttcctggacgtctttgcccccagggtttcggttctgggcctcagtttccccacctgtcctcgacctgacccacttcacggggctgcagggcgggtgatgggggggaccctactctgcccggccctgctggggcccggccacaccctagggtctgcaggagaggcggtggagcgggcttgccttcagggaaaagggggctgcaggggcgcagcttcggcctgtgcgtgtgtctggggtctgagggcgaggctccaggggcttggtggcgtctgagcgcgtgtggaggtccgggtctctgcgtgtcatcgtgcacgtgtctgtgcacgcccactcgcgtccgggagtgagagtcagcgccctgcagtcggccgccccgtgcccgccagcgtcaggcaggggctcccggtcccaccccgcgagcggcgcggctccgagctcccgaaggcggaagcggggggcgcggcccggggctgggggcggggcctgcgacctcaccttcgcgcccactccgcagagccgcaggctgaggccgggaagggtcgggggcgaggccgcgtcgccgcctccccgaagccttttcctgttggggggagggcccgccagtgacggccgggcctgtcacgtgggcctgacagctggggagggggtggccggcgacaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcgggggtgagtggagcccgggtgagacccggagctgacgccgggccgcagggggacagggacccgccctgtgctcggggctcat

SEQ ID NO: 13344 - DNA, 18079 bp, Human
taaaagagccccccaccagacggagccgcccgggaagcttctccagcctgtctgggctacagagccttgtgtggctagaacccaaggccctcactccaggggtgctgagagagcctgtccagagggcctgcctcagccaccacctgggacaggttcacgccctccactgaagagacacccggccagccctgggccttcgacctgggacgtctgtagtggggtcaggggatgagacctggagctcagaacagacgggctgagctccctggaggagagagaactgagaaccttgtcctggcagggacgctagagcactgggtgggacagacctttctggaagagcaagattttaacaggaagaaaaagtggaaggacttcccagcaggacccagcctgaacaaaggtcaggtggtgtggcccgcgtggcccgctggggaatcgggggaggagggcacgcaggagacacaggacagagcccaccacgtctcagagctgtgggacggtggtgggtccggtccccaccccaccttgctggggcacaggttagcttgcccatctctgggttcacggtccctgccaggagtttgggtaatgcctcacacagggaccttcgggtccaagggctgttggtgcttgccctgcagttccctctcctgcactgggcctggtgaatgacactaattcagagacgtacaacacgatctgggcatcgccagcaaagtccagccagcgtttgatgacagcctaccctccacaagctcagagtctggtgagggaggctgtggcatgaataagggcaaaaacagagggcaggccaggtgcagtggctcacgcctgtaatcctagcactttgggaagcccaggtgggaagatcgcctgagcccaggagttcaagaccagcgtggccaacatggccagacactgtctctatagattggaaaaaagacaaagcagaggccaggcccccagttccccacctgtgtcagcctaccaggaggagaaatcactcggcgttccctgaacagatcagaccccgggtctttgcacaagctgtgcccccgggcagcggccctcccctgcctgcaggattcgtgcgtggagactgatttgctgtcggccggggcttcactctgggcttcttggatcccatccccagctgctcacactccacatcggtccacctactatgctcccggcacccttagggctgaggtgtagggacttactccatccccagggaacagcgtgggtccggagaggcgactcccaggagggccccagggaggtcgcagcccgagcagctttggactttggccagcgcccctctgaaactctgccccggcccccgcagggagactggagttggccgagcccgatttgggacgcgtgcgtcggggttggtgaggctgcggatagcgctggaaccgggcaggtgagaggcccgggacccagggccgggccgggtggagcgcgtgggggcgcgggaggcagggtgcgcccccgcccctcggagaccccaggccgggccacgcggatgccggcggggggcgcgcagaatcggggtcgctgggggcaggccccgggggacgagcctgagacggggtgggccggggcagggggcgggcgcaggctggagacccccgcccagtccccgcgcggccggggcacggcgggagggggcgcccgcggccctcccgacgctcgggcgggacaaaggccggagcccgggcccctccccggcgggtgcggcggcggcggcccgcgctccgacagtccgcgcggccgggtcctgcgcccggggcgaccccggcgccccgccccgccgccgcctgacttctcggcgcccgaggtcgcgcgcgcggaggcgggggcggcccgggatctccaagcgccgccgcgccctcctcccgcccgccctccgcccgcccgctcggcggcggcggcggcggcggaggaggcggagaaggctggcaggcggcggccgggagagcgagcgcggcggccggaccggggccatggcgcccgcgcagcgcccgctgctcccgctgctgctcctgctgttaccgctgccgccgccgcccttcgcgcgcgccgaggacgccgcccgcgccaactcggaccgctacgccgtctactggaaccgcagcaaccccaggtgagcgcggccgcgcgcggggggcgcccggggaccccccaacgccccccaagccgcgcccggcctcgcgcccccggagctccgggcgccccccacgcgcgcgccgccgccgggatgcgggcgcccggttcccgcgggagccccccagggagctccggccccccggagtttgggggactcgcccttttcgcgcctgccttccccggggcgccccattgccctacggactgtggggactcgcgccccacatcccccagagcgccgacgtctcctggagtttggggaacccctctggtaccctccgatgccgggtagcccctgagttgcctgcctggacttggggggacccctgatccacccgcttctctggggagccccctcggtttcgcatttggtggggatccccggggaccttggcaccggaggtgggggactgtggccctcgagggatctctgggttcgtcctgcccgcaggtccccagatgaacttggggaagttggagtgtccctccctcaggacccagcatctgcttcactccagggggccaagggcccagctttgaaaggagactgaggggccggggagctgggggtcagccccgggaggggcagtgggatggagtcctctcttgtcctctgggcgctgaccaggaaactgaggtgcagaggggatgaggagctggctcaaggtcatgcaagggggggacttgggggcaggacccaggtggcccagtgccctgcctgccacgcccggccgagatgccgcacccgcctgctgcaggcccccttgttttgaaccaggtccgggccaggcacaacgtgggggacaggagaagcccccgttggtcagagcaaaaaaagtttgccggggcctggccatggcctggacgtgggtagaaccctctgaaccatcccagggtctccaagacaggagcaggctgcagcttccctgggggtcccgtgggagccggggctttgggggtcctggggctcgggagggagtcagccccagcactcagggtgtcaccgtcttcctaaggcacacggagctgcacatcgggggctgaggcggcccccccccactcttctgctactggtcactttctctccgttttccagccgcttcctgtgccgaccgagccgccctctggagcccgccacccctccttgtcccctctgtctcctgctgtcctcggtccccgggaggaaagttgcatgaaggggtctctttgaggcgggctcggggacaagggcggcccgtgttccgccgtgggggtggggaacacgcacaggcccaccccccaccctggtcaacggcctcgggtcgggccctgggggctgagggcagggaccccgggccgctgggggacggctggcccacctcagagcgggtccccgagccgcccgctgtgctggtcacatgtgggtttgattaaggctgtcgctggccgtgcggggagtccagcgggcagcgcttccccggcccaagtttttggtttcagctgcggaatctcccgtccccagcgtggcctgtcctttgttctagcaaacgccaaacacacgaggacccggcaaccgggggaggaaggtggtcaccagggccgtcctgctgccccacctgccacagggctgtgggctgcgggccggacccccggccaggggaaggaagtggcctccccagtgcctggcttggcccagccacctcctgttgctccgggtctgacctggttgcccagctcaaaccgctgcctgagggaacggccttgctggtccgcagagccgacctgggcagcaccgaggctgcctcctccttcctctcctgcctgcggtatccagggttgctggggacggagccgacaccctgcagtggggcccagggctgggtgagcaccttcccgggaagccgggatccagccagaatcagggctttgtcgcggacatcaggggtctctgcagttctcagatttggtgtccaggggcacctgcccgggacctgtgcctgagtggcgggggtgtcaggcacagcagggggtggtgctgggcctccgtatccaaggggaccctgtggaggggacatcggcttggggagaggagtggcgtcagccggcaggcctaaggtgtgaggctgggctggccggggagggatgatggggtcgggcaggtgtgtgggggatgcggggaccccaagtctttgagaggggcatacagaaaggcactggagacggggacagccgcgatggggggcagacagcagcgtgggcaccaggggaccgtgtgctcgatggggcctgcaggcccgggcagtgccgcagcgtcgccggccgccccttccgcccattggcctggcacctgtgcccaggcgatgactgtgtggtctgtctccacatcacaccctctctgctgtgagaggcgatgcctgcacccaggggaccccgcacccacctccttgggccgctataaggtggggccccgttgggtggtctggctggccggccccgccactcccaccggtgactgcacagcgtccgtccaacccactccccaacctgggctgggtacccctgagctggccgccaggagtctctgggcctgttcccagccgacccgcatcgggctggggcgtccagggcttggacctggccggctgccctcacctgtcctgttggacctggccagctgccctcacctgtcctggccacaacaccgcgtgtgcattcccacggctgctcatgtgtgtttgcgtgcagcggtggggaagggtggcgtgcaggtgtgcctggagtcgcatccggctgcaggttacatgtgtctgtgtgtggcaggaggctgcgtgaatccacagggcacagctctggcgtgtttgcacatgtgtctgcgtgattgcatatgaggtgcatgtgtgtgcatgagtgtgtctgtgcgtggcacccgcgtttgcatgtgcgtgcccttgcacgggatgtctgcagtgtccgaggtccctgtgcgtgtctgcctgtggcatgcatgcgttttgtctgtgcgtggagtgcaggtgtgtgtgcgtgtctgcgtgtggggtgcatgtaagtgtgtctccctgggggcagtgctggctggctgagggcctgcaatgtgggggcagtggtggccccagcacggtccacaatggcaaccccgctgttggccctccctctcctcctcccctggggacgggaccagggcccgtgtgcagacggccatcaagcctcagagcagggtggacgcaggggcctgtggtccccgggagtccccaccttctgattggaaatctgcagccttgggggcactgggtgggcgcttgcccacactgggcatctctgggcttcggccaccctcccggggttccccacggacccagtggccctcgggtgtgggcagcagccgggttcccctcaaacactggatggaaaatggtgacctatgcaagggctcactccccgagggaggagccgtcccccagcagagggcagaggtgaacggggtgtctcgctccccgtggctccgctggcgtccctcggcctctcggggagccggctttgaagggggtgatgccgtgttctgctgcataagggttttttgttttgtttgagagaagctggtccactcggcattgggggcgctaggagagccgggcggtgggcctgggggattcggggcctgagggtggggtcctggaggccgtggggtacctggactcagactcgggagtctgggagacctgggcatgacgtcaggcaggtggcttagcagcctggaacccccaggcctgctctgcgaagtgggggtgacggagccctgcggtgggtgcggctcggccgatagggcctggtgtggatgggcaaaggcctgagggtggtcccaggggttagtgtcccctccccagaagggaaaccgaggcagctcctgcggtggggaggatgcttctgccgaggcaccatggtctctgtgtctcacggtctctttgggtctctgtcttccccatctctgggcatcctggggtgccatgggtggcccaggccttccgcctccactgcaggcctccctgggcggcctcagtttgcagagaagggaacagaggttccgtggcggggggccgtgaacgcagtgggatttgaccttcccccgtctctgggctgacgtctccgcaggtctgcaggggactggccctacgtgggtccctcggggtcacggcggaggcagtgggttgtgcattcatgggggtccgggtggtagcgtttctgtggagccggtggtctccttgtcatccatgagggtcctgccccggtggccgtgtgttccccgggacacggcttctctcctccccaggaaccgggatgcagccaggccttgcccctcagtcctgtgtgtgggaccagcctctcctgcagatgggtcctcagggagagctgggctttgtaccttgctgggggaagggctgagctgctcccgtccctgtgcccaccgtcccgtcgccccagacacgcggctggagcctgcggaggagcagacgagccggcggggtttttgctttaacctcaagcaggcgtttgaactctgtggccgagtcggtcctggtggggggctcgtgccacacctgctcccagaccaggctggtgtggggtctggccgagagactcagcggcgtgtccccccagctctgtgcgccccttgtccacctgccctgtgggtcaggggcccccaattcagggacagagcagccgaggccctgaaagacggtgactcacccaaggccacccggaagttgggcagagtccagggtgtcccacctggggccggcccgggggaagccagggacagccctgggaggggcaggaaggtgggtggccgacggcagctgcactctgtaccagggccacccacgcccacggtgacggaagcccaggtggggctgaccctgcccggcccatctttttcctattttgcttcatttctagggccctgcctcagtttaccctcctgcaccacaaggccatacttgtcctttcttgggcagaccttgcaccatcccggggactgatttcccttcaggtcccacccaggtcctgagcaggaggaaaagctccagtcctcagtcaggggggacatctcttccgtccctggaaaagccaggtgtgggtgctgtcaccccagcaggtcttgctgggggtggcaggaggggacgggcggcctcagccccacgctgggcttcaggacccgggctgcctgctcatccggccagcctgggcctccccgggagcttctccaccctggaagagagatgcagacgggtgcaggcgtccacctgcccacccacggggtcctggctgccggccacaccgctgcctcagtttccagtcctggaaggcagcccagcccacccccaccccagttttgggtgagattcctaattagtcgcttagctattagcgtctaataacttgacaattgcccgattggagctaattagctccaggccgcttgctggaagcgggtgacagccaggaggcccgggtgggcaggaggggagccctgctgggtgaggctctgcctggggcctggagggctgcctggaggcgtggactttggcacccgcaggttgagtgagtgtggggggaaggtgtggcccggcagagggaacccggaggagtaaaagctgccaccgctgctctgtctgggaaaaatcccaaatcagtcattaaccccttagtgagaatttcagtctctctgccgctccggggaggatttgcatatcgaggcttcatcactaatggaggaagcgaaggctttgtctgcctctccccaggtgcggttttggggtgggggccccctcccccctgcaggcgccaccctcaacaggggcaacgcgcccacctcgggcttgcccgccaacttggaaccgggaatgccaacacagcaaggccgctgctattttagagacgcaaagggaaaaatacggccccactccggcaggcagagccgggggtgggggttcccctgggacctgccctccaacacacacacctgtgggctgctccccacaactctggcattgcaaagtcctcgcctcttgacctttttaattcactcattattgagcaccactgtatgcagggcctgtgtagggccctggggaggggacagaggaggccaacatcaggatccgggattcagacagcaaaccctgtaaagagcagatgtgatatggggcggggcacagggaacagcactgcaggcagtgggaacagcagctgcagaggcccttggtgggaacagggacagccgggaggctggtgtggctggaagggaggagtcttggagagaggaggatgaggagggcgcagtggatgggccacacaggcctggaggggtgtggattttattctgaggatcaggaatggatggagggctctgagccgccgccaacgtgttacagggtctgttttgcagaagagcgaggcttgggatatggggaggctgggccccggcagaccctcaccgcagcctggaggggcccgggcacctggccgctcagccacacagaagcctcggtctctgacattttaccgaaggcagaacaggaggagagaacacagtggtgtcagacgtgggggaaggaggcaccattggggaaccaagaggccagagggggacctacagggctggtgctgtgggcactttcagaggctgctctgtctcaagaagtgtcctgctaggagccaggttctttttttgggttgaatgtggctccctggggatcactgccgggacaggaggggaaactgaggccagagggcagtggggagcccagacgcccctgtggtccctccacggaggcctcccctgcagggtgacctgggtgtgggcagtcccaggcgggagctgggccttggctaccatcgaccgcctgatcaatgggctttcacttgggctgggcaggaacgaaaatgacttttcaaaaaggctggagcagcttctgcatcgatcgtgcccaaggggccagcgggtcaatgagatgcctgtgcccggccggccaatggggcagcctgaggggtgggctgaggccgagcccatctccatctgagcctgtatgggggctgcccccgtgtctgtgcggacgcaccccgagtgtccaacagccgggaggaccatccatccccttgcacggaggggaaagggagcctctgagaggaggccggacctcgagacccaagggttcaaatccagacgcaagcccagaactgcaagattccgaagccccggaagggcccctgccctccaggcctggtgcccgggggagatttccctgcaacacgccctcccactgtcccctgtgctgggctcacaggggtgatgaaggaggcctgggaagctctctgtccctggacgaatccaaccaggtagggaagggctggagggtgacttcaccgcctccgccgccctgccttgaaattctttgctctggagatcttcatgccggatccctagtggggaaactgaggcgcaagtgagcacacctgtctgccccttctcacccctggagacccaggaacccccggccccgcctggcgtggcatctcagggtggcggggggccgggctgatgccatctgataatcccaccaccctctctctcgagctgctgtgccaattagtgcccccagtgtggggcctgcggcgggctcacccctgcaggccggggtggcggtggctgtgccgggctagaggcagtgccagggccgggatcgtagcagcctgcacccatgtgctgccaacactggtggggcctcagtttcccctgcctgtgcatggagggaggaggcaggagcggtgtgggggaccccccattcctccctgttcaggtcttttatgtgctaataagcccctctcagggcccccctcgtgccccgcttggtccaggccgccggttacatgacaggggccctggggaccacagccgggagatctaagggctcctgccgccatcgcccgaggcagtgagggaaggggagccgccggtcccttcctcggctgatctctatcctcacagacgaggctgggtcagggggctccctggaggaaggggcctgtgggttgcgtctgggggacctcagggcaaaggcctggaggcagggctgggggctgaggtgtcaggagtgcaggcacccaagagggagaccaggaggccgccggattccggggctcggggctcgggaggtttctgggttccagatgtgagagggtggtatggggctcgcagggtcacacaggaaggcaggggtggggctgggagtggagcccaggatgtctccgagctgggcggcaggtggaactcggcaggctgagagagagggggcggtgggcggaactctgggggtgctgagaggagggtggagggattcttcacgccaagctccgttctctttggggaaactgaggccagggtgggggcagagcttgccccagagcgagctggaatgcccgacctgtgtcccccacgctgccccggtccttctcaacaggtgggagtgcagaatgaaagcagggctgggggctgcctggaggaggcggcacagatgttaagcatgttaggtagatgcgaagtttctggagagggaattcttgtggagggacagctcgtgcagaggcccggagtcaggaaccccccgccggccctttgcacacaggggtccagatgtcacccacctggacacccacctcgctgctggccctgccgtggggctgttggggacactgaggcaggaggtggggggcagtgccaggcaagagatcgtgggctcccaaccttggaagcccgccgtgattggggtgtgcaaccccacctgctgaccgctatcaccattcagggcccaggcggagtccaccttgtgaactgacccctcccccattccccggcctgacttccccgtgcacctgtcccctgacccgtccctccccgctcaccctgtcccgtgccctgtgcacctgtccccggagccatctctccccgcgcacactgacccgtgccccatgcacctgtcccctgaccctgtcccccctggcgcaccctgacccgtcccccgtgctcctgaccccggccctcgccgcgcaccccgacccgtccctcgtgctcctgtcccctgaccctggccctccccgcgcaccccgacccgtgccccgttcctcgctccgggcgctgacctctggccgccttgtccccgcaggttccacgcaggcgcgggggacgacggcgggggctacacggtggaggtgagcatcaatgactacctggacatctactgcccgcactatggggcgccgctgccgccggccgagcgcatggagcactacgtgctgtacatggtcaacggcgagggccacgcctcctgcgaccaccgccagcgcggcttcaagcgctgggagtgcaaccggcccgcggcgcccggggggccgctcaagttctcggagaagttccagctcttcacgcccttctccctgggcttcgagttccggcccggccacgagtattactacatctgtgagtggggtcgggccggggctgccggggcccgagtgggcggggacgcgggggcggggccaggaagtgggcgggaccactggggtggggccggggagtgggcggggcagcgcagtgggcggggccgcggtgtggggccaggggggagtgggcggggccgcggaatggggccaggggggagtgggcggggccgcggagtggggccagggccggtgctggccactgacccacccaggtcactgaccccctccagatgtcaagtgcatgatggacgtgccattctcccaaccatcccgggaggccaggactttcctcgtccttcgttgcatatggggaaactgaggcttggagggggactgaggctgcactattgtgatctcgggcctccagctcagaccacttggtggttgggccagtagacctggctcagccccccgatagcgagaccagggtgcccgagccccagcacactgatgagggaaactgaggcatccggagcccagcaggggaggggagcttggtggaagccacagctaggctgagtgctggggcttactcctgcaatcccagcactttgggatgccgaggcgggaggatcacttgaggccagcgtggacaacgtagggagaccttctctctacaaaaacataaaaacaattagccaggtgtggtggcatgggcctgtggtcccagctgtgcagggggctgaggtgggagggctgcttggagtgcatgagctctggtcgctccactgcactccagcctgggtggcagagcgagaccctgtctttaaaagaagaaaaaaaccccacagggcccctgccgcaccagccgcacccagactgggtaggggtctccaggtcctccctgccccgcacccacccccgcatctccccgggacccatgccaggctcggagactccctgaggaccgtggggtcttcatctgaaggttgggtggcggcagccttggggatagtcacatctgcaggaccccatggtgggccaggctgggtgggccaggctgagggaggctgccagtccctgctgcttatcggaggtccgaagctggcctttttgtccctacgaaaggccaacggcaggtggggaacacagcagcgccagccggagtcccagtcctgcttggccatgatatctgtgaccttggcgggggaatgaggggccaggcactgcccacctgagatggggatgatggcatcacactcgtggcttccgccgtggcgctgagactgagggattctcgtggagtggggaccccggcttctcagcatctcggggcctgagggatggggagtcagggatctggggtctgtgcccccaggctgcaggggggccagtgcctggacacccagctcctgctgtgtgaaattaaactttacaaggccccattgcctcctttctctgctctagttggatttttcccttttaattcagggaagaagcgggtgggggacgggggaaggtgtttaaattaagtccccataatatgagaaaaattacatttttctttctgagacggcagtttcataaagataattattgtaattattcgtcctacctctgtgatgaatgttatttttattacatgctttttatcttcatcttccagtgtgaggggtttctagggggcgggcagaggtggtggccatgagagccaggccatcaggggcccagggcccggcagagacagcaagaccacatccatgtgtgcgtgcacatggacccacccctgttcgattgtccacacgtgtgcacaccccagcggccccggcttcaggcgtccttttcctcctctcttgatccttgcagacgcccccactgcactccaggatgcttctgggggcccgaaagcaggggcggtgatgctggaattttgggcgtaagaaccagttggaaataatctttcccagccaggcgtggcggtggctcacgcctgtaatcccagcactttgggaggccgaggcgggtggatcacctgaggtcaggagttcaagaccagcccggccaacatggtgaaaccccgtttctactaaaaatacaaaaattagccaggcatggtggcacacatttgtaatcctgtttacttgggaggctgaggcaggagaattgcttgaacccgggaggctgagattgcagtgagccgagatcgtaccattgcactccagcctgggcgacaagagcaaagctccatcacaaaaaaaaaaaaaaaaaaaaaaaaaagaatctttcccagagaatctactgtgttgccaggcgaggtccagagagggagcggcttgtccacaggctctcagaggcagagatttgaacccaggtcaatcatttcactattaatatatcacctctttgctgattgcttgaaaacaaatacatcattttccgagctcaccctgtgctgccctggggtgaggcagagcagaacaaaaacacagacacccccaggttctggggtcaggattggacagaaggaggagcagggggaatgtgcaggagactgctgggaaacagggggcattgtgtctggggctttgatgtacgattaggagttttaagggtggctctccacctggggtcagggttgattcaccaaggtggggaagggagtacagccccaggaggtctcaggcaccaagaggcacttccccactcatccccatcccctctcttctagctgccacgcctcccaatgctgtggaccggccctgcctgcgactgaaggtgtacgtgcggccgaccagtaagtgctcagggggatgggcaggatccaggcccccacccctgtgtcctaaacccacagaaccagtgagtgttcagaagagccaggacagggggcctcgggtttccctatcttgccctgccttgccccagcctcgatttccccgtctgatgaacatgtcagaccttcgagagtgaaggttagctgagcgcagtggctcacgcctataatcccagcacattgggatgctgaggtgggagaatcaattgagcccaggaggccgaggctgcagtgagcagagatcacgccactgcattccagcctgggtgacagagcaagactctgtctctaaaaaacaaagcaggccggttgggtggctcacgcctgtaatcccaactttgggagcctgaggcaggtggatcacctgaggtcaggagtttgagaccagcctggttaacatggcgaaaccccatctctactaaaaatacaaaatttagccgggcctggtggcgggctcctgtaatcccagctactcaggagactgaggcaggagaatcacttgaacccgggaagtggaggttgcagtgagcccagattgcgccactgctctccagtctgggtgatatagcaagactgcgtctaaaaaataaaataaaataaaaataaaaataaaaacagagtggccgggcacggtggctcacacctgtaatcccagcactttgggaggctgaggtgggtggaccccaaggtcaagagatggagaccgtcctggccaacatggtgaaaccccgtctctgctgaaaatacaaaattagccgggcgtggtggcacatgcctgtagtcccagctatttgggaggctgaagctggagaatcgcctgaacccgggaggcggaggttgcagtgagcccagattgcgccactgcacgccagcctggcgacggtgagactccgtctcaaaaaataaataaataaataaaaataaagcaaaaaaaaaaaaaaaaagattaaaagagtgaaggttgaattcaacagccaggtcccccacttcaggccaagtgactttgcccggagagtgggcatcggggatggcaccaagagggagcagagggcctgcctggtggggtgatgagcccgttgggcagatgtgcaccctgagggcgggcggcacgtggggagcccagtggggttcgggcggccgctgagcgtgctgtctctgccacccgcagacgagaccctgtacgaggctcctgagcccatcttcaccagcaataactcgtgtagcagcccgggcggctgccgcctcttcctcagcaccatccccgtgctctggaccctcctgggttcctagtcccagccccgcaggacgccgaccctgcctggacggccccgcctggaccgcctgacctcggccctccggacccggctgcggcccccgcctccgagaccaaatagagacgctgcttctccctcgcctggtgccgcccccgccgggcaggggccatccacccgccccaggaccagccctcagggaggggaaacggccgagagcccccccccggaggcccgaggggccggggtgtggatgcggaccgtggccaggccatctcctctggggcgtcggagaacccgggaacctcttggcgatttttttttttttttttttttttttttttttttttagtgtatttttcgtggttggatcaaaaagacttgagtttttaatttaatttattccctgccgttgtagcggggcggggtccctgtgccctggcctgggggaggggaacgcggaacatggggtcgggaacacagccgctcccctctgctctgcaccccactcgtgggggaacacagccgctcccctctgctctgcaccccactcgtgggggaacacagccgctcccctctgctctgcaccccactcgtgggggaacacagccgctcccctctgctctgcaccccactcgtgggggaacacagctgcagcccaccgcggacccccctggtgctccaggttgggtgagtctgagccggaaggggtacgtggtgggcgcccctcattgtggctggggagacctcataccccatcgcccacccccgtcctcctggtcatttcctcccagacactgttttgccccagcgcccttcggaatcacagtcccgccgtgtcttagaaactgctttggccgatgcaaacagccccctacccgtccccctcgcctcacacggtccctctccgaggccgagaagaccttctgttcctgtaaatacagccagcaagtgcaaactgtgattttattttccacgtattcctgaggacggactggaccgtctatgttttttcagcccttcatagggggtcttttattttggtgggggggtggggtggacttttagagtagaagctgcacttggcaataagctcgtgtcgtctgtcagagcccctctctcaactctgtgacctgataatgtttctaagaaaaagaaaaaaaggacaaaagggagggaaccactaccaaaaaaaaaaaagaaactcctccccgaagacactttaatgaaggaaacaacacatttatacggatttcatatttctacccgcctttcctgactctgtgttttatatatattatatataaatatatattgtgtacggccgccggccggcggctcgaggcacgcccggtggtggggggtgggcagagggcttttgtagggggtcggcggggcgggccgcgttgccaggcctggagctggcgaccgggcctccctcttcccgtcacaatcaactttggattctgtatttttttataataaaatgagcataaacctcaaacgcgtgtgtctgtatgtgggggccttgccctacttgaaggagacttttgcattcctaatttggcggtggatgctgggcgtggtggtttactcctgtgattgcagcactttgggaggccgaggcgggcagatcgcttgaggtcaggagtttgaaaccagtctggccaacatggtgaaaccccatctctactaaaaatatgaaaaaaaaaaaaaaaaaagccaggtgaggtggtgcacgcctgtcatcccagctactcgggaggctgaggcaggagaacctcttgaacccgggagttggaggttgcagtgagctgagatcgtgcctttgccctccagcctcggcaacagagcgaaactctgtctcaaaaaggaaaaaaaaaattagctcggcgtggtggtgcacaactgtagacccagctactcgggaggctgaggtgagaggatggcttgagcccggcaggtggaggctacagggagctatgatcacaccactgcactccagcttgggcaacaaagcaagaccctgcctcaaataatagtaatagtaataataataataataatttagaggtgggtctggaatctactggggagaggggtgcggcttcgaggaacctctggggatccccagagctgtgaacctgactgattctttggttctgtgcatcgttttggggtcagaccttgggatgagcattttatagggcccgtatccttcatagccatccatgggcttcagtttccctctctgggaagtagcaacagcccacctagggctgggagggggcagctgggagga

SEQ ID NO: 13345 - DNA, 25401 bp, Human
  misc_feature (1)...(25401): n = A,T,C or G
cacctcggccaccctgagtgctgggattacaggcgtgagctaccgtgcctggccggcctccaatcactcttatctcattgacctcactttcctccttttctcttatagatacattccacctccaccacacaacactcgtcccgcattggtattcctcaaacaagcgagatacatctgccttagggtatttgccctttctgttctctttgcttatcgagatatcaacatggctcatttttttgttttttttttcctccttcaggtctttgcccaaatgttaccttccaagacaggtcttctctgaccaccctacttaaaattgtactcctctcctctacactctggcacattatcccactttccttgcctgatttttttttccacaacacttattgccatttgacatactatgcattttgcttatttacatgtttattgtttgagaatgtaaactccatgacagcagggtatttttaattgtttactaatgtattcttgtgccaatacacagggcctagcacataaagaatgttcactaaatatttattgaatgaacgaatcccttggggcaaatactttgtagtcccctcaacgccttgcacactgccttgcatgcaatagaacactcagtaaatatttgatgaatggcctatgatggaagactactaatattctgccttgcagtttacttccttctccaagtattcctatatacatgggcctacattaaatttctgagcttgtaaaagtgcaaaaaaggtcagaaggagaagtcctccatggacactgctgaaaatagcagtaagacaaagacaggatgctgctttgagtattttctgcctttgccacttagataaatccctctcccacctccatctcagttttatcatatgtaaaacgactatatgatctctgaggtcccttctatttttacatttggtagttatgagcactatggtcacttttgattccagaattgtatgatttttatcttctcctaacccatgcttaaaatatgcttaatggaaacatggtgcaagaataaaggctcacttaggtccaattaacaagtatcgctataaaaataataaaacatggtgtaaaaggccacattagcaacatgtagctgatgacattgaggcttacatgaggcagacaggactaaaacccaggttttttcaaatcccttcagggctctttatctgaagtcccatagaacactatactttctttcctttccgagggctataaaagttagatctttattgtccagatagtttggaaaatccatcttccttcacttgtttcaacatacttggttccagcactagaaacaaaacaactttctcttgcagtgtctcttggatgattcaggtggcatgccttcagtcacttcccccatgtaaactgtcttgcaggcaaaggcgacactgcaattacaatgggcaagcaaactccttgcatgcacgtctgtgatgtaaaagtgttttaattcagccccatccttataaagagataaaaaatgtgttcagaaacatgcaaactcgtggctgtcatcctgataaacagattttcttaaaggaaactgtaaaccagagccagacttactttcctgcgctgagggaggggaaataaaaaagcaggcatggttgatttcccgctagcgggaacgatctggcctcagacgtcaccagcatccctccacccccagtccaacgtctcctgtccccaacagcctagctacagggggccgggctatgggttagtctcgcccccgttcatgctcttcacccaatacctgagagaatcggaaggaggcagagctacaccgaggaccaaaccccgcccttcgctccctcttagctaatcgttgccagcggggtgtggacttcgccgctgaccccacctccgccgctttgggtaatttagagccgcgcgccgggcgggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctggtaaggaccaagttgggaccctgactagacctcacctgcccaggcggcagagtataggagggatggggtcgccgcttgagctcaaacagactgggggttggggggagagggtgcagctctgtgactagcctaccccacgggctgtttccgttattttacctctcgcgggagggtcacgttcattcttaccgtgcggtggggtggagtcaaaagatggagtgtgaggcgaagcttctgcgtttgagggcaagggctgggggacccaatagatagtggctgcatagagcgacgagaggggaccgacgcttagccagggcggtagggacacgtggcttggctttgctgttgagccacccaggctggactgggttgcttcagctcttagactagcttgcatttagagagcctacctgcgtactgagctctcctggtctttcttttcctagagtccaataagcagctttttgattcgaaatggtgttggtccgttcggcttggtgttgagggaaactgacattatatactgcaggcgccaaaattattacgacttcccttagatcagcaagcgttggcttttctcatcttatgaatcatctacctgagtaattggagccataaatctagttgatttgttaaagtgatgcgttgactctgcatccttgatagccagcatctcagcttgagccatccaaaaaatcttggaaatctcaattctggaatgtttgaccttccccagtgcagctagtggtacagataatgcaaaagcgtatttttcagtaaccgagtccatcctggacttggctccttctttaagctctgtgtagggaatttaggaaacaattttatacctgaatgttaaagataattgaggacaggcaatgtagtggaagactaggattggacagtgcattgcaacttgcgttttttccattgccttgccagtaaaacttgcttcctcgactccgacttacaccctctaccggcaccatgggactgttttagagatgacttggttacctgattatttcagtgccccttccacctaagtgtgggatctttagtttctgataggtgtaatttgtattttattgttaccctatcgattaaatcagagccctgcccacaatcttacagatttgttaaggggaaagttttcacctaataatcagataagaatatttcgaatattttttcctaaatgtttttgcttacttttttgctttctttggactgatttccaagtttaactcgccttatctcttttagacccagctgataaagtaatgtcaccgataatggacagcttcttcccgaattattgtgctactgattgtgatgcaaatgatagtgtaaacattgccatctgtaaccaggcaataccttagttaaaagaggcttacaaactgctgtctttagatttttccaaaccattatggctcatgggccttaataaagaatacaaaacaggactagactttgtgattggcaatatagttaggggacaagaatgtttttcatttagaggttttctttggcccctgtggatatttaatccttttcctatgcgtctaggaaaaatgtgaaggcatgaaagctttattttctccttgtgttaatccttctgccctctgcataatgcagcaccccagaacctgaggctatattgggagaggagagggggaggacaacttagttttctactgattgatttctattaagtccaacatggataattgctgactggttagattttcttgtttctggcttaatcattagcttcttgtttcctagatattctgaaatcttcattgaacataatcacatttttttttatggagttccccctatctttgtttttcctatactgaagaaatggtaactgctccctataactgctcccccaggtgactcttggttgatgctctcttgagcagagtagcttttcttctaacataaggatcatccttggctgtctggttatttaggaaacacacacacacacacacacacacacacacacacacggagggggtgggtgttaaaagtgctgaaatcagagaacttggatctgaatccttaacctttctttgccccaataatctaatctgtaaagtagtacctacccatactgttgttatgaggattaaatgagatagaagtaaagttcttaggatcttgtccaaaacataataagtacaacagtaaatgttgacaagaaggggtggtgataatattgcagaaaatgtggaaaatttagaacacggaagggagaagatatgcctcttaattctgccacctgacataaatgtcacattatcatttctgacctcccagatatttgtgtaagatacactttttcaagaatgtttaatacatttatagctctcttcacttagcaatatattttgaacagtttctccctttaatatttagtatatatgattttctttttttattattaaagattttaatttattttttagagatgaggtctcactatgttgcccaggctggagtccaatagctactcacaggcacaatcatagcacactgcatcctcaaactcgcgggctcaagtgatctgcctgcctctgcctctcaagtagttgagaatacaggcatgcaccactgaggtgggctagttcatgtaattttaaatagctatatagtcttaccttatggttatgccataattttatataaccaaattcttattggacatttccagtttttgatctaatgcttttatatgaaaatccatgaacataaatctttgaccatttctgattatttccttagaataaatccctaggaaggtaattattaagttaaagggtagataccatttttcaggcttttgatacctgttgccaaattattccccagaaaagttgaacaaatctgtctcatcagcagtaatacaatattaataatatttatttatgtatttattttttgagacggagtttcactcttactgcccaggagtgcagtggtgcgatctcagctcactgcaacctccgccacccaggttcaagcagttctcctgcctcagcctcccgagtagctgggattacaggcacgtgccaccacgcccagctaatattttgtatttttagtagagacagggtttcaccatgttggccaggctggtttcaaactcctgacctcaggtgatcccccacaccttggcctcccaaagtgctgggattataggtgtgagctaccgtgcccggctataatatttaatgtatagtgaatgcctaagatgtgctagtttccatgctaagcatttagtatacattgtgtttaatcccctcaaaactgctatgaggaataactcttactatccctattttacagagaagagaactacagtaagatgcagagtaacttgcccagctctgggtattattgttcctttaaatttttgctgacaagatctctcacctggctttaaaaacttagatattctaaaattttgactctattctcttcaatatttgtaaataactttggtttatttggttattctgtactagctgagaggaggaagacttgaactttggttgcctagggttttcctgagaactgtatcttctggttgtggttagttaatcccatgtattttgcacatgccaatatctccataatctaaattcttcagattttcttaagactactatccaccttttagattcacttttggtgtttcctgacattccatttcaattggatacacttatgcctgaccttaaaggaaagggaaaagagaagctagttttttcactcattggatagacatagccagtcttctggcctcaccaaaacagctgagagaatgattggcccaaagccatttggagaacactccattaactagagggagagaacaaggagtattactctctaaattgctgaattaggtttttccacttaatagattatgttaggagcaaacaggttttaggcacaaatattcttctcgatcactgccataacttagaagaagccataagaataaggttaagatttttagaggacttgttgaaccaagctgtataatcagagtgcaattcacggactttttaagactttgtcaaacaaagtctgtatgttatagtactactatagggaaagattggttttaataagtgaaattagaattatacacattaaaacaaggcagtatcacctagtttacttgcaccaccttattttatttatgtatttgctttctaagtttctctacttttatttcatttttgtaagatcttttcaaaagccccacattttttaaacagttaaataaccttttcaagttattagatacatgccttataacaaacaccttctatgctgaaggtagcttttaattttaaaaagtttgagccgggtgcggtggctcacgtctgtaatcccagcactttgggaggccgaggcgggtggatcacgaggtcaggagatcgagaccatcctggctaacacggtgaaaccctgtctctactaaaaatacaaaaaattagctgggcatggtggcagacgcctgtagtcccagctactcgggaggctgagacaggagaatggtgtgaacccaggaggcggagcttgcagtgagctgagatcctgccactgcactccagcctgggcaacagagcgagactccatctcaaaaaaaaaaaaaaaaaaaagtttggctttgagaaatagctgagctgttgattgattattaagtgatataataacaaaaatggtactagcgactgtattgggtggtaagctgataagtgatttttatttatttttattttttgtttgataagtgatttataaaaaattattattcaagccttatgtgatgttagaatatgtatattttaaaaataatcaccttggctgggtgcggtggctcacacctgtaattccagcactttgggaggccaaggcaggcggatcacctgaggtcaggagtttgagaccagcctggccaatgtggcaaaaccccatctctactaaaaatacaaaaattagccaggcgtggtggcacacacctgtagtcccagctacttgggtggctgaggcaggagaatcacttgaacctgggaggcagaggttgcagtgagcagagatcacaccattgcactccagcctgggtgacagagtgagattccgtctcaaaaaaaataaatacaatttaaaaaataaaataatcaactctattaaagctatatatttatcagatgccctttgatgttttaattagcagtgataatttaatttttaaatagtatctcacctgctttcaagaaaggatttgaagtatgtttgatagtcactagtacaaaccgtttgttaaggtaggtatcagaagccttatagaaccatggactacagtaattgtggcaactatttggcataaaacaatttctaaagtttagtgttactttttattttatttatgtatttatttatttatttttttgagatggagtctagctctgtctcccaggctggagtgcagtggcgcgatctcggttcactgcaagctctgtctctcgggttcacgccattctcctgcctcagcctcccgagtagctgggactataagcgcccaccaccacgcccagctaatggctaattttttttttttttttgtatttttagtagagacggggtttcaccatgttagccaggatggtctcgatctcctgacctcaggtgatctgcccacctcggcctcctaaagtgctgggattacaggcgtgagccaccgccccagcctagtgttacatttttttaactgtatcccttggcttcctgacagccagagggataaaggcatatgcaatcgattatgtggtttttattttcataaagttatttagaaacttccaggcaaaaaatcctaagaattttatgggtgagacctctaaatagtgatatcgagtaacatcatggacaatataacaattttgtgggtattttttatattgactgatagttgaggcatttgtaaagggagataagccactgtggtctaagaatgttgttttctggtcttacttgataatgataaagttttttgttttttttttttttgagacagagtctcgctctctcgctctgtctcccaggctggagtgcaatgacttgatctcggttcactgcaagctctgcctcccaggttcacgccattcccctgcctcagcctcccgagtagctgggactacaggcgcccgccaccacacctggctaatttttttgtattttttagtagagacggggtttcaccgtgttagccaggatggtctcgatcacctgacctcgtgatccgcccgcctcggcctcccaaagtgctgggattacaggcgtgagccaccgtgcccagcgataatgataaagttttaaaaacatagcagaatagcttgtcccttatactgtctgatatcaattgtcaaactacatttgttcatttgttctccaacttttaatcaaacatcctgactctggcaagtgaatgtctggagcacagatgatactctgtgttcttgactgaaacaagagccataggcttctgatacatgattggaaatcaatatgcctgcctgactttcattctcctccagggaaatgcatattttggtcaaggagctgatatatggaggatgaatgtgagcagcattaaaattttctgattttttttttttttgagacagtgtctcactctgtcacccaggctggagtgcagtggcatgatcatggctcctaactcctgggctgaagcaatcctcccacctcagtctccccagtagctgcaatcacaggcacttgccaccatgcctaatttttaaattgttttgtagagaggaggtctctttatgttacccaggctggtctcaaactcttgggctcaagcggtcctcctgcctctgcctcccaaccacagacttgtttaacataaaacctaaaagtgactcttttagcttgaaatctctcgaagggcagagctagtagtaaagaaagatctgggccagacatggtggctcacacctgtaatcccagcactttgggaggtcaaggcgggcagatcacgaggtcaagagatcgagaccatcctggccaacatggtgaaaccccatctctactaaaaatacaaaaaattagctgggcgtggtggcgtgcggctgtagttccagctactcgggaggctgaggcaggagaatcacttgaacccgggaggtggaggtcgcagtgagccaagatcgtgccactgcactccagcctggcgacagagcgagactgtctcaaaaaaaaaaaaaaaaaaaaactgaaaacgtcccaaaagtcccttgaaatgaccactgcctgtttgttttgttttgtttggtttgagacggagtcccgctctgtcacccaggctggagtgcagcggcttcatctccccatactgcaacctccgcctcccaggttcaagcgattctcctgcctcagccccctgagtagctgggactacagatgcatgtccccacgcctaatttttgtgttttttggtagagacggggtttcgccatgttgccaaggttggtcttgaaatggggagctcaggcagtctgcctgccttggcctcccaaagtgctgggattacaggcatgagccactgcgtccagtcttaaaaaaggtttatcctaaactagtgcattttcttttttgttctggctgccaggaatctcagcttccttgattttaattggtttctagtttgattttttttcacttgcttttatttttcttgctttacaacataaactaaccccatttgtcttttcttgcttttgagatgagggtcttcctgtgttgtccaggctagacttgaactcctgggctcaagcagtcctcctgcttcagcctcctgagtagctgggattacaggtgtgtgccaccactcccagctccctttcatcttgggttagaaaggaataaataagtaattatctcctatgtcagcttcttctggcaatagaattgcctctgccagttttcatataagtcccttttggagttctccttgaagttttgtttggggagagaagggtgggtaaaagtgatcttgacagaaataggacagtaggtagttcctgaagccacacagaagatagtgcttagagtgagatagaagtatggatcttttatttaataactctattgccttttgatttgaactgaagttttctcttgttcaataggtattgtcagccattctgatctacttgtctatatacacacatacacctctccttcacctagaggattagttggaatataatgttgtttgaggtatcactaaggtgatttttaaaaatttttaaattattttcttttttttttcttaaacctggtgaacaggagaggtgatttttttttcttggtagagacccgagtatgggcactgaaactttcgtggtaaaatatagccctacttcatacttagagtaaattcctatggagttacttagtaattggaccagagtacagttaacacagaatgagggcaaggaccacattttattcaccattgtttccctagcatctagtacagtgatgagcatatgaacatttaatatttactgggtaaattgccagtatggtagaggtggtactgtcttttgttaaagtgtcattatagaacagtagtgattcactccttatgatatttctacttcttttgctatttatggactctgtaacagtaataggtgatgcatcaaattttatgtacatcacatgtacctatatgaaatgagatacaggccacctgctaaaattatggtccggttatttgtaagtactttagactaacatgtgccaaccatttcatgcatctttttcgtgtctgtcacatggtaatattagaaaatattaccatagaaaatggtaatatttgtatagtgcactggagtaaactgaggcagtgaactgcttctggtataaggctccttcagaggatctcctgaagcctaggtgatcaatatccacatgtagctgtaaccattcacagcatactagtagggaagctgttcttagaccttattgtctatagaagtatagtaaagtcatccctcagtatccacaggggattggtcccaagaccaaatctgcagatatgaaatagtgtaatataaatatatatatatatatatatatttttttgatatggagtcttgctctgtcacccaggctagagtgcagaggcacgatctctgctcactgtaatctctgcctcccggttcaagcaatttttctgcctcagcctcctgagtagctgggactacaggtacctgccaccacactcagctaattttttttttttatttttatttgagacggagtctcactctgttgcccaggctggagcgcagtagcgtgatcttggctcaccgcaacctgtgcctcccgggttcaagtgattctcctgcctcaacctcccgagtagctgggactacaggcgtgtgccaccatgcacggctgatttttatactttagtagagatgggttttcactgtgttggccaggctggtcttaaactcctgacctcaggtgatccacccatcttggcctcctaaagtgctgggattacaggtgtgagccaccacaccctgactaatttttttatttttagtagaaacgggtttcaccatgttgactaggctggtcttgaactcctgacctcaggtgatccgcccacctcagcctcccaaagtgctgggattataggcgtgagccatcacgcccggccatatgaaataatctatgcacatgttcccttatactttattgttatttatttattttttgtagagatggggtctcactgtattacccaggctggttttgaactcctgggctcaaatgatcctccttctaccctgccccctgctccccaaagtgctgagccaccatgccaggccctcccatatattttattttattttattttatttttgacacagagtctcactctgttgcccaggctggagtgcagtggtgtgatcttagctcactgcaacctccgcctcctgagttccagcgattctcgtgcctcagcctcctgagtaggtgggactacaggcgcctgccaccatgcccttctaatttttgtatttttagtagagatacatggtttcgccatgttggccaggctggtctcgaactcctgacttcaagtgatccacccaccttggcctgccaaagtgctgggattataggcatgagccactgcgcccagccctgccatatactttaaatcatctctagattacttataatacttaatacaatataaatactacgtaaatagttgttatactgtatttagaaaataatgacaaagaaaaaaatctgtacatgttcaatacaggtgcaattttttctccaaatattttcaatccacacttggttgaatccatagatgtggaacctatggatatggagggctgacagtacagtggtttaaaatctatttcatgttctttctttcctcattgtagtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataaggtaggagcagaattttattttttgagcagaggaagcaggagcacttgccccaaatcacaaataaattccaaaattatcaaatatatatttagggggaattttaaaaatcaccttttcttaggtattaccctatcttcaaaacaatagaaatataattggtttgtataaagcaacacatttgtagtctgtattttattacagtgatacatatataactttcagttagctcactggtatttttaattgtatcagtaagactaagcaccaactcctctggagtactggagtatatttttaaaattacggtagatcctctcaaactgtaagattgggatcctagttgtgacctcttcataaaacttgaagtctgttatatgaatacttgatctgatagatacatagatagatagatagatagataaactatatatatctctcannnnnnnnnnnnnnnnnnnnctcaggagttttgagaccagcctgggcaacgctgtgaaactccgtctctactaaaatacaaaagaaattatccaggcgtggcgctgcgcgcctgtagtcccagctactcgggaggcagaggcaggagaattgcttgaacccaggcaggcagaggttgcagtgagctgagatcatgccactgcactccagcctgggcgatagagcaagactctgtctctacaaaaaaaaaaaaaaaaaaaaaggcatgcatggactttgctattttacagtgcagcaagtatgttttatttgaggagttcatagttgttggaaagttgacctccagatgagtaagtagtgatgtgatttacaaaggaaactataatatctattctgtgatgtatcttcaaaccttgacatgttaggtgttaaaggtttacatatgtatgtgttgaaagagattttaataaaattattttttaaagtctgcctagtttgaataattgagcattggaaacacttgaataggattgaaaatgtgtacattaagaaaacaaaagttaggaaagcattttctttattgataagtgtatcctgatttggaaaagtgatgttccacttaatatttgttctgaattatgatccacttaaagtcaatggacatgtctccttctatgaatttctgggtaccatagtgcctttaacatagtaggtacacaataaatagtttcttgagtaaatgaattgtttttcaaattggctttttggtttttcttttctttcctcccctccatttagagccgggcgccaatctcagccaagcttgttgcaaatatgctatctgtagcaggtgcagatcatattatcaccatggacctacatgcttctcaaattcaggtatcagtggaagctaaatattggtgtttgaaaggtgggaggaaaggactgatgatgctgaagactgcagagaagccaaaaattatgcccaagtacatctgaaataaactagatatcaacaacattttaaatgtgttcaccttaagcatacttcatgatcttagtcatttcaggtggttagatagggaggcagtctagttttatgggaagagcactactttgaataaaggctctggtatttactagctttgtaagcttgggaaggttacttaatttctctgaacatatactttttcattattgtgagtataaaacattaaattcatattataatgcctggcccatgacaggtactcatagataggagctgttattatcattcttattctccttgaatattcatggagtgcagtggcacgatcttggctcactgcaacctctgcctcctcagttcaagcagttctcctgcctcggcctcccaagtagctgggattacaggcacctgacaccaggcccagctaacttttttgtacttttagttgagatggggtttcaccatgttggccaggctggtctcgaactcctgacctcaagtgatctgcctgctgcagcctcccaaagtgctgcgattacaagcatgagccaccgtgcctggcctcatggtcttaaatttagagccacagatattggagcctactttccaacataaacccaaagtaaggggggtggaataccacctttattttatattttttcaaagagatttttcaaatcattacatttcaagcttgtgggaattcaatgaagtacattggacagggactgtactccttttatggaaaggaatgacttaattgagaaatacaactaatttgtatcaactagaattagaacacagatctcctgatttctaattattcactgtgactatttatcataagtagcttccattaagtttatatgccatagcatctctaactggtttatccattagcttttactccttaacaaatcagtccaacacttagtggcataaagcagtatttacaaactcactgagtctgcatgttgactgggcagttcttaatggttttgtctgaacttagccattctttacaagggctcacttatgttcctatgttcagttgtgggttgactgagggctggctttgctgatcttggctgggctctctcacatagcccagattcaaggaggcttttataatctaccacactgggcctgccttcccatcagtttgaatgttgcagtaagacattctctgagcaagttactactttgtgtttgccatttataaatggaagagaaggaaagtgaagcaaaactgatccagcttctttctacagggcttttttgatatcccagtagacaatttgtatgcagagccggctgtcctaaagtggataagggagaatatctctgagtggaggaactgcactattgtctcacctgatgctggtggagctaagaggtatggttgaaattagtattgttcccaatgtactgggaaaatctttcagatggttgtgtcacaaagtgaagtttttctatccaagtggcagtttttaagtatttttgaatggatgtaagtagctagcacatgggttgaatatagttttaccctttcctcttttactgtcctcagttactactcggaagacaagacagaaaaggggtcctaaatcatcatattatggatttgactataacttatgagtaacttggtgctacagagctagcaatacagctataaaccttttgggaagggtagaaaatgtggttttctaatgaatagcagctgctattgaaccacatattggtggacaaattcgcttttacactcctcttacaatgctgttggttagatcattttgatccttgggattaaaatattaagcaggaaggaaagtaaagtgtgacatttttatttaaagccaagatcttaacattttaaacaaactgattgccagggattgccagttaacagtgctttgcagctcacatggtgcagactaagagctcttgatttccttagtggattactcgttagtaatgcattcaaaagtgtgacacatgttcttcttgttgtggaaatagaatgaagagctacaaaacacagatgattaggaagagctaattcagaactttctaaaagccattcaaatcttcaatgactgtttctcaacaacctcttttatttcagtaacttcaacagaactgataagctgagaacttgagttatgttatccagccagatatatgggttggtgagtcccatgtaattgctagttaccatctgtaatgctagagacagcctaagaaacatccccccaactagtagttgtcatatttaatttgtcggtcattattttaatatctttctgtgggacttagaaaatagtcacatttgaaataggcaggattttctttccaaaggtgggtataggaaaactgcctttagtagacaacttattgctacctgatttttttttcattatcattgtcttatagtgatggagtattttacaattgagtgtctatcacttctgtgttggcagggtttggggagtaggtagagatccctgtgtgatattcatttgtacagtagttctctcctcaaaaggtgtagagagttactttttctagccctttttatgctttgttggtcactgaatttgttggcctttgagtatggttggtttgggatacttgaactaattgatcatgcatttgccttgggtaagtaatcattccaagcgaattggttaccactgatgttatgtgcttatgcagtagtagtaatggagagtacagggtatggttggtttagatcaaggtacaaatgttacctagattatggttcaaaccttattatgtggtcacaggttctcacttatccagcaaaaactcatgtgaccatagtcacaagagaaacaggacaaaatgctatagtttgttcagttctacattaaaaaacaggacaaatccccaagcacgggctgcttcacacatgacggagatggcacagcggagcatggacagacgtgccactggggcagctcactgtcatttacactgaatagatttttgtttgaattatgtggtactttgtcaaaagacaaatttgtcttctatcctaccttctagtctggtttattttctcttgtaataagaaaaataagaattctctttgattggaagatactttggaccgaatggtgagatgcctagcttgtctgggtaattgatataactttctgtctagcaattgtgaaaaaaactcccaagcttggtgtccaggtacagttgacagtgacagttgatggatgttttgccaacagcactgagggaagtgatgaggacacaggcattggaacaggctggatgctgctcctctcctgccagtcaggttctcttctcaccacatccccattcacgggtcttccatgatgggaattgggacagtctgtgtactcctggcattagttaattctttcctcattccttctgctgccaatccattaaataaacttgcgtgtcttagcgttatactgcttcccagtactggtgagggtgtctgtcctctacccagaatgaatactcatctaagtttgatcagtacgttcataagcttctgttgagctatggaggcactggtttataaaacccagtttgtgatatttgcctttgagaagtcaatgatagttgctttcattcttccagccctgggaactattggtttcaaggagtattctcctccccaaaacaagcccattctttagtccatttctttttttcttttttttttgttttgagacagagtctcgctctgtcacccaggctggagtgcagtggcgcgatctcagctcactgcaagctccagctcctgggttcacgccattttcctgcctcagcctcccgagtagctgggactacaggcgcccgccaccatgcccagctaattttttgtatttttagtaaagatggggtttcactgtgttagccaggatggtctctatctcctgaccttgtgatccgcccacctcagcctcccaaagtgctgggattacaggcgtgagccaccgcccccggcctctttagtccatttcttttgtcttagaagccacacatacatatgaacacgctctgttttgcagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaagtaagtgtggattgatggggctggtagttagaaggaaaaagctagcaattgctgtctgaatgtcttcagcctgctgattccttttggaaccaaattgaggggataagtaactttgtgagatttttatcacccaaggcttaaattataatacatagaaattgttgagtactcttatttttttttcagattttcttattttttaaatttatattgtactaagctacatataacacaatttgccattttaactattttaagtgtataattccatgacattaactatattcacaatgttagacaaccatcgcctgatcatcaaagttttttgatcaccctgagtatgctacatgcgattgttttttgttttaatgagttaaaataaaaatcctgagcagacaggtgtgtgtgctcatatttttattttacctaagccggaacccttggtcttacttctcgactgttttaccggctgctacttttgttcattattacttctttttttcactctaatcctgtgataggttaatgtttatattacttgtcatctcttgcctgcagtgttctaaattgcctccccactctgttctccattgccagtcaccgttctctcacctccccactccatctctccatgcttgctaatcttcctgcaactgaggctcgatcccatcactctttaagattttaagtggcccctcattactaacaatccaagccactatgagcagcattgtttcttagaatggtatttttacttttatttttattttgagacatggtctcactctgttacccaggctggagtgtagtagtacaattacggctcactgcagtcttgaaatcttgggctcaagaaatcctcctgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaatagccagaattaagccacatggccacactgaactatgtgagggaggctgggaaatgtagttcagctatgtgcccagaaagaagaggaagtggattttgttaagtgcaacagtctatgccagagtcctttgacactaattcagacctattcagataagttcttagtgcagttctttctcgatatggactgaattgtgtcctccccaaattcatatatgttgaggcctaaccccaatgtgatggtatttggagttaccttgaggggcacgtatttaggattagatgaggtcactagggcagagcccttacaatgggatgaatgcccttataagaagagaatgctggagaactggccagcatttccccatgcgcacgcatgcgtgcacacacactcacactcacacacaaagaggtcatctgagcacacagcaaagtggtggccacctacaagagaagaggcctcagcatgacacctactttgtctgcaccttgatcttggactttaagcctccagaactgtgaaaaatttgtttctgttatttaagccacccattctatggtattttcttttccttaaaaaaatttttcccctaacccactgtgccttataatattttttatttttttattttttttcatatgatattttgttgtggaagcctaagcaggctaatatactcctccctgactaaaattctgcaatgacaagtaagatgaatccaaatcaacattttttccctctagacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgaggatgagatttgtgcaaaacaagacttttctaagtgtttaggaggtggttacttacgttgaattaggtctctggattctgaagatatctttctttggtctgaaggatttagtcttgtcatcagaatttgtgatccaaaagttaacaatcacctgtttcttttcctttttttttttcttttcaaactgccaagccttgggaaaatcacctgtttaaaagtttaaattgctacacctcagaatctctggaagatggagcctaagattctacattttaacaggttctcccagtgattctgatgcaaattaaagttttcaagtccatactttacagtatgtgtttgtctgttaactatcggcccctgtagatataatgtgaaacctttaaactgattgtacacttctaccaactttagtgtttctcagtgtgctctggacctaaggttcttattaaaatgtagattcctttgctccatctaagacctataaaaccagaggtcctggaaccagtattttaaagtaattccccaagtaattgttagaaactaaagtttgagtgctcttgcactaaaagaacaaggccttgcttaattaaaaatgttcacattaatctatgagctttttgaaattaatatgtgtaattggaggattatcatcttttttttttttttttttgagataggatcttgctctgttgccccagccggagtgcgcaatcaaagctcactgcagcctcaactttgaaggctcaggcaatcatcctgtctcagcctcccaagtggctggcgtgcaccaccatgcccagctaatttttttgatattatgtgtagagacggggtctccctatgttgcccaggctggtctcaaactcctagcctcaagctatcctcctgtgtcagcctcccaaagtgctgagattacaggtgatgtcattcttaaggattttttttcaacttagtcttttttttttccttcataaggtttttttgtttgtttgttttttgtttttgagatggagttttgctcttgttgcctaggctggagtgcaatggcacgatctcagctcaccgcaacctcagcctcccaggttcaagtgagtctcctgcctcagcctcccaagtagctgggattacaggcatgtgccaccacgcctgactaattttttatttttagtagagatggggtttctccatgttgctcaggctggtcttgaactcctgacctcaggtgatccgtccacctcggcctcccaaactgctgggattacaggcatgagccaccacgcccagcctattcagaaggatttttaaatgcgaacctaccaccatttttttttagacagggtctcactctgttgcctaagctggagtgcagtggcctgatcttgactcactgcagcctcaaactcccaggctcaagcgatcctcctgccttagcctcacaagtagctgggactacaggcatacaccacaaccacgcctggctaatttttgttttattgtagagacagagtttcaccatattgcccaggctggactcaaactcctgggctcaagtgatcctcccaccttggcctcccaaagtgctgggattacaggtgtgagccacagtgcccagccattttgatgaaccaaagtcagcgttttttctcagttagcattttgactctttcctaagtggctgttttgttttgttttgttgttttgagacagagtctcgctctgtcacccaggctggagtgcagtggcacgatcttggctcaccgcaacctccacctcccaggttcaagcaattctcatgcctcagcctcccgagtagctgggattacaggcgtgtgccacaccatgcttggttaatttttgtatttttagtagagacggggtttcatcatgttggccagcctggtctccaactcctggcctcaagtgatctgcccaccttggcctcccaaagtgcagggattaacaggtgtgagccaccgtgcccagccgtaagtggctatcttaaaaatgttatgaagaatagctgagtgcagcctcatgacagggaaacagcacagtgttgcagttttaagaggaagggcacttgcctggctgctcatcagtgtctgcaaattggccagtcatctctgaccatatgatagtaacctgatttcctttcttgcctttctaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttatttgttgagaacaactagcaacaaaggcaacccatgnnnnnnnnnnnnnnnnnnnntcgatttggctttaccttcatctatcttgatcctttcctggccaaatatcctcttgggcccaaatgaacattgtaccatagtcttctggaaagcaaacatgcttcctgctatgtaattgctaacattcatattagatgatgtgctgtagcttgatcttccttagcctactgccactgaggcagtaggttttaggtggtatcgtagtgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtgatttggggtctgtatcatacataatctgtactgatctctctgctaaaggtttggtttagatagatgtcttgctgtccattgatagctcttatttgtttccaaactacgttagcttcattgttaaaccaagagaagacattggcagcagttttattcaactgtaagactaagatgtctggagtttactgagaatgtgataagagtgtaattctgtgcagtatacctaaattatagcatgtataatgtctggtggatctctggttcttactcctgaagatccaaattaggtattttcttatgggaggagaatttctgtgatttattcattttgaactaattttgccaaatgtgataatttccttccattcatcagtaattgacatacgtttggcatttactttctttgttttttttgattttttggtttttttttgagatggagtttcgctcttgttgcccaggctggagtgcaatggtgcaatcttggctcactgcaacctccgcctcccgggttcaagcaattctcctgctcagcctcctgagtagctagaatttataggcatgtgccaccatgcccagctaattttatatttttagtagagacagggtttcaccatgttggtcaggctggtcttgaactcctgacctcaggtgatctgcccgcctcagcctcccaaagtgctgggattacaggtgtgagccactggtgcccggctgggcatttactttcatccctgctaaataagaactattttgagaaggtaaatgtgcaaaatttaaggatgaattattatgcattccaaaattttaagtttccttctttctttccttttttttctctttctttctttccctttagctctctctttcttcatttctttcttttctttccttccttctctttctctctctgtctgtctgtctgtctttctttctgtctttcatctttctcttgctctgtcacccaggctggagtgcagtggctcgatcttggctcactgcaacctccacctcctggattcaagtgattctcctgcctcagcctcgagagggattacaggttatctgggattacaggtgtgcaccatcacacctagctaatttttgtatttttagtagagacagggttttgccatgttgctcagtctggtctcaaactcctggcctcaagtgatccgcccaccttggcctcacagagtgctcggattacaggcatgagccaccatggcggccttaagtgagtgagtttcttggcccatcatcaaataagggtgctcttttactttgggaagctacatggctacagagcttcatgaagagtgcttccttatttgtgaagcccaggtctacttttgtttattttgtttttgcttttgttggatatcgggatatctattttacagctagctctttgataaaagtgattcaggagggactaaagtatactatgaaatgtgcgcctctaa

SEQ ID NO: 13346 - DNA, 5802 bp, Human
  misc_feature (1)...(5802): n = A,T,C or G
ggactgcagagagataggaggtgccagacggcagggacttcaaggcagaattgaaatctgctgaacagcaggcgtcggtcagctgggacagccggaaagctcgggatcaggaggcggtcaagctgagctctgctctcattccgccgcgtgaccttgggcaagtcccttcccttctacaggaggctggactagatgtcctccttgtacagcgttgcggggaaggtgagacagtgccaccaacacagcagggcattgctgggtcggggggatggggcaggaaacgcttcaaggatcaggcaggattttcctcccaccaggaaaagccggcgcgggtctaaggccggaggagggacccagacataggagtcaccttctaaggggcttcctggagcacattttcctgcccagcaacaggcggcagcattctctccccactaatcctctccaaacagcagtgagagagaatgcctgccgcttcaagccaggtcgcaacccctcggtgacccgctgcgcccgaggaggggccggcggtgcgcggtggtggcggcgggcgcggcagctgtgcccgtctgcccaagggttaatccgtcccctgcagctgccgcgcgtgccttgcagaatttcaccagaagagggtacagtttgaaaagctcctgacgtcaggctggaattcctattgtgtttagaaaaggctcgggcaaagcagcccaagttcgctctctgcacacctcgagcacctcgcggacggcgtgggtccgccagctccgggacctgccgccgctgcctgcgcgccccggggcagcgacggtgccagcgcccactaggagaccccgctcccgcagagtgccgagctgaagcgccggagccccgctagaccagcccggggtgagtgccccggcgtaggcgtcggcgccaatagcccccgcggctcgccgggctgcccgatgccagcaccgagcccgccgctggtgcatgcatcctcgcggcggcccctgcagctgctggcgctgtgacgcacttcccgcagctgcgctggcagctctgccgagatagcgacgtgtgcaccgtggagtcaagcgtacgcggcgctggtcagagggtctggcgaggctggatggagcccgggaagatgactgtcgggtagcgagctccggagcgggagctagagttcgtgtaggacgaatagaatactattacgtgagggcgtcgcatgtgtgtannnnnnnnnnnnnnnnnnnnccagcaacaggcggcagcattctctccccactaatcctctccaaacagcagtgagagagaatgcctgccgcttcaagccaggtcgcaacccctcggtgacccgctgcgcccgaggaggggccggcggtgcgcggtggtggcggcgggcgcggcagctgtgcccgtctgcccaagggttaatccgtcccctgcagctgccgcgcgtgccttgcagaatttcaccagaagagggtacagtttgaaaagctcctgacgtcaggctggaattcctattgtgtttagaaaaggctcgggcaaagccagcccaagttcgctctctgcacacctcgagcacctcgcggacggcgtgggtccgccagctccgggacctgccgccgctgcctgcgcgccccggggcggaggacggtgccagccgcccacgaggagaccctgctcccgcaggaggccgagctgaagcggcggagcgcgccgccagccagccggggtgagtgccccgggcgaggccggcggccgccaaagcccccgcggctcgcccgggcgcccggatgccagccccgagccccgccgccgggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggcgcggggcggaggctgcgagggcgcgcgcggggaggatggacgggtccggggagcgcagcctcccggagccgggcagccagagctccgctgccagcgacgacatagagatagtcgtcaacgtggggggcgtgcggcaggtgctgtacggggacctcctcagtcagtaccctgagacccggctggcggagctcatcaactgcttggctgggggctacgacaccatcttctccctgtgcgacgactacgaccccggcaagcgcgagttctactttgacagggacccggacgccttcaagtgtgtcatcgaggtgtactatttcggggaggtccacatgaagaagggcatctgccccatctgcttcaagaacgagatggacttctggaaggtggacctcaagttcctggacgactgttgcaagagccacctgagcgagaagcgcgaggagctggaggagatcgcgcgccgcgtgcagctcatcctggacgacctgggcgtggacgcggccgagggccgctggcgccgctgccagaagtgcgtctggaagttcctggagaagcccgagtcgtcgtgcccggcgcgggtggtggccgtgctctccttcctgctcatcctcgtctcgtccgtggtcatgtgcatgggcaccatccccgagctgcaggtgctggacgccgagggcaaccgcgtggagcacccgacgctggagaacgtggagacggcgtgcattggctggttcaccctggagtacctgctgcgcctcttctcgtcacccaacaagctgcacttcgcgctgtccttcatgaacattgtggacgtgctggccatcctccccttctacgtgagcctcacgctcacgcacctgggtgcccgcatgatggagctgaccaacgtgcagcaggccgtgcaggcgctgcggatcatgcgcatcgcgcgcatcttcaagctggcccgccactcctcgggcctgcagaccctcacctatgccctcaagcgcagcttcaaggaactggggctgctgctcatgtacctggcagtgggtatcttcgtcttctctgccctgggctacaccatggagcagagccatccagagaccctgtttaagagcatcccccagtccttctggtgggccatcatcaccatgaccaccgtcggctacggcgacatctaccccaagaccacgctgggcaagctcaacgcggccatcagcttcttgtgtggtgtcatcgccatcgccctgcccatccaccccatcatcaacaactttgtcaggtactacaacaagcagcgcgtcctggagaccgcggccaagcacgagctggagctgatggaactcaactccagcagcgggggcgagggcaagaccgggggctcccgcagtgacctggacaacctccctccagagcctgcggggaaggaggcgccgagctgcagcagccggctgaagctctcccacagcgacaccttcatccccctcctgaccgaggagaagcaccacaggacccggctccagagttgcaagtgacaggagggcccctcaggcagagatggaccaggcggtggacagatgggtagatgtggcaggcatgtcatcgacagcacagaagggctgtcctgtgtccccccaaccctcccctggacagactctgaaggccctcccggcacctctgccaaggctgggtaagactcctctatgttgcctgctgtccaggagcccgggagggaggggtgtgcaggagccgcagggccgtgtgggacgagtggaggccgcggcctggctggcacgagagcccacgcccgcttctgtatctccctcaataaagcctcctgctctgtgcaccctccgtgttgtaggttctgtcacaggctggctgtcacccccaagagtagctcaggcacacttcagtgccaggccaggaggtaggtgtgcagccgggtggtgggggagttatttttagtgggaactaattaaagaagggctcatagtcaggttcggcgccaaggagccttaccacattcctggaggctctgcaggccgtgcttccctgctgcttccttctggggtaaagcttgctccccctgcaggcccaggatgggggagagttcacagtgcacgcccagcagcctgcagcatttagttatcacgtgcaccgggcccttttcacaacctctttctattccttccattgaccctactagctaggtatctccattttacagatgaggaaactgaggcccaaggtcacacagagaagggaacaatcccaggtctgatgatcccaaagcccatgtgttctctctgacaccaggtggtcttgggacagaggcatctgcttgggctcatgatgagacagtctttggaccaggagaggggctgatcttccttggtgtgggggtgcctgtcctccagcccatctttctagccctgatacctttgagatagctgctgaatggataaacccgagtgtggatgcccctacccgtgtcctggtgtctcactgaatctcctctgagagccccgagggaacagatcaaacagatctgggttcgaagcccaggcagtgaagaggaaccctgagatgcctttgagcttaaacatttttctctaaggcctctcctccaccactcccttaccaactttgtgaccgtaggcctgctgattcatctctctgaccctcattctgatcatctggtaaatgggaatataatatttaataagtacggcagagaatcgtggcttttagcatggcacctggcacttagtaagtgctcaataaatagtagctgtttctattactctgtgctgggagggaggtgggttgcacggttgcccactctgacctccactgatctgggctgggcttgtaggtggggggaggttgggggcagggcattgtcacactgtccttagtcaaaggctaagagttggccccagcaggccccttcttctgggtttccatctttcctgaaacccagagctgtgtccttgcttctcttgctaaggcagctggtgcagtgggaggagccctgcagtggggcaagtgtgtgggactagatgggggagagggaggtggtggtccccagtctgccaccatctcgggccaatttttcccctcctctgggcgtaggtttccctatacgtataataagacttctcgaggccccatctagatccgaccttcgaggattcggaagccttaggctgtggatgctctgtggtggggactctggagggtgggaggctgccatgttgtagggggcttggagtgggaggtcttgggagagagttagggtctgtggagtgcagggcttagctgtagagctaaaagtgatgagagggccccaggtagagaggggcctggccagggggtgcaaggccaggtggggcaggagtgtcagccctggcctgaaaggggctgtcctgtgtcccccagccctctcccgaacagaggccctcccaggcaagactcttgtgtggctttcagtcagtgccgtgcacccctccctcacacgtttctccaggaaaatgctgggtcagggccaaaaggcagaggagtcaggaggcaggggctggggcagcggggacccactgcaagggggagaggggctgcacgccctccagctgggaaagaggggaggagggttgtggaaggtacagtctgtgcaccccctgggctcagtgggtttgctggatgtgtgggttgcctctttttgttccccttttccccagagcctgtgctggcctgagcgggggaagctcagggagggcgggagaggccagggtgaccctggctctggaggccgccttctctgcactcacctggggcaccaggggagggagg

SEQ ID NO: 13347 - DNA, 11494 bp, Human
cagtgatccagtacctcctcctggctgaacagggctatgaagtggcacaaagcaatgcagcctttattcttgatcagagtaaggttcattttagtcctgccttaggtttagaatgtacgagttcacaccagtaaactgtttaatgtattcaaaaagaaaagctactaggaaacattctttattattgtaactggaactgaacacacaggcttaagttattaatattttactttagccatcaaagttagttttataacgagttgactgtagaaatggatttgacattcattttaaaattaagcactttgcataaatgtatttttcaaaatacagtggatacaaaaatgccattttcccaacactgtagaagagtgactcagtagtctcatgactggttctatagatacaacatgtttcacaaagtagtgccctcttgcatccagtgattgctttgaactcactattttagttcagtaattaatttcagtatttgttttaatttttatatcctaattcttgtttaacttatgcttcacctatccttcctactttgcaaatgaaaattaagtctagtgccttttcttaaatgcctgatttgtatttcatttcttttcctgtaggagaagcaagcattgtaggtgagaatgaaacttatcccagagctttgctacattggaacagggccgcctctcaaggtaagtgattaattctaagataagagtttcacccagggacctccctatgttgtttatctcccatgaacattaaatcatgaagccgagtactgtggctcacgcctgtaaccctagcactttcggaagccaaggcaggaggatcacttgaggtcaggagttcgaaaccgaaaccagcctggccagcatagtaaaaccctgtctctactaaaaaaaaaaaaaacaaaaaaaattagctgggcatggtggcaggctcctgtaatcccagctactcaggaggctgaggcaggagaatcgcttgaacctgggaggcagaggttacagtgagccaagattatgccactgcactccagcctgggcgacagagcgagactccttctcaaaacaataaaataattaattaagcagagatactgtgacttaatttgtttgcatattattggtatttattcttaacagaagtttctagagccagagtttctaaattgggttgtaaagtctttgtactacacatttccatcaagctatgattcactctttgttttccagtttgaggccagtatactgtgtgaaatgggaattaaatagaatgtatgatagaacattagtctgaaacctaagagacttttctttttcttttgaatatttattttttatacatgttcctttcaacattctctgcctgttcccttctccaaacctaaatggtcaagctggactattttaaaatgtaaatgacattataaagtagagcctgatcatttacataggagtgtttgtgaaagaagggagtacaggttgagtatcccttatctgaaatgcttaggaccagagtgtttcagatttcagatgtttttgttttttttgtttgtgtttggcatatttgcacatacgtattgtttgagcatccttaatctgaaatctgaaatgctcctgtgagcgtttcctttgagcatgacctttgaatgtcatttcaggttttggagcatttcagatttcagctttttgaattagggatattaaacctgtccccctacacacacaccaacttggttttacctctctgtattccaaagccttctgcagaagagctacacttctagtttaaatttttactggactttataacttggctgaaaggatttgttacaaagtttgtgtactatgaattaaaattctttgttttatgtaagcatgtcaatgggaggagaaaaaagtttgatctgttttaaacatactttatttattggcagttctgcatttaacttttgtttaaggctatactgtggctagaattaagctcggagactaccatttctatgggtttggcaccgatgtagattatgaaactgcatttattcattaccgtctggcttctgagcagcaacacagtgcacaagctatgtttaatctgggatatatgcatgagaaaggactgggcattaaacaggtgagtgtggcttccaaacacgtttgaatcacataattgtgattggggaaaatacttgcatttgtatagaaaatagactttccttgacattcagttggatttcaggccactaaattatgggactgatttgtaatatttcagaagactgcccttccatctctcatcttccagcacgcacagatactgctatccacgctgttttatttagggattaagctgaagacagactcatgaaaatggaagtgcagtgcttcctctgctgataactacttgtttgagaaactatctgtccatcgtcagccaaattctatttttttcaaattattttgaaatgaattaaatgtattctactgataaatttatttctgattcttacacttgcctaatgaagtctgtcattctctggactcatgacttaaggtttttcctgtgtgccctcaaaagaatttggaaaaactacagacccccttgtacatttttaagttggcatttaaattttttcttaagtttcaaagggtctaagttccagctattttaagcattaacatttttaaataaaattaattacccttaaaatatccaatagaatctaaataacaataatttaatacccacttaccattattaattttttagaaatatacaagcaagttttttaattgaaagctaggtcttttcctgtttccctaaatttatgttttctaccacgacttctgtagaatgtaatactaatgtattgtttttaatgcttaggtcttttattgattactgtatcatacttacctgaaacaaacaagtgtataaattcattttgaattttattaccagtgatctaagtgttaagaaaaattcatgagatattactagtcacagttggtcagttaatgcattgttgatcaaatctacaaaatacattttgataaaactttgctttttgtattattaattgaaaatgcatcttttaatgagataaatggagtatttgttaaaaattgagatttcacattaattctgtttttcatttttttaaatgtatgactagaatgtcatgtatgtgaaaatgggaagaatttcactatagcatggtcacttaattcttcaaactaccttaagagttagatgccaaaaatcagagtgacttgtcattagaaattatttttaatgatcaatctcctgactacttgataggtccctcttcagttgtgttgaaagcaaagaattggaaaccagagacttgtgaaagcatgcattccctgacactgggacctttcacttttcttattttctaggaagagtacaaaaggctttaccaagacttatgaaataggctgttaattatactccttcctgtgtcacttagaggccctttgttgacctaaggattgagggaaagttgttcatttttgctaatgcggtattttcttgacaaaatgctgctgctttgttcacatttggacattttcttttaatttcagtatgtaaatatttatattttaaacttaccttaatacttagaatattactaatattagatacttaaatatagttcagtcaaggctcaggagcagcaaactcagtacattcaacttctggaagatctctgccacttaatgtagtaactgaagcttctctttattgtcaaaccagtcatccagtgtcccaaattagacttagcttctatcagaaaggctgacggatttttgtcgttttttttaaatggagatggggtaccactatgttgcttaggcttgtctcaaacccctggggacttaagcgccttggcctccaaaagtgctgggattgcaggtatgagcccctgcacccagctgactttatttttaattcaagtgaagtttaacatgactaatataaagatcacatgtaagttatggctttcatggagtacatctagtaataatttactgactgtagtcaaaattaaaatgatataactaatctgtttttataatagcttataaaacaagaaaatgtgttctaatttaatttgtaatacactgtatagctaataatagaaattcttgtgaataaagaatatgataaaaggcatagtactcctttgataagagtagggggagggaacttttgtttagcttttgagaataaataatcatttatgaaaataaataatcatgtatgaaaatcagtaactccattactttttttttttttcggtgagatggagtctcactctgttgcccaggctggagtgcagtggcacaatcttggctctctgcaacctccgccctctgggttcaagcgattctcctgcctcagcctcccgagtagctgggattacaggcgcctgccaccacgcccggctaatttttgtatttttagtagagacggggtttcaccatcttggccaggctggtcttgaactcctgacctcatgagccacctgcctcggtctcccaaagtgctgggattacaggcgtgagccactgcacgcggtcccattactttttttataagacatcgtgatcaccttttctactttttttcttttgaggtttaaaatattcatgctactaaaaacaatcccccatttaatatagttaggaaaatattaaatatgaggattgactataattggaaaaaatcatcatattatttgataagttttaattacatactagtgaatctatttaattaccctagtgaatcatccaatgtatgaatcacatgaagtttgatccatgatcttgaaaaatatagcagtcgaaaaaaccatttgagttatatttttctaaaaactcagacactaaccatactgttagcattatttgaagatgctcttctttttaaataatgacacaccctaaggacaagaataaggaatagctgaaaataactgcttgtatttaaatatgtttggagggggagtcatttttggtctttaacctttcttcctcatatctcatggaattctttcttaagagtttggtattctttgataatagggagtagaagtgagatttttaagtgaaaattcccaccatcccattctattacatatctgaattcagaacactccagcctgggccaaaattaagaatgcctggtttcaccctttacagaaatatatctaacacagggaaacacaagatgccctaataagggtttataattagtcaataaaggagccttctccagaaccagtatttcaaggtatctcttccggtggtagcccctgaggtttctacaccccagggcaatgcacttgaggaaagagtggggtagatctcttccggtggtagcccctgaggtttttacaccccaagacaatgcactggaggaaagagtggggtagataagggctgtgccttcctttagcaaagcgaagcagagaaacgttgctgtgcatacaggcctattctcagcagatccctttcaggaaaaagcacatatggaagctgcagaactgcagaatcgagtcccttaacatgtccatgcaagtacctcttgtaaaatctgtttctttttttggaaacagggtctcactctgtcacccaggctagagttcagtggcaccatctcagctcactgcaacctctgcctcctgggttcaagcagtcctcccactcagcctcccaagtagctgggactacaggcaggcgccaccacacccagctaatttggcttattttttgtagagacagtttatgttgcccaggttggtcttgaactcctggcctcaagtgatcctcctgcctcgctctcccaaagtgttgggattataagaatgagcccactttgggaggctgaggcgggcggattacgaggtcaggagatcgagaccatcctggcgaacacggtgaaaccccgtctctactaaaaatacaaaaaattagccgggcgaggtggcaggcacctgtagtcccagctactcgggaagctgaggcaggagaatggcgtgaaccctggggggcggagcctgcagtgagccgagatcgcgccactgcactccagcctgggtgacagcaagactctgtctcaaaaaaaaaataaaaaagaatgagccaccgtgcctgtcatctgttgtaaaatcttgagtgtttctaccccactttgaagatcactgtccagaactgaaaccagacgttgctaatactgattgaagttttaagtagcaaaaaattagtgtgagtttcagaagtcgcccttggaaatctctaggttaacagtgttaatgcatagatatatggctgtatgcagcatatctacacagcaaattagatgttatgttgggggaaaatgagttttttaattaagtttttcaatattaagcagttagataattaaacgaattttacccaagtaaagcttggcatttttgtttaggtgagggaaactcattttaaaatgaaaacctcaaaggtaaaataaattcgtctaatatgttcactaaatatttttacttattttgacaagaaatgcatttttgtttcttacctgtattataggatattcaccttgcgaaacgtttttatgacatggcagctgaagccagcccagatgcacaagttccagtcttcctagccctctgcaaattgggcgtcgtctatttcttgcagtacatacgggaaacaaacgtaagtggtccgtacctcttttcattaaaatataaatgatggaaggtctgtcctggaggtttgtttttcaaaagttgagaagcacagggaagagtggtcctgcaggtatcgggtgtgttcccttctcctcagctcaggtacccgaggaccttatcaggggagggataaatgcaggcataaagcagctactgcagtttttaggtagcgtttgacacttcctgacgctaaagcatttttcatggaggcagatgttttctggtttagggaaaactgagactaactcatggcagtttgaaacagtatttaattcagtaaacattaaatcagatgactcaaaccagtcccttaaaaagaaaaggaaaaaaaaaagaagaatctgagaacctccccaggttgttgtacttcagattcttccgatagtgaagcattaagttgaaaacaccacccaaattttcttctctaaaaatagcgtgaattatttaaataggctaatggaagaacctatataggaagtgggttacccattttcttcaaaattaccaactttagttggcaatactggtatgtaggtactcttgggttctgccagctttatattttgtttccagtactatagttcctagaatggattaactggtagagcatttcactctgaaagccctaagatgttcagagcccttgtttctaacataggcttattcaggacaaggaaagtttcttcaggaccagaaaaggatgatgtttcacccttttgttaatgtctttcagttttagattcaagaatgggctttccctcatgtgtgtcacaggtataaatgtagtccatgctgctccagcatcagtgaaaagaaatggacttgtctagtccatgcagctgaagtcctccacagatagggttccagagcactggtcttgtgggactctggcctcccagtcgcttccacatgtgtaatgtcagttgctataattgcatggtagcatgagtcaggtgtgctgtaaccgctgccaattgaaacaatctttgttcctttaattaaaagctgatcgtgtggcagcctcctctttctctttcagtaccatttcagacctttatctctcacaatttttattactaactgttggttatagtctaggacttcatcttataatatgctgtactgggtatattgtatctttgctgttttttttaatacagaagtataaagaagacagtaaaaacgccccataatcctaccacctagttattccaactaaaaagaaaaagagagtataagactaataagtatcgatcataagaaagtcaaacagtacagaagaacacaaatctcccatcccagattcttccccagagaacacaattagtggtttcttgtcattttttttccagaaaaatttagcacctgtacctacaaacgtgttatagagatctttcaaatgtaattttatataaaattataccccatgtttactttcttaatgggtaagtataataaaagtcagaaagtatcagtgatactaaaacaattaaaatattataggctaagaacataactttcaggtttcaattcagatgttaaatattttgtgttttagttaaatcctaattgagaagcattattcattcagctattaaatgtttgaattcctgctattttcaattacatgggaattgtgaaatggccccactgtcatggaacagagctttccagctggtgtgctgtcactgccagtaggttcgctgtgccaagatactaatttctccccttggctcaccactgtttttttcttttttctttcctgagacagagtcttgctctgtcgcccaggctggagtgcagtggcacagtctcggctcaccgcaacctccacctcctgggttcaggcaattcttgtgcctcagcctccagaatagctgggattacatgcacccgccaccatgcctggttaatttttgtatttttagtagagatgggatttcaccgtgttggccaggctggtcttgaactcctggcctcaagtgatacactcacctcggcctcccaaagtgctgggattacaaggcctgagcccccgcgcctggccccagtgttgttttgttttgttttgttttccaaatattttctgtgaaaaatgattaaaattagcgtattggattactggtggaaagaacactgtcagacattttatattaagtgtcagctattataaattagtagcttaattcctcagacacattattttgagcttcagttgaaggcttttaaaaccgctttaaacacacacacacacacacacacacacacacacacacacacacattgcaaaacgtttttaaaacaaattattttaatttctgtacttacttctggtgatgtaactttcccagttccttgcctgacattttagtgataataatggtttctatattattttcattaagattcgagatatgttcacccaacttgatatggaccagcttttgggacctgagtgggacctttacctcatgaccatcattgcgctgctgttgggaacagtcatagcttacaggcaaaggcagcaccaagacatgcctgcacccaggcctccagggccacggccagctccaccccagcaggaggggccaccagagcagcagccaccacagtaataggcactgggtccagccttgatcagtgacagcgaaggaagttatctgctgggaacacttgcatttgatttaggaccttggatcagtggtcacctcccagaagaggcacggcacaaggaagcattgaattcctaaagctgcttagaatctgatgcctttattttcagggataagtaactcttacctaaactgagctgaatgtttgtttcagtgccatatggaataacaactttcagtggcttttttttttcttttctggaaacatatgtgagacactcagagtaatgtctactgtatccagctatctttcttggatccttttggtcattatttcagtgtgcataagttcttaatgtcaaccatctttaaggtattgtgcatcgacactaaaaactgatcagtgtaaaaaggaaaacccagttgcaagtttaaacgtgttcgaaagtctgaaaatagaacttgccttttaagttaaaaaaaaaaaaagctatcttgaaaatgttttggaactgcgataactgagaaactcttaccagtccacatgcaattagacatattcagcatatttgttattttaaaagggagggttgggaggtttcttattggtgattgtcacacggtataccatactcctctccttcaaagaatgaaaggccttgttaaggagttttttgtgagctttacttctttggaatggaatatacttatgcaaaaccttgtgaactgactccttgcactaacgcgagtttgccccacctactctgtaatttgcttgtttgttttgaatatacagagccttgatccagaagccagaggatggactaagtgggagaaattagaaaacaaaacgaactctggttggggtactacgatcacagacacagacatacttttcctaaagttgaagcatttgttcccaggatttattttactttgcatttctttttgcacaaagaacacatcaccttcctgaattctttaaatatgaaatatcattgccagggtatggcttacagtgactactattataatactaaaactcagagaatcaaagatggattaaactcagtggttgatgaaagccaaaacctgtttgtactgttctatactattcaggtatctttttatttctgatagttttatattataatagaaagccagccactgcttagctatcatagtcaccattttctcactgttaacattaggaaaatcaaggctactatgcttcaggattgtctggttaaatagtatgggaaaaaaactgaagagtttcacataattacacacgtgaaataattaaagcttaaactgaatttgtatttcattttattgtcagatggtggtgttcaccagcctgtatcttgtctgagactgcattcgtatctgagcaggttttctatgcctactgatgtcagtatgtttatactaaccttcatgcttttttcccagaatccctcatctgccagaaaacttgaaaagtttattgcttgtagagttgtactgctttgatttttgaagttggggtagtagttagaactagatttaactagtctataatgaacatgaaggcttttatatatgaagttgtatacctttttgtgtttagagaattatgggaaacctggtaagcaaaactttcctcccagataattgcttccaaattcgaagagttagtcaccaagagagccatatgtatgaaagcgtatctgtgaaaggtaggaaacttaccccccctaagtgtaatgttgctttaggcaactcttgtaaatagtgagacttgtttggtctcttacatgtagagatttgagtgcagttggtacagtactttggtgtctccaccactgtcccttctccccgcttcaaaataagtgtaatccacggtagcagccacacttcctttagaaggaactgttataatttatttaaaagttgaaaaaccacccaagatgactaccaactttcacttttttcttctgccatccaccctcatttttcctttagcaagatttttatatctaactttccttccctccattgagtacgtgctttgagaaaacatttcttaaaacagtgtgtgccacctaag

SEQ ID NO: 13348 - DNA, 8909 bp, Human
tgaaaccctcactctctcccctccaggttcctcacctctctcccaggacaaagagcatctcccttgaagcctcactcaccaggtgtctgtgcctcaggtcttggtgaagaatgctggaagtagaggacctagtcagagaaaggactatccccgtggccagaagagatgcggccagggcagacggggctaaggggattctcggccagcagtgaggagtgggtactgggttagcgggtgagaggggcatttcacaggtcctagggctggctgtgagatggatgagatgggcacagactcctggagagttcagctaggggtgggaggggtcagggactgtaaccaggcatagtgggggcagcggttctctagacacggtggtcctgaggcagggggttaccgcgtttggatatctgagtcgcttggtcttgtgactgcttttttttgatgggcacagggttcaagtggcagcaagcagtgcacaaagcctcctccatgagttctgcactgatctgggacaggtattcctcagaacgagataacgaagcctgggaaaggaaaagccggaggggttcagcctgggagctcccacatgggagtgctggctgtgggagttcccaggctggggcctgtgggtccaaggagcttgctcctgaaggactgggccttgagatttagctagaaagctctggacctgggggaggggggtttggtgggggtttagagtcagggcctagtgctgagagctatgagtcggggcttcaggactcagggttgaggctagagtctcagggcccgtggctcagacctggcacggggtgcctctgcctgggaggctttcacttcattacattcccacctctagggttccctgcagtgctcaccggacctcctctcaaggagggtgcagcttgagatggccagctgctcttcttctccccctcattccccatcggagtggacgccatccccctgggaacagtcgaagcctgagttgacctgagaaaccagcccgctttcccccagaacccagtccaccaccattccccgggcccaggtttaaacaaggcctttagaggaaacatcccgctgcctcattccctctcacaagaaaaaataataataataataaaggttgctttatatcttcgggagtgagagggaactcccgcaaccccctacccctcaccccttcgcctggtgggcctctccttccttcttccctcccaagcaccttcccaagccgaggcagccgacttgacgccccagacctggcagatgggtggaaaccttgggctactcggcaaaaggagagacgtggaggcctaaggacctctggtataggtcgtgggggacggagaatgggagatggggaggaaggctggaaaagggggagccggctccgtgtcgctaccggacgctataaaacccttggagtctgcagaggttccgcagcctcgttgctaggagatcaggggttctagaactaaagacagaggaatttcctagcgcgccccgtttgctcctccagcctcccctccgtacccctccaggtgcctccttgagggcagtgaccccaagcgccagacgcttgagaagcttgggaggatgacgtagggtggagcctgcgacctaatcctcccatcacaaggggcacgcgagaagcaacccatctgcagggcgctctggagcctctctagccgcctagagcctgcgagagcaaaggcggctggagacttagggggcggggagtaaagtgaggactgcaccaaatctcctggcctcttggggacgcaaagactcaggaggaggaattttatcgccttatctttgcctccaggaagtcataccctccacaaaaggaaagcagagatttttattcggtcttctcttttaccctttccttttccgtttctaactttgcttgacgttaatggttccttcctccctctcctcctctgcgctttggtacgagccaagggagaggggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggtgagtgctgcccacggccccgggccgaacgagagggcgaggggccttggcgggctccctgatcctgccctgtctccccgcgtcccgttccaaggttatgcccggattgtcttcgccatcatttctttctacttcatgccctgctgccccctcacggcctcctccttctacctgctcagcggcctgctggacgctttcgatggacacgctgctcgcgctcttaatcaaggtgacagacacccctctcagccagccttggggttcaacaatcccctcctcccttcccctgcctcctcgggacctcagagtcagagggctgtcattcccatctctggaaaaagcagaacaggatggcctggggctttttgttttgtgttttgtttttttgtttttgagacagggtctcgctctgtcacttaggctggagtgcagtggcgcgatcatggctcactgcagcccccatcttctgggctcaagtaatcctcccacctcagcctcctgactagctgggactacaggagcgtgccaccacacccggctaatttttaaatttttgtagagactgggtcttgcagtgtcgcccagattggtccccagctcctagcctcaagcgatcctcctgccttgctcccaaagtgccgcgcccagcaagaatggactgattttgtagcaaaaggaatttaagctagctcttgagaactcactgcttgtgagaggtgtggattagcaagacatgacatggcggtggcgctgctggaggtctctctgaatacaagtccattcaggccaggggcggtggctcacgcctgtaatcccagcactttgggaggccgaggtgggtggatcacgagttcaggagttcgagaccagcctggccaacatggtgaaaccctgtctctactaaaaatacaaaaattagcgggcttggtgacgcgtgcctgtaatcccagctactcgggaggctaaggcaggagaattgcttgaacccgggaggcggaggttgcagtgagccaagattgcgccattgcactccagcctgggcgacagagcaagactctgtctcggaaaaaaaaaaacaaaaaacaaaaaacagtgtattcaacaggtgtttactggaggcctactgtgtgccctgcataagcagttggggttccagaaggcatgcttagagggaggatggagagggaagggtgatggcttctggagggttgactaattttttaatctgttctccagacccaactgtaaggcttcccctgaggcatcaagtctctatctagccctggagtcttggttctggggttgatgagttgcagacatagctttcctctcctcctaccctgttccctccactctcatgcctttctcagttcatgccatggtgacctttgcccactgacctcacacacagcctgttttctagcctgcgttcctccccaggcaggcggacacttccagtcttcgtttacaccctgcgtcagagtgataaaccaaatatgggcacctgtcctgcatccactgtgccataacagcccttgcccacctaatcttccaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacaggtctgctgcgattctgggggcctgggccacttggagacattacagtggggtgggctgagcctagatggaagggtgtctgggatggcactaggcatcctggaagggctcctttttagctctgctttgtagaaagaccccaggcaaacctgcctctctttaaagcttcagtcatgtttacagttgcattaagcaattcttaggactcttctggctgggtattctaggattccatataggtgacagcttataggaaggggcatgggagctttcaaatgtggcatttgaatcctgactctgcccccaaataggtaactgtggctttcggcaggatactggtccttagccgtgcccagttttccatctgtacaataggtgttaacatgaggattggatgcatggtagtggtcatgaaaccttgtgggttcccctgttttctccccaagttctgtggtccgaggcagtgagagtcacaagatgatcgacttgtccgggaatccggtgcttcggatctactacacctcgagggtaagcatttcctgcacaccccacccctcaggctcttggctgtgggaagccctgggctgaatcctggtcctagcctaggagaaggcgagggcgcagagcagggcctgcccagtcactccaggaggagggcccgtaagctgaggcgtggaggaggaggattggtggggaaggcctgtgtgaattactccagggaacaagtgggaatgaggcctgcaaagagaagggactgaaagcgggaagggagataagccagagaggtctgcagggctggagtgtggacttgattccaggaacacaggcagcctctggaaggatttttaaaaagataatggctgggcatggtggctcatgcctgtaatcccagcgctttgggaggctgaggtgggaggattgcttgaggccaggagtttgagaccagcctgggcaacaaagtgagactctgtttccacacacacacaaaatcttgaattagcttagccaggcacagtggtacacgcctgtagtctctacttaggaggctaaggtggaaggattgcgtgagaccaagggtttatttatttatttatttatttttttgagacagagtcctgctctgtcacccaggctggagttcagtggcgggttatcggctcactgcaacctctgcctgctgggttcaagcgattcttgtgcctcagcctcctgagtggctgggactaccggcacgtgccaccacactcggctaatttttgtattgttagtagagaggggtttcgccacgttggccaggctggtcccaaactcctgacctcaggtgatccgcctgtctcagcctcccaaagtgctgggactccaggcatgagccacacgcctggctgagaccaggagttttgaggctgcagtgctatgatcatactactgcattccaacctggatgagagagcgagaccctgtctgtaaaaaagaaaaaaaaataagagaagtaatatgccgagattgtgccttcattagtgctgggggggcagggggtggcacacgcctgcctcttgctaacgtggcctgtttgctgtgtgtgcagcctgctctgttcaccttgtgtgctgggaatgagctcttctactgcctcctctacctgttccatttctctgagggacctttaggtaggagatgaggggctgggcaggaggatgggagggggatctggcctgcccagggagatggaggccccctccttcgggccccaaactcccctgctgccttcctgcagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatgagttggtttctcagagtgtggtccttagaccacctgtggtatatttctatttctcttttttgcttttctttctttttttttttttttttttttagagacagagtcctactctgtcgtccaagctggagtgcagtggtgcaatcatagctcactgcagccccaaactcctgacctcaagtgatcctcccaccttagcctctcaaagtgctgggattacaggcatgagccacaaagcctggctggatatttctttaaaatgcaaattcaagccaggtgtggtggctcatgcctgtaatcccagcattttggaaggccaaggttgggtggatttagtacaggagttcgaggccagcctgaccaacatggtgaaaccccatctctacaaaaaataacaaaaatagccaaatgtggtggcacatgcctgtggtcccagctactcaggaggctgaggtgggaggatggcttgagcctgggaggcaggagggagaggttgcagtgatccgtaatggtgccactccagcctgggaggcagagccaggcagtctcaaaaaaaaaaaaaagcaactttggcccgtcttggaggctcacgcctggcctgtaatcccagcactttgggaggctgaggtgggaagatcacttgagtccaggagttcaagaccagcctgggtcacatggcaggaccccgtctctacaaaaaaaaaaatacaaaaattagccaagtgtggtggtgtgtgccttagtcccagctactggggaggctgcagtgaaaggattgaatgagcctgggaagtcaaggctgcagtgagtcatgatcatgctactgtactccggcctggacgacaaaacaagatgtctcaaaaaataaaataaatgcaacttcttggaccctgcagccaaccttcagagttagaagctctagggatgggctcagaaacctgcaacttgaatgccggggaattcttccagtaatgttgagaaacactgttccctctttttatgggctcctatcatatactaggcactgttctgggcatctatcccctgccatctgtggtttttaaactactgtaccgcatgccagactctgtgctgcgggttctttgcagatgttactcattctatctgcatgatagcttagccaagtggcccaagaggcccccgtgtccaggagagcagaaatttaccagacatgtactgagcctcaactcctgtgctaggcccaggggattcactgggtactgggcagctggcttcctctacaataacataggaaagtgctcgttgggggtgggagtagaagacacctaggacctgatttagggtttggtgaaggggctgggtatcccatgtagaaggctggtagggattggagaggaaagggttagtgcagaggagattggttcttagctgagggaatggcatgggaaggcagggaggccagagaggcccctgggctctgcacctctttctccttcctgtcagctcttcttccggcatggtgggtcctctgagcactctccagccccagagcacggagcccttggtcggcctgggtcccacatccctgactggctcctgggctccttggttctaaccatttacagtgacaacagaaattggaacagatctaggccgggcacagtggctcacacctgtaatcccagaactctgggatccacccaagggggtggatcatttgaggtcaggagttaaagactagcctggccaacatggtgaaaccccatctctacaaaaaatacaaaaattagccaggtgtggtggtgcacgcctgtagtcccagctacgcaggaagctgaggtgggagaattgcttgaacccaggaggtggaggttgcagtaagccaagatcatgccactgtactctagcccagtgacagagcgagactccgtctaaaaaaaaaaaaaaaaaattgtgcacaaagcaggtgtgtttcaagcgcatcaggcacccctaccatccctgccaacctggcc

SEQ ID NO: 13349 - DNA, 9245 bp, Human
agcaagtaattggctaaactgggattataacccatttttctctgaccctagagccttggctcttgattgcaacactgtgttgcttctttagactagactgagattcatggaccattttaagtttgtaaccacctttgagagtctgaatggaggacgtggttttgcctggttttacttcctcctctagagtgcggggtccatattcctctgatgataagggccaggagagccatctaaacaaagtactgcttagatcactccaaagccggggccactcacactgcaccccaggaaactgaacctctgtcctttccagcccagactttcttccacggagtgacactgattagtttgtaggccaggtgaggcatgatttcataaccatggagtaatctgaccagggtcatgcaggggagcagcaggcctgcggtatataaattctcaaatacacatcttccatttatttccttatttctttctttaaaaaaaaaaaatttggcctaggcatggtgaatcatgcctgtaatcccagcactttgggaggctgaagcaggaggatctcttgagctcaggagtttgagaccaacctgggcaacacagagagaacacgcctccacaaaaaaaataacaaatgaaataaaattttaattttttaagagacagggtctcactgtatcacccaggctatgtacagtgacataatcatagctcacagtaacctggaactcctgggctctagtgatcctccctcctcagccactcaagtagccacaggtgtgtgctaacacaccctgctaattttacattttgtaggaatggggtctcactgtgttgcccaggctggtctcaaatttctggcttcaagagatccttctgccttggcatctcaaaaagctgggattataggtataagccactgcactctctctctatatatataaaatcaaagccccaccaatgccacctccttttctattttccaaactactccaccaccatggtctgcaccactccctgtgaggcccctcaaagctgtccatgcccatgtctacattaggcttctctacccatcgtgtcataacatttcctgtatttccatttctttctttctttttttttttttaaggagtcttgctctgtcactcaggctagagtgcagtggcgtgatctcggctcactgcaacctccacctcctgggttcaagcaattctcctgcctcagcctcccaagtagctgggattacaggcatgcgccaccacgcccagccaatttttttttgtatttttagtagagatgcggtttctccatgttggtcaggctagtctggaactcccgacctcagatgatctgcccgcctcagcctcccaaagtgctgggattacaggcgtgagccaccacaccgggcctatttttaatttttatttttgagacagagttttgctcttttgcccaggctggagtgcaatggtgcgatcttggctcactgcaacctcctctccccaggttcaagtgattctcctgcctcagccacccgagtagctgggattataggtgcccgcaatcacacctggctaatttttgtatttttggtagagacagggtttcaccatgttggccaggctggtctcaaactcctgacctcaggtgaaccacctgcctcggtctcccaaagtgctagaattacaggcgtgagccaccgcacccggcctctaagaggctttaagaagtgactttcccattgtgcttaatcatttttgttgaagccttaaggcagactaccttgtttgggattgggcatctgggaaaagagattttggcagagtccttaaaaatcttgcttttcttgggtacaatgagctggtccaatacaattaatccatgagagaatcttcaaattccattttctgagatgatttggaggtttggaataatagagcactttttcttagcaactcatttgatatttgagtgttgtttgacataatcatatcttggtcaacaggtccttcaaccggtgaccccactctgaggtaagaataacactatcacagtgcccatttaatttgatcaagaatcaatgggtatttaagagttgtgcatggtggcacatgcgcctataatcccagctactcaggaggctgaggcaggagtaggaggatcgcttgagcccaggaggtcaaggctgcagtgagctatgattgcaccactgcactgcagccggggtaacagactgagaccctgtctcaaaaaaaaaaaaaaaaaaggaactgtggatatagctttctttattgttccttttctcttttgccattttccattctttctttcatttttgccttttccagtttcattttctatggttattgttttttatatctttgctcttatgtcttttgatctctttaaataaatgattttctagcttgcttatctgttattgtcttacaatttctcttctttttttaaatcgcatgcttttatagccattagtgaaatacctgggaaactcatttgtcactttaacttcatcttcgttttataatgtctgcccatttttcagacataggacagggaagtcatgttaaggaatatattatctcttgataggtggaaggattgatctatgtagtaaatgaatgtgatactttagggatgagtgggaactgttaggatgtaataagcttgtgacttaaccatattgcaaagaagagtctgcagttcaattctgagtttcccttgagttacagctttcagacatagagagtgttaaatctaaagacaccactgagagcaagtagaatttctttcttataggagttagtatatagaatcctaatgtggaagaatcttgaggctaaattgctcttttgtctgttcttgacaatacaatcttgttggcaatttgaggcgtcaacacttgagaaaatctggttagagtccattgaggaatagaaaagataaggattggaacatagcacctctaggtgtaaaatagaaaagttagaatatagctaggcatggtggggcacacctgtggtctcagctactcaggaggctgaggcaggagagtagcttgagtccaggaaggggagatcaggctggccagcttagagagaccatgtcttaaaaaaaaaaaaaaaaaagggttagaatataatgaaggaaaatttaaaagagaaacaaagacacacttacacctgaattcaagactaaaacataatggtattagagagtggtcaccaaataatgtgactgggggaagaaacctgtgcactatgtttgtgagaaaaaaaaatctgataattcaaacagacctcttcagataactttgagacatatactagaaaaagaagtttcctgagatgttatgtctcagatcagcctgatagaagaggggagcagaggctgggcgtggtggctcacgcctgtaatcccagcactttgggaggctgaggtgggcgaatcacaaggtcaggagtttgagaccagcctggccaacatggtgaaaccccgtctctactaaaaatacaaaaaaaattagctggacatggtggcgggagcctgtaatcccagctacttgggaagttgaggcagaaaaatcgcttgaacctgggaggtggaggttgtggtgagctgagattgcaccactgcactccagtctgggcaacagtgtgagactccatcttaaaaaaataaaataaaataaaataaaataaaataaagaagaggggagcaggaaaagatttctaagatctctctaaatatggcatgacagtgtgggctgctttttgtatttcaggagaagaatcgaaccctgggagtttgacgtcttctatgaccccagagaacttcgtaaagaggcctgtctgctctacgaaatcaagtggggcatgagccggaagatctggcgaagctcaggcaaaaacaccaccaatcacgtggaagttaattttataaaaaaatttacgtcagaaagagattttcacccatccatcagctgctccatcacctggttcttgtcctggagtccctgctgggaatgctcccaggctattagagagtttctgagtcggcaccctggtgtgactctagtgatctacgtagctcggcttttttggcacatggatcaacaaaatcggcaaggtctcagggaccttgttaacagtggagtaactattcagattatgagagcatcaggtaaaaacagtaaacaaagaaacttcattgtttacaacagactgtggtgatagtagctgtttttaggccagaagattggttagcccaggctggaagtctcagaagtaaaagtccaaaataatgtcataaaggactaggtctgaaattcatgacaaggaaagttacaaaaatacaactcctggctacgcatggtggctcatgcctataatcccagaactttgggaggccaaggcaggaggatcacttgaagccaggggttcaagatcagcctgggcaacatagtgagaccccatctctaaaaaaaatttaaaaatccggccaggtgcggtggctcacgcctgtaatcccagcactttgggaggccgaggtgggcggatcatgagatcaggagatggagaccatcctggctaacacggtgaaaccccgtctctactaaaaaatacaaaaaaattagccaggcgtggtggcgggcacctgtagtcccagctactcgggaggctgaggcaggagaatggcgtgaacccgggaggcggagcttgcagtgagccgagatcgcgccactgcactccagcctgggcgacagagcgagactccgtctcaagataaaataaaataaaataaaataaaaaataaaataaaaaaatcagacaggcatggcagcatacacctttaaaggctgaggtaggaagatctcctgagcccagaagttcaaggctgcagtgagctatgattggaccactgcacactggcctaggtgacagagcgaaaccctgtatcaaaaaacaaaaacaaaaacaaacaacaactcttttttttttttttttgagacggagtcttgctctttcgcccaggctggagtgcagtggcgcaatctcgactcactgcaagctccacctggggttcacgccattctcctgcctcagcctccccagtagctgggactacaggcgcccaccaccacgcccggctaattttttgtatttttagtagagacggggtttcactgtgttaggcaggatggtctcgatctcctgacctgtgatccacccccctcggcctcccaaagtgctgggattacaggcgtgagccaccgcacccagccaacaactcttttctctagtcttgcctctcagccatctttaaatgaactgctttattctttttagggggtctaatgtccagcagcaactagactagagactacaggctttctatacgggaagctaggttggggatcttcttaagtaatttaccattgtgcttgttgaatgagccaagatttgtgtttccttagagtattatcactgctggaggaattttgtcaactacccacctggggatgaagctcactggccacaatacccacctctgtggatgatgttgtacgcactggagctgcactgcataattctagtaagtcactttagggacacaaatgttgatgcaaaaagaagcatccttcttcaaagttctttcctgagaaaatttgactcatatcttctttttgacatttatattgagatttagttatttaactagctagctcctcttaagaaaatctcagagccaggtatggtggtgcacacttgtagtcccagctacgcaggaagcttgagtctaggcgttgcaagctgcagtgagctatgatcacgccaatatgctccagcctgcgtggtataacaagatcctgtttctaaaacacagctgggtacagtggctcatgcctgtaatccaagcactttggaaggccaagatgggaggattgcttgagaccaggagtctgagaccagcctggccaacataatgagaccccctctctataaaaaagaaaattatgtatcaaacaaactaaacaaacaagcaaacaaacaacatctaagcctaagaacaagaagtgtgtttgtgggaggtaagtggagaagggaatttgggtaaaccgatctaagatatgggtggtccccatattaattacattttatcatttttattcttattttattatcattatcttttaagccacagggtctcgctgtgttgcctaggctggggtgtagcggctattcacaggcaccatcacagcaacccacagcctcaaactccgaattcctagcctcaagcaatcctctgacctcagccttctgggtagctagaactacaggcgtgtgtcatcatgtctggctttatcattattattgttcttgttactacaacacatattggctctactgtatttcagatattctcctttctcttattagtgtgtgtaatcttattgaagagaatgtacgtgttccattggattctcttgaaagtggttcaggctgggtgcagtggctcatgcttgtaatcctagcactttgggaggcagaggggagtggatggcttgagcccagaagttggagaccagcctgggcaacatggcgaaaccacatctcaacaaaaacacaaaaaaattagctgggtgtggtggtgcgtgcctgtagtcccagctacttgggaggctgaggtgggagaattgtttgagcctaggaggttgaggctgcagtgagctgtgattgcaccactgcgctccagcctgggtgaatgcagtgagtccagaaccagaccctgtctgggaaaaaaaaaaaagaagaaatagttaaatcgtcttccaactgacatttttaaatgtttgtggtgataatattattaattaaaatattcatcctaaggattaaatataatccttttttattccagagtcttccaccctgtttaaagatttcaagaagatggcaaaatcatcttacatttttcagacttcatcttcaaaactgccattaccaaacgattccgccacacatccttttagctacagggctgatacatccttctgtggcttggagatgaataggatgattccgtgtgtgtactgattcaagaacaagcaatgatgacccactaaagagtgaatgccatttagaatctagaaatgttcacaaggtaccccaaaactctgtagcttaaaccaacaataaatatgtattacctctggcagtttctgtgggtaaggaatttagaagcagcttatctgtgtgttcctgtctcaggtcccccacgaggttgtagtcaagatggcagccagcgctgcaatcatttgagggcttgactgaggctggagaatgtgcttcccaggtggcaggctcagatggctggcaagtttgtgctagtggctggtagaaggtttcagtttcttgccacacaggcctctccacagggttgcttaaataacctcaggacatggcagttggcttcctacagattaatttaccttttgaaaaatttcctgtagagatggagttttgctgtgttgcccaggctggtctcaaagtcctagactcaagtgatccaccagcctcggcctaccaaagtgctgggattaccagtgtgagccaccatacctggcccagagcgagtgatcgaagagagaccaaggtggaaatttccacgactttgatgacttcatcttggaatcacaccctatttcttttgcagtattctatttgttacacaggccagccatgattcagagtaagaggggactcatacacaaggatttgaaactcaggacatgaaaatcactggaagccatcttggattttccctgtaggggctttctctgttttcagacaaataattacatggaatcaatttctgaagacacagatagagggaaacaaaagacaaagtagtaacatctattattatttgtttcttaattagaatatcatgagattcacaggtgatttatagaggactggatgaccagatgcagagaggagctaccatctccatgagagcttcggagacctgcagagacattgcatgacttgcctgcggaagttgtttgataggaattctcattggtttacagaaataatattggttagtgattggctatacatggtgtccagcacagggcattttgtggctgcttagtgtcagtctagagcccatgttgcaaggggctttaagaggtaattagctcaagcagagagtgagatgtgattgctgtcacattttttttttaagtttttttatttttatttttttttttttgagacagagtctcactctgtcgcccacgctggagtgcagtggcacaatgtccggctcactgcaagctccgcctcccaggttcaggccattctcctgcctcagtctcccgagtagctgggactacaggcgcccgccaccacgcccggctaattttttgtatttttagtacagacggggtttcaccgtgttagccaggctggtctcgatctcctgacctcatggtccgcccgccttggcctcccaaagtgctgggattacaggcgtgagccactgcgtccagcctgctgtcacattttaaatattcctctgggcttgataatttaaaggagctcacattcctcagataaaatgttcattttctttctcaaacctaaacataatattaaccaccgctatattatcatttttagtaggaggatgagaagggctaaatcagacacaattacaaaaaactcttagcctactcatcaattactcatataagctgagtaacagcaattctaatttataactcctttataataatattaaatctactaatgaggctgggtgcggtgactcatgcctgtaatcctagcactttgggaggtcgaggagggcagatcacttgaggtcaggagttcgagaccagcctggccaacatggtgaaacgcggtctctactaaaaatacaaaaattagctgggcgtggtggtgcacgcccgtaatcccagctactcaggaagctgaggcaggagaatcgcttgaacctgggaggcggaggttgcagtgagctgagattgcaccattgcactccagcctgtgggacaagagtgaaactccatctcaaaaaaaaaacccataaataaataaataaataaataataaatttacgaatgagaggagagtgaaaagtaccagttaggcagatagctaggacatgtccttggtagaattcctttctaacaaaga

SEQ ID NO: 13350 - DNA, 9245 bp, Human; identical to SEQ ID NO: 13349

SEQ ID NO: 13351 - DNA, 15036 bp, Human
ctaagtttgagtttctcattatttactaaatcgaatatgcaccaaaaggatagactcctcactttcactcagtttgaggcaggtgactgattccctaaaacatatattccttgctagacaaacctggcctgggttaaaaataaataaataaaaactcaaggtttaagacccttgcaggccgggcagggtggctcacgcctgtaatcccagtactttgggaggccaaggcgggcggatcacctgaggtcgggagttcgagaccagcctgactaacatggagaaaccccgtctttactaaaaaaaaaaaaaaaaaaatacaaaaaattagccgggtgtgctggctcatgcctgtaatcccagctactcgggaggctgagggaggagaatcgcttgaacccgggaggcggaggttgcggtgagccaagatcgcgccattgcactccagcctgggcaacaagagtgaactccgtctcaaaaaaaaaaaaacaacaaaaaacccctgccaacatttatttagactctatgacaagcacgctgacaagatgccatcatgtttccagtaaaataaattcaacaatgaaccgaaagatgaatatattctcttgaatcaaaggtccatataaataggtgggggaggggaggaatgcccttccactcttaaaaattattcttcctaaaaatcacaaagtttggtacgactctcaaatagacgatgaaattaggaaatttccaacactgcatttctaacttaaaatattttttctaaagtaaaaaagtacatgttcgttgtgtgtgtcagaagaagaaataggaactacaaataaaagaaacatgtttaaatgaccataatcccaaattactcagcgataattacttgctatcaatccttcttaacttttccatgcattcataaatacgatgagactgtaaataagacaaaaaaaaaacagaccccgataatgatcaaagatcttcggcgcaataggcaatgtctaacaacttcaatggctttcttcaggggattctcaacgggatttcttgatctttcccaaaatgctgggaagccctttaagtttaaacaaacaaaacctccaaacgggaagggatgccaacctctcctaggctgcctgcagagcggggagaaacaggtctatcggaagaagagtagagatactcacctaaggagactcctctcccgaaaggaatctgcttctcagccccacccccagctcaccccaatcccacgtaggtccgcagatgctccccccgggaaggacgggacgaccccgcagccgcgattcaacgcggcgcgcccggaagccaacagctactcccgggctctgagcgggaagtgctgctgcaggcgccagcccggacccgggaatgctcctccctagggtagggaagcgcgcgggcgcaggcgtttacctgtctcatcttcccatggttcggggcgagcaggcgtggaccgcgctctgcgcctacctccctcctccttccccaggaaggctcagggcagccgccgacggctgcttccccggttactacaacaaccaacaagcaaccgcccgctcggagccactgcgcaggcgctcataacgctcagctgcggacgcgggcgaatgtcgtcaccgccgcgcagcgcgggcgcagagccctgccctcagctgaagggagtcttctttttttttttttttttccgctgtttttttctccgcccctaagaggttgactccaaacccggagttccgctaggtccaacaggagggcttacggcgtgagcggcgtacctggggagaggcttaggcagcggcaaccgctgattggcagtaaaggggttcactccccatctcctgctcgggcgaaaccgggacagccaatcagagagagtactgacggaaacggcccaatcctggagcagggctgagggagggggcggggacaaatggctcaggtggactccgggctggagctgtcctgggggagcttgtttgcggcagcggctgctgctgccactgctgtgctgggggcccggtcgccaggtaaggagaatatgggggagaagagggatgtaggtgtctgtgttgcttctgattgagaggatccggagagtctggaaaaatggaggtgggatggaaggaagataactggaaggcaaccttttggggggaaaaggtttcgagaggcgatgacaagggggagctaggaagatggagaaggcttggtgaattcaaggaacgaaggaatggatgagcgaatgagcagccactatgagcctagcactgtacaaagagccttcactttttgtcatataattcttacaatagcccttcgggttgatatttctatctccattttgcagatgaggaaaccgagactgaaaagtgtaaatgacttacccagggtcacacagctactaagtggtagggccaggataagaatccctttctcctgattaagttttaacagcacacctatgctgggctgggcttggctgggctgggccagggccaggacaaaatttggaaatagatgttgtatacactctaagaggcccttaagctttagggaaattaggttgagaaattggcagagcaattcagaagtgctcaggctctgtcctcatcagctatctgttgggatttctaacagataacacttctgtgaaatggaaggcatacttgtgcagaaaagtggagaggtgcatccatgcagcttttctaaaccccggaggagtctcctcttgagagagagtgagaaaataaagaggatgggtggatcttggcccaaatgataatggcctgtgatgtccagtagaccctcagtctctctgatcttcgacagagaccacctttgtgatccagctctccctgaagggctcatcaattcacccttccttctctagatctctttattgcttgtttggggcggggagttggcggggggggcggcggtgtttcacactgtcttgggccattgctgactttaatatctgtcccactgggtagcagagaacaataccgaaacttgtattgccaaagtgacaaagaaagcctgttagtttattaccacttcaggcccaagaggttaacctgacaacagataaaccgtggaccaagaaaataataatgaggatgggaaaaagtcattccattattagattatttatctattttggttttatttaaatcagactaactgaaattactactcaacaagagttgaactaagccttaaaaaaaaaaaaaaaaaaggctgggtgctgtagctcacacctgtaatcccagcatttgggaggcgaggccaaggtgagtggatcagttgagcccaagtggagaggttgaggtaggaggatcacttaagcctttgatttcaaggctgcaatgagccatgactatgccactgcattccagcctgtgtgacagagcaagaccctgtctcaaaaaaataaataaataaataataaattaaaaaacaaaaagtatgtaatctaattgtattttccatacaacttgaagacaaaagtggatatggtatgcttttctttctcaaaaaatgggaacttcattaaaatagtctcaaacaatgaggtagcactgcagcagtccagcagaccatgattcttatctcagctctgccaactttgctgtgtgaccttaagaaacttgtttaacctctctgttccaaccctcatctgtaagatggaaatattaatagtgcctgcttacctcattgtaaagattaaatggtaatatatgttaggtgcttggcacagttcacggtgtaagtgctcaatgactgaaacctattattttcttgcaacccaacaccaagattgctgtttccttcgctatataattttcttactagtcctaaactcacacgttaacttaaacacacacaatttataaatttggaaaaaaggaaaagaggctttatctcttgcaaagggttacagccacccaacagggaagagtgcctcccaccaagaccagagacagttactttgaaggagaagggtttggggtagagcttcatgctgaacaggtttgctaaacatacacattcgacaggttacaggaggagctgtgaatattcctgaaggttgtcctgacacatgcatattgaacaaacatatgtaaccacatatgaaccctgttcactttggagtggagacctaacatttaagtctatcacacctaggctctatacgtcaaaaagtcttttcaggacaccaagacactcaagtgtgtgatcctgctaaactggccaggagcagtccacggttggtggtcttatctggagaaaattactgaaatcagtctcttgtccaatcaaagctgtagttacaactggtggaacaggggtcaggtagtcagcctctgtgagctggatgagctgcaattgttttaatattgcttatctcaaggccagtgttcatctagctgctggagaaaaaaaaaaccttgtggcagaatataacttttattctttaaatgtaggagtgtgtaacttaacccttgcctggcatggccttaggtcttgtttataatttggtatcttattgcacaaagaatctgttgtgtcattcttatgatctctattttaactttaatgctggtaagttgctgtctctaaacctgaaaacacaacgaatataacagggcatgtcagacctcccatcttgtcatggccaggagctcagttttaggatttttctggggtcccctaggccaagaggggctctgttcagtccgtgatgggcttaggattttattttgagttgacacacagcagtttatttttaacttttagattgttcttctagtttatggagcatggtatacctgagaaccagagtccagaaaacctagggatgtaaatagtgacctcacaccataagtcctactcaaatttataaagttccatacacttggaagaatccgtcatcaatagccaggcaggtgtctgtgagtatagttataatcgcctttgagctatttgcattacgaaggaatggcatgaaaacatgaaggtatagaagtaaagatagaggactgattccaacccagaaaaaggagttctgatttagggtaatattttggagaaattgcttagacaaggataagtactgtgccacttattgcaaagtatactgttcattcaccactattagtgtgactgaatttctttttttggcctgcttcattcttcctcccttcctgcttatggttaacatagactggccctcattgtctcatgtcctctgcctttgtttccaaggcaaaaagccctcccacgtttgaggggagtcatgagccgtttcctgaatgtgttaagaagttggctggttatggtgtccatcatagccatggggaacacgctgcagagcttccgagaccacacttttctctatgaaaagctctacactggcaagccaaaccttggtaagaaatcaaagaatttctgcatcctttataggacttataggactggccctatgctgtggttcccaaaccaggctgtacatcagagtaacctaggaaacgtcaacaaacacaggtacccatttccctcaccaaacctatttattgaacctgggtggagctcaggaatccagttgctaaaacacttcccagatgattctgatgctgccttagctagcctttggcagctactggagtaatagactttgtggtgagcacttgaccctttttcccccaagcttctctgaatacttttcattgattttacactgccctgggcaattcatgtatttaaaaaaaaaaaaaaaaaagcattataagggcaagtgaggaaatagacttacttggtgactctgtgatgcctgacaagaaagccataaagaagctttacatatatctcaaagccctcttcagaatcaggtttacatgattctggggcttacatgactcatattccatgttacagatggagagttattaattcaaggtcttccgtgacatagtccctgagaaggtatttaaaatcccttcaagttggtctcccaaaatgaaacttaagaaggcccatggcagcctttcctggcttcctgagcctctctactgagagtgtccatttcagcttccacttcatcacgctgatgtgtggggtagtttaagctgcagcactgtttcacagcagatgacaattctgtgtcacatttatagctaacccagattcaggctctgacctagctcgtttttctgcagtgtctgagtataaaatgaaattaagtaggctaaggctcattttaagaaagctcaaatataataagagtaaagaacctgggaaagtgagcagaataattccatcttttcaccttcaaatgctgccctcaggtggtcatggaaccctatatagattcacacatttttagaggtcatctggtctagccctttgagtttaaagttgaggcaaagaggtccagaggtcatgtgacttaaaggcatatagctgagcagaactttatgtgtgtgtgtgtgtgtgtgtgtgtgtgtgtgtgtgtgtgtgtgttcagccagcacggaagctgaggctgccatctcccttgtgatctaggggccttcatggtactcttctgaaagtagcagtgctctaaagtgtcccacagaatttcacctcatacctaatctggttagggctggttgagtactcttaactagagaaacgtccttagtcttctcattatcaaattggtttataaagaatatagctatccagggctaatgctagatatttggttggcatatggaattttttctcactaccatctaatggtcttcagtattgtgaatttgggagagctgtctgattttccaaaggctggaaaaatccttaaagcccaagtaaacattagtagacttttcagttgtcaattttgtcccttaaaatttatcttactcagcaggtagtagaccagcaaaggaagtatctttgctttcactgttttggcatccccgagccactggatgccttagctcaatggttttgcatttaaattacccaaacagggagtttctagaaaatacttatgcctggggccctcctccagagaatacgatatagttggtctggtacccaggccttgtaattttataaaactacctcagttgattgtaataaatgcccaaagtcaagaaccactgttatggtggaatatgacctatactttcaggacaagatatttaatacagcaatgtcagaacaaagctaccaacagcaggatgcccccagcaaacaccaaagaaacagtgctttgtcccactgccatgcacacaggaaaccaacctggtattggttcatccaacagcatagatctggatgcaggaagagacccaggcactcacatatcttaaagaccatatatgggcatctaaattggtccccagtatctctgagttctctcctggatcagccttgaaagtctgctggcctcctgggcatcttgcatttccagatcagtctctacaacattccccaaaacctgtcctgatccagaccctctaggcttccaggacaaaaggggtaaattactatatctaggagttatttgcctaactgggctctttgtgggtttccactcttggaacttcccttccaactgtagacatttgaagagaatctgagaagttctcattctggaattccttctattccttctagttcccatgttgccactaggacctccatcctgcccagccacagagaggtcaggtccagctccctatctcccatgaaccaccagtgaaataggaggagtttggaaggaacctcaagtctccccttctgaacactcttgcttttttctgctacacagtgaatggcctccaagctcggacctttgggatctggacgctgctctcatcagtgattcgctgcctctgtgccattgacattcacaacaagacgtatgtaagggaaggaagagctttagcatccttttgttggaaatcagatgcgaggcatacctgttaccttgagtaatgggaactgttaatcattttaatgcattagcttagaatgtgaataataaaaaactcacaggttacattccctccaagcctagaaaacatagtagacctaacaggtcttcattaaagtctgaaaattctttggaactgacatagcaaactggcaggccattatccagtggcctgcatcatgcccctccacttctttatgaaagaatcagcccttcttctactaaagaagtagagtggtatgctctttttagagtagccacccacacatacctttctcacattcctccttaagaagcaggaatgaacagaaatcacaatccatgaaaaaagaggaacccacaagtaaactgttgtatgtgtatgcagcatcagcaggtgagggtgaaagagaagctagggctcctgaatctacctgtcttgggtactcaaacagaccagggtggaacaattgcaggcaatcagaagccataaccagtgctggccactagagggggctcgagctttcttcccagcgggagtcatcatcacactctaggtggaaacagtttgttcaggtcaccgagggaggctatctgaatgccaacttcacattaaaatgtttttctgtcttatccaggctcttggcatctggggaaaacaggaggcgataatatttattgagcccctcttattatgctgagcttttatctacgtgatcttgattaagtcttttcttagcagccctggaggtcatgattttcattcctgattttgcacatctaaatattagagatacagttagtttaaagaaagactgactcaagtgagatttgaagcagggctattagccgtttgatctcttcaaccttattttttttttttaattttttttcaaacttgaacctgcagtttacttgtcctagaatgacacatacttttggaagcagtgtgtttagttctgggcccagttctgttggtaactagctttgcagtagcaagtccattattcaccttccttgcaccttggcctcttcatccataaaatgagaatagatatctgttctacctctcagggtgactaagaggaagggaggattgaacaatcattttaaagacctgtaccacaatgaagaattgctgatgagtatgagggatatatcttttgattgttgtgcttttgaagtgagcgaagacaacccagacttatctctttttttttttttttctgagacagtcttgctctgtcacccaagctggagtacagtggcacaatctcagctccctgcaacctccacctccgcctcctgggtttaagccattctcctgcctcagcctccccagtagctgggattacaggcgcgcaccaccatgcccctctaatttttgtatttttagtagagacaggttctcaccatgttggccaggctggtctcgaactcctgacctcatgatccacccaccttggcctccaaggtgctgggattacaggcttcagccactgtgcccggcctgacccagacttatctttacctcagttaccatttactttcacctctccccacacaggacagctgcaaacgctgactcctgtttctagacctttctagcctaggactttgatcgatgcacttctgatgtgcattctgatcctattccctccctaactagagactgaaagtcaacacacatacatattgtttccacaatgggccaggcgcgggtggcttctgcctgtaatcccagcactttgggaggccaaggtgggcagatcacttgagatcaggagtttgagaccagcttggccaacatggcgaaaccccatctctactaaaaatacaaaaattagctgggcgtggtggtgtgcacctgtagtcccagctactccaggaggctgaggcaggagaatcacttgacccaagaggcggaggttgcagtgagccaagattgtgccactgcactccagcctgagagacagagcaagagtctgtctcaaaaaaaaaaaaaaaaaaaaaaaaggtgtaaaaatatgcacaggagagatacaaatcaaatgtaagataccagttacttgtggggatgagggagaacagacttagagcaggataagtatacacaggatgatttaactcttctctgtaagtttttattagaagagtctgaaacaaaatgtcaagatgttaagatctgagggagctgggtgttggttgcattggtgttcattatagtgttcagtaatttttttgtatgtttgaagtatttcataattttaaaaaattttatactaaaaagatatcagcaaacaaagtggtcagtcacctagtagcctgtctcttctctaccttatagtcaaagctgaaagataagttcttttcccatgaggttgtcaccatgtcctcaatgtgactacttttctaggctaaggcacaaagtaaccaacgtatattgcaagagcatctaaaagccccagaggtgtccttgctccttactccccatgaggccgttcgttctgtggcatccatcttataaacaccgacaagtgcatggccagatgcctgccaggtgggattagactgcagagtcaaccaatttggataaatagaatatgtaagcgtgctggatccaaagttgtctacactgcctgcgattgtcatcattcaggctctgctttgctatagctgagttcaccactttgctgagacctggacgttcattctggatgcctgaaccattctcctctcagtttagcagttgaaaccttcagttttgccctagatgagaatatcgttgtgatcaaataaccagctcttcctcaggaacaagtgtcctttcttttaagtcttaatgacatcctgggttcttatttgtctgtatgaagtctgatacttttcctctgttctgaacaaacagtaactttggttcccatttctgtctgcttccttataggctctatcacatcacactctggaccttcctccttgccctggggcatttcctctctgagttgtttgtctatggaactgcagctcccacgattggcgtcctggcacccctgatggtggcaagtaagcatccaaccaccctagacctcctacaggagctgtgccagctctagagctagtacagagggtggacacaggagagagagagaagaaaggtaccgtatgtatgttagtcactagtctttcctctgtatttaaggtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctctgctctgatcagttcttgtactttgacctctgctaagacaagagcatggctgcctcctctgagccctaggagaatcacagctttatgcctgattgaatacaccatagtgagtaggacagctcatgacacaggtcagcctggctgcctccggctccttactgtcatttgctcattcctcttgtattcttgaagtcaaatcttcttttttctcaccttcaagagtctgcgttcacaactaaacactaagtgccctttcttatttcctcctaaagaagaaacagattcttgagagagcagagacaaaaaaatagaactaggcagcatagatgaaacaactgcatgacatgggaagaagacaactaaaccccgaggagaatgcactggaatggacagttgctcttaaaccctacccagagggcctcccccagctggaccctcatacacagtgtgtgtatccaaaaggccattgctatttcagcaaatatttgttgagtacttctccatgccggacacttgggaaagagaaatgaacgacacaggcaatgcccctgccctgtgggccttatattatagtcaaggtaacagaatcaacaagccaacacaaaaataaagaacttcaaatagggataagaactctaacaaacacaaggtattttggtcaagaaggaatgtggggtgggcagtggggaacgtaacttaaattagatcatcagaaagtcctccctgaggagatgggatttttttgttttttagagacagggtttcactctgtcacccaggctggagtgcagtggcacaatcacacctcactgcagcctcaacttcctgggctcaagtgatcctcctgcatcagcttcccaagtagctgggactacaagtgtgtaccaccacatccagctaacatttttgggggtgggaagagatggggtcttactatgttgtccaggctaagaggtgggatttgagctgagacttgaatgcccaggagttaaatgtcttaagatatggagcaggccgttagaaaggagggagcagcaactggaaggtagaatagtcttattcaaggaataagaactatgtaatcacagcatggtgaagagttaggaagtgaaagaaaaggtcagaaaaggaggcaaggggcttataagggtgtgataagaagcttgatgtttacacttaaatacattgggaattctcttatcagttaagtctctttaggtgaaaggacaaaacctaccttaaactagcttaaacaataaagatagctggctcatataactgaaaaattacaagattagcttcaggaagggtttgatcaagactccagctccatttctttacgattctttcagcactacctacgtgtgctggcatcctcaggctgacttcttttatggtaccaaagttggttgcagaaattccaggcctcatatgcccagaacactgtatctagaaaaatatctcaatggtaagaactatcttttctttacttgtcagctatattgttaggaggcagtaaaaaagcagtgatgacagttaatgtttgaacacagatccacatgaagaccttatgaaaggagtgaatgaaaacattggatgatttaggtcctctgagcatgtgtcatgaaaatgtgatgccctggccgggtgtggtggctcacgcctgtaatcccagcacttttgggaggctgacacgggcagatcatgaggtcaaaagatcgagaccatcctggccaacatggtgaaaccccgtctctactaaaagtacaaaaattagctgggcatggtggcgtgtgccggtagtcccagctacttgggaggctgagacaggagaattgcttgaaccaggaaggcggaggttgcagcgagccgagattgcgccattgcactccagcctggcgacagaaaaagacaccatctcaaaaaaaaaaaaaaaaaaaaagtgattccagattagtaaaggcagggacccaaaggatctaaagagatgtacagttagagtatttagcagacactatggatattagatttcttaacagcccaggcttgggtcccttcctagatcatttaaaatagaatcataatattgttcctccccagctacgagttgctataaatatgatgctagaataccacaggcacagtacaactctctatggaaagaatgtacagaacacagatgatagtagcagcatattcaagtaacacgcacaaggtgatcacaactggggagggatgagtaacaggacgttggccagttaggaagaaaaatggtaacgcaagactgcagctgctgggactgagccatgggccccagccacagcaagctggtgcatggctgaggtaatcagagaacaaacatttcaaccaccctttgaggcagagccagaaacaacagtggactctctcatcagcagtcactcacattccagcgcgtacacagcatggaaagaggtcagggtcgtgctggatgttgagttgcagtccctccatgtaggcaaacagtaacctttacagccttgtctttaaaaaatatccctcccagatggtaaggtctggcaacagtgagatgctcctgtggaagaccacagttgctgcttctctagcctcacactcccccgccccagcccagcccttccccacacctaagacaggagcctcaggaatgtgtgacagtcttgcagggacttctaagagccatctctgccccactgaatgataaggcagaccactttctgagaagtttttattgcctcgaaatgtcagatcttacaaatagaaaacacaaattatgtttttaaaataaagcaataggtttggtaaacattttgttaataccttttgaagggtttatgagtaaacatctttctctttatcaaaaagtaaagcacaccctcacctctcttccacactgactcactacttctgccgaaaacgtggacttctttcttctattacatacagcatgttccttgcatccattgcttgaatctgtacaaacacacacacacacacatgcagacacacacaaacctggctcctctcaggcagtggcccaagcaccacagtattgcagccagcacaggctgccctgatatgctgaggccagggcagtggct

SEQ ID NO: 13352 - DNA, 17032 bp, Human; identical to SEQ ID NO: 12476

SEQ ID NO: 13353 - DNA, 124110 bp, Human
tttattcctggaaggctttttctttattttctttctctcactgcacaagttgatctttttgaaaaatgagtgtttgccaaatctagtctgagttggaagggaaggtcggcgggaagggtgattacttaatattctgactaagaatactagcaactgatttccaatatagaggtaggctatatgcctggtgaaacaattaaattataattacactgattgatattataaatcatgctttgggaaaatgagtttttaagacttgtgatgcctagtctcatttttatttttcacatgtatcttagaacaaaaatccacacatatggaagatagtaagagttgtttcttcctctagtgtggtaaatttttactttgtaactctatgctgtgctctagagacaaatgaagcaaattcataactttgatgatatattttaaaatattgagaactgtagcctgctttatctaggatgttttgtaaatgcagagaaactttttgtcttgaagtaattgatttgactttgtttcttagtttggtttggatgttaaataagcaatgtcaagaattttagccatttaaactatttctttttgaagtggtatttcttaacttactttcaacctgcactattgctattctttgtgatatctattttacaagggtgttgcatgtatgtcagcatttgcatctgctactgtggcatcctacatgactattaataattaaatttcagtaaagcaaatattaaatagcaacatcaagttttcgtgcaataactttgtataagaaaatgatgcgtacaataagattctgcaaaccctttcagtattctgcattcaccaataactgaagacttctaagaaatatgacttttctttatacattcagaggaaatatttaaaaagaaacaagaaaccaggcgcctctaggtagagtaaaggaaaaacattaaaatttcataacagctctagaatttgctcgataaatttacattggtatcagcatactatcccagacaatgaaagtattgtgagccctaaggttaagtgagagcctgtaaggaaaattatagctgcacaaaaacattgtagacttccaaattttaaaggcattaaacattaaggataaacacatactttgctcatttccttggattaagtatggtattttagaaaggtgtgcattttccccattttacccatcaaattttaaaaactcaaatttcaatctgcatgtagtcatgacgatttgatttgtgtttatttgcatgggttaaaacaagtcaaagtattgaatacaatttatgggaaatatctaatttgtaagtctgtgtatatttcaactgaaataacttaaaagttatgaatcatgacactacatcttaggatatttgtatttcaactttctgcttaaaattttaatacttaaagacacttaaagctaggttatctaattactgttattgaattattacaactactattttggcagctagaatatatttattagtgattaattgtctgctgtattttattttaaaaggatctggctgtcattaagaaacagtgaattaacctcaatttacaactcatccttttattttttaagaagtgcattttaatgacttacaaaaactagaaataatctcaaatacagaaccgagattcatcaagctaacttaggcacaacctgagacttaatacagaagtgtattaagtacatgtcactgaaaaaagatctaaagaagtactatgtaaaatggatggcaaaattttcagtgtactacttgaaaactgccttttatttcccctagaatttgtatgtcccatgcatcactgtttcatgttagatgcgtggttataaaattgtgaaaatggagacttttctggtagcaaaagggttaagttctttttgctttaccagtttcaaattacaatgagaagcctcttctttcccagcagggttgtgcttacactactctttagatctctcttgaagagggctggtatatttgtgcctgctggaggtggaattaacagtaagaaggagaaagggattgaatggacttacaggaaggatttcaagtaaattcagggaaacacatttacttgaatagtacaacctagagtattattttacactaagacgacacaaaagatgttaaagttatcaccaagctgccggacagatatatattccaacaccaaggtgcagatcagcatagatctgtgattcagaaatcaggatttgttttggaaagagctcaagggttgagaagaactcaaaagcaagtgaagattactttgggaactacagtttatcagaagatcaacttttgctaattcaaataccaaaggcctgattatcataaattcatataggaatgcataggtcatctgatcaaataatattagccgtcttctgctacatcaatgcagcaaaaactcttaacaactgtggataattggaaatctgagtttcagctttcttagaaataactactcttgacatattccaaaatatttaaaataggacaggaaaatcggtgaggatgttgtgctcagaaatgtcactgtcatgaaaaataggtaaatttgttttttcagctactgggaaactgtacctcctagaaccttaggttttttttttttttaagaggacaagaaggactaaaaatatcaacttttgcttttggacaaaaatgcatctgactgtatttttacttaagggtattgtgggtttcctctggagctgctgggttctagtgggttatgcaaaaggaggtttgggagacaatcatgttcactccagttttatttatagaagactacggaaccacgaaagacgggaaatacaaagggaaattctctctatcttgggtttgcctcacagacccagaccattttcacctggaaaacaagcgtcctctgcacctctctttatgctggatctctacaatgccatgaccaatgaagaaaatcctgaagagtcggagtactcagtaagggcatccttggcagaagagaccagaggggcaagaaagggatacccagcctctcccaatgggtatcctcgtcgcatacagttatctcggacgactcctctgaccacccagagtcctcctctagccagcctccatgataccaactttctgaatgatgctgacatggtcatgagctttgtcaacttaggtatgttgttcatttgtttgttaatctatgttattacaaagtggaagttttccctaatggtaaaggagctgcttggtaggtggtcatgtttatataaagacattttctctaactctcctgtttagcttctgttttctttctttcattgatgccttaggcaaaaagtcatatatatatatttaatatgaatagttaaatttaaacacttatagtgtgggtcttttcagatcttgttaaaatttcaacctcgcttaaatatatgaatgcaaaggcaatagtctaaaaacagggaaatttatgaggatagctatgctatgggcaacaataaaaaaaagaagcacttacagatgggaaagtaaaagtgacattcggaagcactttttttttaagtgatttaaagcacatgtaagtatatattcacatactacttaaaaatctctcatctaggggaggcaactactgtaaaaatatagaggtaaaattaaccaagattgaatagcaccataaaagattactatcaaggaatcaaggaagggattctgaaattctatagtaaatatttcagaaataaagtttcaatctaacagttcttaactgtaatgagtaaagtatgttatagctacttgatttttttcacaggcaagaaaaatgtaaaacatgctttagtggtctttatctatacaaaattttccttctatatgagataaaatatttgaaattttctgtaaaccacaacaatattaatgagaaaattttaaaattatgttttagttgtagctggtacttcatggtggtttttaaatactgataatgtcaaatgataatttagttcccaatattccctctcacaataatattatggattaccaatttcaaattattttataagggctgttgttttctttaaatgttttagtaaaaattgaaggtgaaatttactatctctggcagtcaaaggaaaataacatcgaatatattttatgtttgaagattaaaaactctatcaacaaatttaatccactgggaagaattgagaactttatgatgttatagcttttagaactttgttttaaaaatgcaatctgctttgacttaaaattaacatgttttattaaacacttaattaaaaacttcctcatgtaacatctcaaaggaaatattctttgaaaagtcagattatcaacaaatcttaataacacatggatgcttttataatatatgttgcttaatatactctgctcatttgctcttagcaatcctagcatgaaggataaggtacttaataaatcgtacgttttatgttgctagagacaaaggtctcattattaagtgagtaagtcataatttgttgcactaatcaggtgtcctggaggccttttcttctacgtataattaacagacttcacatggaactttttagtcattaaaatatagcttaatttcaaattaatgtgattgcttttacctagtataagggatatgcaagtgtagcttgtggtacattttgctttgtaacatttctaaagtattattcaagaatttaaagtagtttaaatattttaatagaaaaatttcaacctagcaaaatttatatattcataaaccattgagaaaatcaggtcatatcatctaaaatctgacaaagaagcatatgtatgttacatattttaataaacgatagctcagtcatgaatgtcataatatattttattagaattgctctgatcattcacaagagaagtgtaagcatgatttttggatttatgtgtttactttttataaatctacatagagtaagaaagtcaaaaccaataatagttttattcattgattcctataacttttttattattgagaaacacatttaaaaataaatgacattttggttacattgttcagattataataacatagcagtttattagtttattgcctatatgaagaaatacaattattcatttgactctagagaaacaatattagctataagctttagagaaactgtgtgtttatttttatcatgcttgaacttctgagtagtgctttatattcaataacaaactatgttgtttcttctttatttaataattccaaactaaatgtcttacatgaaattactgacaaactgattctgatactaggtgagtttttcttggtagactttaaggaaaattaaaccacagtttaattatcctttgatcatgccttcaaatacattcaagatttatagttgatcactgcttagtaaaaagcttcaacttttgcatttcttttataatcaaataaataaataagcatactcagaaaaggtgaaagtgtaataacattattagctgcaataagagtgccagtgctttttaaatgtaatatccgttagcaaatattacctgtagtttatttcatgttcttataagactaaaaaggattagattttattttttcactgtcttaaaagacatgcatatagttgagactaagtacaaatgagtcacattagtagtaggcaagggatttgtattgaggaagtcacctggatatttaaatatgtgaaaagaatctgttgacatttcccataattagaagaattatataaaaaggatctagtagcatccttttaaaaaatgcttgtgtgttgtccttttcaagtcaaataatggattttccacaggtaccttgccattcagaaattcttttttcaacatagttttggtcacgaagaacaattaaacttaatccaaactcagaatcatgtttaacagaatacctactgtttaaaattcagatgagattagctttatattcataagtgaaaaatagatttgaatttactaaaagcaaaataaaaagtaaataaattgcctaaggcatgcagacatctgaatatgaaaccaaacatatcattttaacctttattttagtgactcgtttattttgaagaaacaaatataaattattaactgtgtgaagagaaatattccttcgatcatattcattattcttaggccacttttatcagtctcatagtattaaattttacagattgaattctttgctttttccctaaaactgttgaatatcagtggaacttttgcttggtcaatataatattattttgttagtaataaaaatgtttttctgtttagttttattttcttttttaaccatctctttgtcaaaagtgctaagtgttagtatatgtattaaataccagtacaagttaaagacatgattagataatttgcttacaatatttatctcttgtttacacaaataaaacatgtagtgtatttctaagatcttttagttagaagccaattttatttgattacttggtgacattatcaccataatgacataacactagatgttttagaggaagtaaaaacaggaaaattacttttatattattctttgtatctacatattcctctggaaaaagttgaactttgagtttattaatggtttttctcttagatgtatttcaagaatacgttttaattccaagcacaaaagtatttaaatgtgttgttaaattttttaaatataaaaacatatttagtctgttatcatgaaagaaaaacgctttcaaaaactaaaccttttttgcctacttaccctaatcattaagttctcttggtactggaaggaaaaaatgctttatgttctcagttgacagatttgaaagacatcattgataatttattattgtttttggctgaatcaagtgcccagtggaaagtaatttatatacaaatctacctaaagatgcctatctatgtagtctctccaacagagttattaacacttgtgtaacataaacacacccataaacacatggaagttttttttgaagggggatgggttggaaggaaagataatataaagccattatagtatatattcataaattatgcctggagtaactaatgctaataatgggtaaagcaacaatcattctgtaaaagttttaacttttgaagagaaaaatattgctgagtgaggagacctttttctctcttcttcaacaacacttcacattcataatcacgaccaacgggattctttttctcctttaaagatggttgattatcaagtgattggcatgacagacaaactctgggttgccagagatagttataatcatagtttaattaaatgctttttttttttttttcaaattgtagtggttactcacaaatatcaaattttaaaagtttaatgagacgtattagctggaactaagaaggacttgggactgcctcagctgccacctctccttccctttcattcttccattttctgtaatatcaccactctccctcctcccttctcatcccagtattttttggcctttcctccttgttcttggtctctgtagccccaggctctcttggcacccctctccttaccactcccacacttcctggggtctgcctttcgtcctggtttgctagaggcttaaattagttgaaaatcaattagttacagtttgagaattgaggtacactctcctgttttctctccagttgagaaggaaaaggttatgatgtgccaactgcagcctccacccactgggagaaaagctccccagggcatcagagctgccctggctcttgccatcccctgtaattgtttctccatcatcccattcttctttgcctcctcatctctccctaaggatcccattgacagaatttaattgtgttttgcctttattttataaaataacatttaaaagggaaaatttcaagaaaagtaaaagaaagaaaaagaaatcaacaatgaacaaaaataacactcatcaaacatgccattcctgtttagtttataaaaagcttttgtgtttattatccttatttaatattctgtcacttccatgaagaaattatttttttttgaaaagagataatgagaaagaataaagagacgaagagtgagatatagaggcatacaggaataaggatgagacagagaaagaaagaaaatatttttgaaaaagagcctgaaagaaagaaaaggaatgaaatgagtcattaaaggctggtttttcagttgtacaggtggaggagatgctgggaaatcctcagtctacctcataccaaacagcagctaattcaacatccccaaccacatcagctcgaggggaaaaccctttcatccttacacactaaaataccgaagtggggaaggagggggttgtctcagtatgtgtgtacaaggagcatacagacaagctactcacatttacagtcataaataatgtagtagctcagctttaaaaaaccacaggttaaaggaagaggcttccctgacgcacaggagaggggctgagatcagaggaaccactgaaagggttggagagaaacaatgaatcccttgttctaagtaatatttatgagtgcttctttgcaccttaagttcatattttattggctgggccgtggggtttccccatttgctcatctcttaaaataatacccttggctaagatatcctttaaaacacactagtcagccctgacaaacagctcatttatttagaggaaaaagggatctgttttgattttgatgtcagattgggatgtttaagattcagctcacaaagtctgacagtaagataaaaataatggtggagtattcacctgactttttcagagatgtttaaaacaatctgcataaccaagtagtagtaacacctagtttgtatgagtcttgaccaagaagctgtggataaatgataattttaaaaggcagaaacaaaatctatgaaaatgtacaatgtttaaaaagagaaaaaaatactatttgtagattagtaagaaaggtctttagtggtttggggagaaaaaaacaacaaaaacaaacaaacaaaaaaccccataaatcaaaaagaatgcattaacctcggcttggaaggcagtgaattaaatacatattacataactcttagaaactaaaaccttgtataattctgaatagttggatgttgaaattaaactggaggttgtgctgttttatgacttctaagacaatgaagatccttgtcttcaatattgtgtttgttcaatttctttctagaaaaaaaattagcaacttttattgttcttgttaaacaggtttcctggagttgttaggaataaagaaaatagttttaaaatgtcaggatcaacagatgtaaatcctatttagattttattcaggactataacacatgtctaaatcaagaaaagatttattaacatgtacaaaatccttcagctattttaatgctataatgacatgaaaagttcaatgttatttgttgttctgactctgtgattaccctttctatataggagacacagccatctccagaatcttcagttcatggcatattactgctcacatgactttaaagttcaattataaattaaatttagttgctttcttttctgtgcttccatggcagaaatagagtagtatacaggaagccagaatgcttggattggaatcccatattccacgcttactagcagcgtgaacttgagcaagttatttaaattatttgtgcgtctggttgcttatctaaaaagtgcagataataagatcaccttcctcgatgaatgttgagataatctgcatgagcagctacataatctgtggaccctgatgcaaatgaaaatgcaagccccttattcaaaaattattaagaatttcaagatggtggcagcagagtattacaccaagagcagggcccttctaagcccgggaccctgtgcaactgcgcaggtcacttgcccgtgatgctagtcctacatgtttgattacatgttgtggcaacagaaaccatgtcccattcatcccttcccgcctgccccacccactgagatgtatcagcatttccagaagaaaagagacagaatgtgcaaactgaattatttaggagagtttaaatgatgttataatgtttatagtgttgtgggcagaggttttgttttgttttgttgcagcaaaacaagggatcatatagtatcttgggatggcagggtagccttcactactcctgggcagggggcatagttaccagaaagctcagaggagagatatgtggggaaggtgccctgacagaaactgtggcattgggagaaagatgccatgcatctaatccttagatactcagcgggggggatacagataccaagggataaatacccagaccatatgctttggtcttccattggttcaccctcactgaaagccagagagccacagaacccattggtgcagttcctaaaagttagtcttttggtgagaatagcagaatagggaaatgtggagagtggatcttgaggtacaaatggaagatatttggcacaagtagataaataaacattggttgtttagtcagcaagtgttctagaattacttcaatttcagtgcaagttactgatatatatgttaatctttgtattatttagttaatttatagtaaaattcaagagagaataataatttagtgtgagagataattacttcaggagttggtgaaataaagtggtaaatataagcatggcatgctgaaagaaaaaatccttaaattgtacatgggtcaataatttcaggtgatatattaaaaccattttagagaaaattgaaattaagaaacaaaaattacccagaaaacagaagcccctaaaacaagaaaaagcagcactttcagatcacaatatgaactgcggactgcaattgccaatgaaaaaattcagtatgggaacgagaagaatatatgcaagtatgtagagcaaaatgaagagcaatatatttttcaaatccctgtttattgtcaattgtatgccatacctcctgagatgatccacgactgtgtgttaaagcttttttgaattctgagtggaatcatatgatattctcacatgcagcattcgcattccatagttaatgttgcaggcataaataatgttagaatgaggtagatagggattattgtctttcttctttgctacctttattctcctctggcagaccatctgtgactcagagaggcagaatttagtagtggagcaggtatgtcagctatttagttctcataaataatcaagcactaaaccttgaggccagagccactccctgcccttcaatcacagagaaacactgaatagaacaactcctttccagtacagtttgtgttttccatcaaatttgctacagttggaaatttcacttatataattattaaaagaggaagagagggtgcaactcagaaactgtgtaggctcttctgcaaataaccttgatgcagacacacaaaagacttatttatctagtggggaagcaatgaaggttattaattaaatatgctttatgtcaaaatttttgtagatgtattctttgctctgggtgaagaagggtcatttggttctcccttaactgttttagtagggtttcagtgttagggttttggagccagactggtttgaattccagctgcgtatccttgagcaaaccatttcacttcgttgaaactatttcctcatctaagtggagctcataatacagaattggagttaagactgtataatgtaaggtcctagacttttgagcctacatgagacaaatactaaattaatggtctcaactgctattacaactatttctactagaatatactatggagatctaatgttagaggaaatctacattcagcctacaagactttgtcaaataaatgccttgctgaaattctgaaacattatgcacataatttttcctctgtctaaaagaaaaaccttgaatttcattgactctttcttcaagctggacagctgatggactctgttcccccactagagtgctttggaaaaggtcagtctatgtcagagccttcatgagacggactgtggtgctttcctctgaggacccaaaagcaacattttctgtgattagctgctgaaaggtgcttttcatactacctttggtcagagtcctagaactattccatggttttactttaattttagatattacctgttccatttccttgcttgttaaggaggggaaactaattagaagccaaggtagtaatatacaattagaagatatttgattgtaaagacatggacagtctataaagaaccctttgaaagaatgtaaaaaaaaaatgaaaagtttttaatgcttattttcataagtcaactcactttgagggttttaatttttaagaagttgattcatgatgaaaatttaggtgtataaacttttaaactctaagcaggaaagtcactctgttcaaataatctttcaatcctggagctttcagtattgtctgtaactcaaatcatgtctgaatttatgatttataatttgcagctattctcattactacttaaatcattattataattttgtttctacttaataccattcagccttaagtattgtgactttcctcgacgatttgtttgggttttttttttcagatgcggctattaaatatttttgttaattatcttgagttgttataataacttataattttttaaacaggatgaaaatgtatttgtttggtctccaaagccacacaaaaggccatacataaactgtggacatcttctattacaggatgcacattgtaaaatcatcacattgatttttgatatttcattatatattgagtgggaaaacatagatttattgttttctcattatttgataaaatgctggaagataagtcattaatatgatgtctcagtctgtttgtgttgatgtaacacaatacctgagactgagtaatttataaggaaaagtttgtttggctcatgattcaggaggctgagaaatctaagatcaggcagcccattcgatgagtgtctcatgctgttttaactcttggtggaaagtagaagggaacgtgagtatgtgcagagacacacaagagagactggacttattacagcctgctctcaagggaactaatccattcccaggcgaccaataactccctccctcccacaagatgacatttatctattcataacggcagtgccttcataatccaagcacctttcacaaggttccaattccaaacgctgccatattgggaatcaactttcaacatgagcttaggagaggacatactcaaatcgtagtgataattactgctagatttttaattgtgatgggtagttattaaaataagtacagattccagctacatatttattgatatattcgaaccaccatttaaggtttttctctttacactttacattaaaagttatcattcttcagtaatttacattgaggaataattttatttatcagaattaagtgagctttttttttatatgtgtgatgcattcacggttatgcatctttaaaaatgggggtgtaccttctgagaaacgtttctttaggtgatttcatcactgtaccaatattatagagtgtacttacacaaacctagatggcatatcctactaaacacctcagctagatggtaaagcctattgctcctaagctacacacctctatagcatgttactgcactgaaaactgtaggaaattgtaacaccatggtaagtatttgtttattgaaacatatctgaaaacacgtaattggttgtgctacattatgatggctatgatgtcactagatgataggaatttttgagctccattataatcttatgagaccagtgttatatatacaatccatgttgacctaaacattgtcattatgtggctgcttatcgtatataaaattttcaggtcttagtatggttgtagcagtgataattaaaggaataataacaacaataaatgtagttcccatggcagagactggactctgtgatttttatgcgttatttcaatttatccacatcttaattccataggtaaatatatttctgccaatgtattgatgtaaaaattgagggtgttctgagggtaaataacttataaaagtcacccagctagtgaatggcagaatcattactggagccatgctctggcgacagtttttatattcttcaccattattctttgctttgtaacaaaattttgaagaagttaaaaagtatacaacttttaacaacaacaataataatggcttatattttttaaaagcatctttatatacgttatgtggtttgatctaaattaccgcagtatatagccctcaaggaagtagatatgatcccacaacacacatctatggaaactggagttctgaaaggtcattcattcagtcatttaacaaatataagctgattacctactattgggccagacactgtgcgaaagactgtgcctgttttactgccaaaatcacagggcaaaggagccaggtccaggcccagaatccttcattcttgtgccaggattttttttctttgctcaatgtcacatactttaaataaatcacacccaaaatctagcaccaagtaaaattaaaaacaccaacaaaaatccctttaaagaattttttttaaaagtctgttaccagttgacagaacctatggaagccttttagtccaaaaagactggagcaaaggtaaaaccaagtcgcagcaaagcttggagagtctgttagaagcctgcttgtgtagctctgggaaattattagtatggaggctccagtgactttcaaggaaatatccgaaaagaaggttttatattttacactggatgctaattgtacattccaaaatataagtgtgtctcaaacattcattgtttgtgttgtattcaggaaataaggatacaagagcattcaatttttcaaaattaagttgttggagctgtctaaatcttacctctggccctatcttacttcttcaattgtgatggataaagattttcacccatattttactgctaacaagactgtatacaatgtttactttgctactgtatacattgaacataatgtagtttcaggatataatagtcaatggagatacaattataaattgaaataaaaggggattctgagaattggtataaggaccactttcatacatttccttgaatctacttacggtattggggattgggcaatgattactttaagttgattgtcgagaaaaatcgaccaatattctatgacttccttactctttcctggtagtttactgtgattgtgaagtaaaaattgcatcaaaatatggatataagtgtactggtacaccatcatagttgttagcgttcacctatcaattcacatcaacaaagcattctatcataaaagtgaaataatagaagtggaagaagttaagaccttaatgatttcttctctagtggatattctgtttgctacagctagcgtagtgcttatgatgtgcaagagagcatgcaaatagcatttcaagtgctaacattttaatttttcataaagtcactcagttttatagatgaagaaattgagaccctgaagtcctttgtccgaagtcctacttcctgtaataggaagaactggattcagagctcaagctattcactgatatgctgtgctgcctttgtcaatgctattgagaaggctgctgtgttgaattctttgtaaagttctatatactttccaacatattatatattgaatttgcactattttcacttcatcagtaagggacataaaatggcataaaatgaaataaaaatattttagaagaaagtctgtaataatgagtttaccaagagtctactccctggagttcaactgttacgggcttttgatagatgagttgtgttgctggccttccaaaggaggcaaatactcatgaaacagaggaaaagaagcactgtgcagacaccaaagatactgacatttgtgacatacaatctaattggtcagtaatgaggagtggaaagattgatctgtgttattgattcccacttttaaaagacagatttggcataaacaagattaacatttggcaaaatagaaaagaggtaaaatatcaaagttgcaaatagtaataggccttaaaagaagggttggagattggaataaagtattagtgagtttaattgtatgctgggtgatttccaacctgctggccggtctagaaggccatataagcagggctgccatgctgctaagtatgagtgccttgcctcagcttctctgaccccactggggattggccagcaaattagtagaaacctactaaagtggaagtttgggctgcaggaacatctacagctgacaagttaggaatctcctactgcttgctgcagctagaaactgacagataacttctgcttcatcttgctagtcatgactgaaactcctctgtgttctagataatatttaataacatcccatatttagtacacatcctttgatttgtagcagttacagccctaatctcttgcatgtgtaaagtgagtttctttccatagctcactcattgcccctgtatcacacaaaagctgaatatattatttctgctccttatgtattttatgaattaaagggtaaggacttgggatatatttgttttccaaaagaaaatatttctggagctacaaaatttctcaaagcaaaatgcagaagtacatgaggacagttcagacccggctatcctcagctcccaataccaaacagagggaaccaaacaatgaattatgaaaagtaggtacagttgttaacatactgacgtttagctaaaacactgaaaactaatctctgctttgaaaagcaaggcaagaagtagctaagagtaaaaatgagcatttaagacatcacctgctgcttcttaaaaattctattttgtttctctctctctctctctttacctttagccactcgtacccaatctaccaatagcccaattgtaatgctagaagtgtgaaggatcttaatatctgatttctaattatttagtctgagacatgcttaggaagtcagatgaacttatgaataagtcaaacatttaatttttattagactaatttcattgacatatgataaaacatgtgcttaactataattatattcaaatctcttggccactttcaatcatttactctttttaatcagagttctttgtcagggtttcctgaaatgaatttcgttgaaaacattactttttaaaaaaattttttgagacaggatcttgctctgttacccaggctggaggtcagtggtgtgatctcggctcactgcagcctcacctcctgggctcaagcagtcctcccacctcaggctcccaagcacctgggactacaggcccatgccactgcacatggctaatttttaaaattgttttggagatgaagtctccctatattgcccaggctggtctcaaatcctgtgcttgtgagatttgcctgtcttagcttcccaaagtgctgggattataggcatgagccaccaaaacatttctctgtccttttcagaggtgttgtctgaaattttgtggccaaataaatttgaactatgcaaagaaactaattcaataggttcttatgttttcaggacaggattcctcagtgtgtttattatgctaatgagcattatgaatctctgcaaggaggatataagttacagtgtttaacatgattgatcattggtatttggaagaaactttcctttatggagaaggactgtttataaaagccattctggaaatacagcaaacagaacgttatgatactttaatttgttgacattgtagtcacttttatgtcaaattaaaaaggagcaggaaaaaagttacaattccattatctagagccaattattgttgatgtttttgtacatttcctcttatactttaaaaatacacctttttgtatagttgaactgtttatgtaaggttgtacccttacttaattcttgatttttaagtttttgagttttctcatttgttcattttctccttatgaatatatttttgatgactgaataatatcagctagacaattcattgtcatatttgcataaacagtattttattattgggcatgcaatttttttagtttttactattgtgtgctgtgttgcaatagctatttttactcatatgttcttaaacattcctgaccagttttttagagtctgttcttagaaaacgaattattagagcaaaaggtgtgaccttttttaatgcatttacacagaattacattgaggagttcctgaggaaaatgaacccaggaacactgataattgaaactaaccagtgtttcaatatcactgctaaatcacttgctatcctatacctttttaaactttttttttaaaattttactttaagttgtgggatacacgtcatgtgcagaacgtgcaggtttgttacctagatatacatgtgccatggtggtttgctgcacctatcaacttatcatctaggttttaagccccgcatgcatttatcctaatgctctccctccctttgccccctactcgccgacaggccccagtgtgtgatgttcccctccttgtgtccatatgttctcattgttcaattcccacttatgagtgaaaacatgcagtgtttggttttctattcctgtgttagtttccagcttcatccatgtccctgcaaaggacgtgaactcattcttttttatggctgcatagtattccattgtgtatatgtgccacattttctttatccagtctatcaatgatgggcatttgggttggacccaagtctttgctattgtaaatagtgctgcaataaatacacgtttaagcctcctgaaaaatacactaaattgcttttcagtaaatttgtttcaatttctgtttgtatgagtgtaaacgttagtattattttaccagaatgaaacctgaattaatattatgtatttccattcttgataatctaaaacatactcttttatttgtgtttcttctgagatttattaatcttttatattttctctttggggagttttaagtttgcagcttatgcttagaaattcctcctgtgactaggtgttaataattatttacttttttttctgttgtttgctttgatctcttttcagccaactcaactcattatttgtaaatagcagtcatgtgaagacatttccagatatttaagaattttaaaaacataccgtcaacattctattttgaaaataattgctcaaagtcatcctataggtaattgctgaaaaaaaattgagaagaatgaggtgtttataatattcaaggagttagagttttagaattaaatgaggtgagcaaatagatttggtctaaataacttgatgttcaaataaccttctataacttaattataaaacgctcaagtatatatgagcaaagaataatttggatggcagagatgtaatacctcatttataacactgtttaaaaggtgttggccaagtgtggtggtgcatgcctgtcatcccagcactttgggaggccgaggtgggtggatcacctgaggtcaggcattcaaaaccagcctggccagcatggtgaaaccctgtctctactgaaaatacaaaaattagccaggcctggtggcgcatgcctgtaatcccagctcttgggaggctgaggcaggagaatcgcttgagcctgggaggtggaggttgcagtgagccgagatctcaccattgtactccagcctggacaagaaaagtgaaactctgtctcaaaaaaaccaaaaataaataaataaagctgtcattttgggattgcagagaaggattactaaataaatgtatacattatttttcaattgagtagtaattgcatgcatttacccacaaattatatactttatagtttagtatcaagtttgatttttgagtcaaagcatttcttttcatggaatctcaagatgttttggaactttttgccatcggcaattatttaaatgatcacaatgatataggatattcataacccacttttggcaccttgatctctttagtatcttctagattgatagttacttctaagggatatgaaagagtgcgaaagtatggctgcatttttgttttggctaaacctggtctctaaatgtaaggttttcattatacatatttatcatcttatcaacctttcttagctttaaacattttataatcatacataataactttttgagtctcaatactgtatcatagcatagtttttaaaatgtcatttaagcaacaattactaatgtaaattcaagtaacatattgtgttagctgcaaaaataatgccactgaagaagcagttgagtgatcgataaactctaaatcaaataataaggtatatcaggactgcatgagcagaagaaaacagtgttcaaaattttatattagtaagtctaggattcaaaaaattgaatgacattgaacaaaacaagtcactatgatcatgaaccacataaaactttacaaagcttcggcagtgtcaactctgtatatggaaagtaataaattaaaatgtttaaggtaaagatgattagaaatgtaagtaaaaattggtagaagcaaaactgtagtgtgaaatctttccataaaattaatactgcataatagcctacacacacacatacaaatgtaaaataattttgtacttaaataatacaattaataatattaaattaaatggtacataatgaagattgtgctttgaaatatattgatatgtatgaaatcatgatttttgagattccatggaacagttaaatcaatcactaatcgggtggtatgtaagtgtaaaaatataaaaagtatagataattaataaacatgtaagaaaatgttcaacactatcaattattagagaattgctaattaaaactaaaatgagataccactacacatcataaaaatggctaaaatagaaaaagaaataaaaaaccctgaactcagaaaaccaagtgcgtcaatgatgcagaccaactaaaacacgtataaattgctggtaggtatgcaaaataatacaaccacgtagaaaatatcttacaattttttgataacattaaacttatgcttgccattatgacacaaatctcagttccaggtatttacctagagaaatggaaacttgggttcacacaaaagcctgtacatgaatgtttatagtgattgtattcacaattctccaaaactggaaacaacttaaacatccttcagtgactgaataagcagtgacacacccattgaattagacttcttggcaacattaaaaggggagaacaattgataatgctaaaacataaacctaaaatacatctagctaagtgaaaaataccagacccaaagggctatatattgtctaatttcatttgtatgaaattctagaataagcaaaattgtagatataggaacagattagtattttccagggattaaaggtggggtgaaagactgactacaaaagagccatgaacaggtaatggaactattctgtatcttgactgtggtggtgatcaccgattctgcatttgtcaaaagccatagagctaatggtagatttcactggtaaaagcaaattacagaggcagattatgccgtgtttacaatcaagtattcataaaatatataaaagagctatttaaaataaacagctatattaagagaggaaattacatgtttaaggaataacatttaaaaaatacttaaaaatttatcaaaacagaaaagtagcagccaaagaactgtatgataaattaatgtgtttggaagtttggtaccaaaagaaaaatatcagaataaatgtatattaataaattaagcatctgattaaacatactccatgaaatcctaaaaggactacatgcaggagtgaaagcaaaatgtgctgagttagaaaacaaaaacaataggattaattcgtctaagggttgttaatttgcaagaccaagtaatcaacaaacttctggtaaacttaataaaaatagaaaaatcccaaacaaataaaaagagaaataacatagtataaatattcactagcactttaatgattactacattaactctatgctaatatctaatatattaaaaatccccccccttttttttcttttgagagaggatcttgctctgtcacctaggctggaatgcagtggcaccatcctaactcactgcagctttgaccatctgggctcaagtgatgcttccacctcgaccttccacactctcccccaaaataaataaataaaaataactaattgaataaaaataaaaacaaataaataaaaatttaaaaaggaagtgttgaaattacaggtatgagccagcatgccccacgcacctcattaaaaatcttatcgagatgtcccaggaatgagaaacataaataggtaaacaatattggtagttgctgaaaatatgatcaaaagcttttttctgttttctaaaggagaagaggaaatttgtcattttaggggggagagaaaaaaagaaacacatcaaatgctacataaattggtccagactattttaaaaatatgaaaaactgcatagtattttttaataaattagcataacatgcatacaaaaatataaaaaagagagtcttttgcatagaaatcttacttaaaattatttgcaaatcaaaatcaaaaatactgtggaaaaatcttaattaaaatacttgcaaattgaaattgagtatttttaaaagagtcatttgtctttatcaattgattttaattctagaaatgaaaggatgatttaattttagggaatctatcaattcaatgaagcatatgaggtaaaattaggaaactaatctgaatttatggcatacctaaaatatttgacatttagagccaatcatttcaataccttgctcctctatgtgacaaaattatcttcaacaataattgtgaaatgagtctagtaaaataaggctaaaaagaaaatacagtgaaaattatctttattgaatgataaatatatatgcatatatacacacatatacatatatgtgtatgaatgccaataaaataagaaaaaaatacagtataaaaaagagacattagattaaccctcttaaattgcattaattttattgaaatgaaaaaatattgatcaatatcaacatcttggtcaattatataagaaatagttttcatttccaaggtttctgcaaatttgtcaatgactttatcaaaatgatctttatatattttgtttagtatcaggatgtccagatctgctaatctgtcttcactcctacttgataaaatcataatttatataaatcttatttttgaaagttttttcatgcacacaacatatataaaagtagaaaatgtcttaaacacaaagaaattggttagaaattcatagaaacctttttctccatcaatttcagaaattataatgcagtctgtcattgtttctttggatttgttgtggttttccagagttttcacatttgaaaatgtttgctaaaatatccttacaaaaaataaaataaaacaatattatatttggtaaaaaattctgaagtatataatggttttgaaattggttgagcttacttagggtagtatttgtgtctctaagtcatgaggtactacatattcctgcaagcaaacagtagatttgatataaacaatgatagcacagtgatcgtaaagaaaaaatataaccgtacttcagttcttactcaccccatgtgtatcgggtttgactgtataaccagcagttctctacattagcttccatggaatacaatgtttattaaaggataaataataaaaatgtgctaattggaaacttacatacatattatgaaaatacagcagttgcaacagcaatttttaaaactttgctcaacacaaattttttctgggaggaatattttgtcattgacactgtttagaattgctggaggcatggggataataaaaagcagaatgactaatagttggttgtattactgtttttaaatcctctacagaaagtgaatctttttctttcctgaacccagaggggcttgctctaaccacctaaccttggtacagcaatgatgttaataggagattaatggcatgcaataaaacttgattctgtttcctattaaggaaagagagtcagagagagagagagagagagaaagcgggggagggggagggggagagagacagagagagagctaggaatagaaagataatttactcatatgataaataatatctatcacaaattagcaacaaattttattttattgtattttatcttattttattttattttattttattttattttattttattttattttattttattttattttattttattttattttatttatgtatttgagatgtagtcttcctctgtaacccaggctggagttgcagtggtgcgatctcggctcactgcaatctccgcttcccagtttcaagtgattctcctgcctcagtctcctgagtagctgggactacaggcgggcaccaccatgcccagctaatttttgtatttttagtagagatggggcttcaccgcgttagccaggatggtctcgatctcctgacctcgtgatccacccacctcggcctcccaaagtgctgcaattacaggcgtgagcctccgcgcctggccagcaacaaatattttaataataaaattatgtctaatgaaattccaaattaaggcaaaataaacaacagaagaatgacagcaaaccaaactagtgtactggttatcactatcaataattaacagaggtctggaagtttgaaatgctacaagttttaactgtatacagttgataatattgctttctttaggaatcaactgaaaacatactaaaattaattggtatgactaagagagcagaaataagactaaaaataaaaacacaatggatttcttctatgtaaagagcactcagagactatgatgaaaatattacataccaatgacagtagaagtagaaaaaaacaccaaaataatagtgtgaaaagtttaattggaattcttaacaagaacatgtaagattttcatgactaaattttatataaataaaaacttgtataaataagttgtgacacaattttctgaatgagaaaagagagatgaaatattgtctttctatttgcatatagatttactatcaatctgaaagtcttaactgaatctttcttggatcgtcacaaaaatatacaaaaaaaactcatcttaaaataaaaatcagctaagaactagtggaacagcaagtttagtaattttcctaccaaattttaatgtacattttaaagccctactaaatattttaatattttatatattgctataatagaacaaattgtatatagcatgcttcctgaattggatagattttaatatcatgagagtagatagatatactaacagaaataaattcattttactaataagtgcttggcatataaaaacaatactttggggggatagaataggaggcatgaaaatttgggctaatacaatttccttctaaatttactgaaaaatgagaaggatcttcaactttcttgcagagtcattcactcaagatacctttgcaataaaataaacttcccaacatctgacatggcccatacttaaaaggatgcttttcataccttttaaggaatcttttctgtgatttactagagggaatgtagattttttttattatcaggtgctttctatgacatctaatcagagtattaacactgtggccatgacaagtgtttaaaatttaaaagtacttttgtaatacttaatcctcttaagttgatttttatttttaccgaagttatacttgcacatggcctaaatcatgctataaagttttgttaagaaaaacagaagttcactttattttccaagtccacagattcctttgcagttcagtggttctactgcctattcctctctccagaaatgttctagtaatattccctggggtggaagccagctttccacacttcttccagaggtactaccacctgcctccatgggagaactggctctggacaaccgctctagtcttgctttgtctactgctcctgcctatctcccttaaaagcattagcttctctcccttctcctgtgacatacatagcgtattcctcactccatgacattgtcataggactgaaagaagccaggaagggaagttgtgtacaagtaagctctgttttctgttttaaagcgcaatcatccactgaaagaaaaaatagcacagagacctgtctagctgcttagaatggggagaagaaaattaagagaaaaaaaatgataaatagcttttcttttccttattctattaaagtaaaaaaaaaaaaaagcaaaacaaaacaaaacaaaacaaaaacaaaaaacccacaacactaatattttgtgccactatgctctttgctctaaggaatataaagtaggatacacaaaactgcttttaagaaattcagtctgttagatcaaaacagtaactttggtagtagctatcttttaccattcaactgctatgcagtgcagaaaatgctagatggtatacaaacatttcatcacttaaagcattctacatcttgtaaggtaaactgtttattatctcctgtttgcaatgaggaaattgaggtttggagaggcccacatttacacaactaatgagttaagaagatgggactggaacctactttcttaatcactatgctaaacagcctgcagatacacatttagttgatgctaaataaatatttgatgaaagaatttctaataaaagacagacatggcttatgatgaatggcagtgcctttatcaaataagcattactgtgaatgctttgccagaagaggaaaggattactgtgaggaggcagaaggtagaaaatgtgcacaaagtaaggcttacactggataaaatttgtgacagaggaactttgtgggataaagtaataacttgagcagtggtgtgaatatataaggtatgtatatatcactggggcccagcatccctgattaaggatattaaatatatcctaggtagggatctatctatctacctctaatctatctatctatctatatctatcgatctatctatctatctatctatctatctatctatctatctacctacttacctaactacctatctataaatacacacataaacttttctatcaggtaaatatttatgttctacttgacatttgccaggcatgtctaagcgatttatatgtattagctcatataatcctcaacaacaaaattacaatataaatactatgattaatccctattttacagatgaataaaagctaaaagtcaagtaacttggtaaaggttgtgcaacttgtagatgacacctgagatttgaatccagatttttcaaggaaaggtgatgtattagagataaacatgaagtgctgttcttggtcaaaaactaaaaaagtatggccctgatagaccttgaaagatactatgtatgcaaaggacttcaaaatgctgtttaagcacaagtttcagaggaaacaaattgataggtccaccagaaaatgtactgtaagtttaggttttattagtagaatagattatcaagggtaggatagaaatagtcctcatctacatgttgatcagagaatctaggatgattttcattcacttctggtctccataatttaataaatatatagagaaagtttaacatgttcataggaggtaaatgcagggtgtgagggtgttctaaattatatattaggaatgcttgaaggaaatcttttaaaagcttttcatcttacatataataaaattcaaactcctcactctgttctacatatccctaaataatatctattttggctagcccttttacatttttcctaactcttcctgcagctcactctgctttagtttgctccttttgctcttccttaaataagacagtgtccttccacagggcctttgcacctgccattcacactgcctaaatattcctctccaatctatgtgtgttgcttactctcatgttagtaaattgccagtttttcagagatttcttcctcaatcatcttatgtaaaatagcattcatattactctctattcacttaccctggtatatgtgtgcacatgtctgcatatatgtatgttcatgtgtaggtacgcacatacataagaagacctttatcagcacctgatattatttatatattcaacaagtcttagttcttgctgttacagttttctccggtagaatatgaactctataaggatagggactttgcctcttttcttcactcctatagccccagaccacagcagtgtgcctgaaacacagaagggtcacaacaaatattgattgaaagaataaatgatggaccatttagcttcaagaagaaaaaaatgcaatgaggctaattgttatcttcaaatatttgaattgcttttgcatagaagtgtgattagacataatctaaaatagagctaaattaatggtaatcccatttttaataacagtcacagtggttcagagatgaagtgtgtttattctctgttactgaatatgttcaaccagtgacagcctaatttcttaggtaagatttagaaaggatcatatttggactaaatgaattgtaagagctggtctaatcctgcagtctttgattttatgactggagataagggaaaaatgattcctgctgcatcctttgtcccacctgatacctggctcatatttagaatcatagcattttagggctgacagagactaaagatcacatagagactgaagttgaaaaccaggagatgatattatctttctgcaacaaaaccaactatgatcatccacggaccacagcataaactcccaactcctcagtcatcaataaatatttattaacctctaactacttgctaggcagtgttttcaaccctgaggttacagcagcaaatgagataaacaagaactttcttttcattgtgataccatttatcatatcgtagctagacttacatgtatgtgtataaatgtatgtatatattgaatatatgaataatatgaatatattgaattataagtagtatatcactcatctaaattttgtgtgttattactaaatggaaaagatagggaatcaagtgtagtgactgggaaacagtgttttctttgtttacaaatttgcattcttttggcttttgaatgattataccaaagtgacagctgttggtcaaccagaaaccaggagtcagctgaatttttgcaggatatttattcatacattagggtggtcttccaggaaacagaacaacaaacagaatattttacaggcagtgttatagaaatatacacaaagaagcattctggttgaaagtagaaacttttgacctcacacagggaagtctaaatgtaacttaggctacaccagcagttttgactaggaaagtaaatagaagtttttaaaaagttgtttttaaaataatggcttaaaagattaactgtacaaattaaaatccaattaattatccttttaaggaaaattaattgaagtagagttaaaagcatccttaacaatattggtgatctatatgaaaaagctataggagtaaaagtgatactattttccctagtagtccttttaaaaattttagagtgcaatttttatttttacaatattgagacatatcactgatattttgatggctaagatactctacagtaatggatattctacacagtggagaattgactacattttataaaatttctgaccaccttttggacattcctgtagatgaaaaaatcaaaacctagatactaaactcacttaacataaaagtaaaaaaaattattgcatttttatatacattgatttttttccattaatatatttgtcattgaagtcaatgaataatagcactttttttggcccaggaatttaataagcatcattttcagttttgataaataatacgactaacggtaatgcaattgtatcagtctacctttaaggccgttgcattcctggtggtgtaaacctatgatcacttctgttgtatgcctacattactttgtaagattaattttgtattgatgttttcaagacagtgagggtaagtaggacacattgcatacaagttttgtctcaggataggaaaaggacacgttacaaacagcataaaatgaagtgctgggactgccctggttgagaatgacaggacaagatgagaagtcatggatatttatcctgggtctggcaaagatgaccacaggggctttaatgtattatggaatgcaatgactttgaatttcagttccaccactttctaagctgtgctaacttgggcaaacaagtctcttggaatattatattttacatcgataaaataggaactgcagtgcctagtctatgagataatggaatagagggtatacaatgtttgggactggtctgggccccttgctggttacccttgctggttattttcctttttttttgaaattttagagcaataatttcatattgaagccactttttaactataaatatttgcttccctgaaatgaaaaccattgaaaaatataatctacctacatatgattataaaatatcacctgaggcatatacataaaaataaaaagaataaaaaattattaaatattatatatttgaatatataaaacttgggtattactctggtggataaaacaatacaaatatcagatgtttgcatctaccagtaatgaagatattcaaatttaagagacatgatgtcagaacccattccattcaagaaatacatcaaaatgaaagagcagacattcagggagatttgagcatataaattagtgtctggataaataagaaactgggtctgttgcacatgaaagaggatactaatttgtgtgtgaatatgagtgcaagtttaattgaagaagaagtacatgacaagagaaatggtctactagagaagttgagaaaatgagagactattatagtttttcaaatgagggtattaagtaacgctaccacgagcacttcaggttgccatcttttctaaactactttgggtggcatctctctctaataatgtaagtgagaaccatcctgaacaactaccatgtgtcttcaataacaccaaataaaatattaaccaaatgaaaattatcaaatcaatatttatatttccctttctattttatttcctatctgcatgtagtatttgagttgtacatttcaagacaatgtcttggctccacttatgctttgctctccaagttgaacattcactgaattactggtattttcatgtacattcttgtaaaaactcttcattattattagcaactgaagaatgaacaatttatatttatgggagtttagtctagtgggccattcaaagactgtgtggggcctgagaaaataaatttttcactatgagggactcattagaaaatagcacttgctcttccagctaaattccaagtctctacatagttccaaactctctctaggagacagcattgctgcctccaaggttttctgtgccttagaaagaggagcgggagtaggagtaggatcaggatggagaagaaattggatttggtgttcttgttcccaaataccttcctctataaaagtatgggaataaggagttaagaatacctgcctaattgaccaatatatgttttttcaagaagactgacatgaaggaatttgataaacttgagtccagggggttcatggtgtaacctccaaatcatagaaggggagaagcatcacaacctctctccctgtataagaggaaccaattctcaatccactgtgtttccttcaaaggcttcttttatggtggttcaacttcatattttaatcaaggtccatatgttggatattaaagtaattttaaagtgtcagtacaatgttgctatcacccagagatctgcatggtaaataagaaacatcttaaggtagtaggagacactcaccttaacagtaagggaagtgttacatattcacacaatccatggaaatcccgtcaccttgtggttatgtcactacatcaaagcatccagatcattttttttttcaagagttgctccatagacccattgtaggttccaggtgaatatgctgcagagagatttagttccttcagatgtcaagtaatttgtatggtaaaatcatatctcagaataattcagaataaagttccatgtttatttttcattgtctcagcacaactgattagttatgaaactgaaatttctcggcaaaaaatttaaatctcattataaatgtccattgaagtaagtatgacagctctgtttcttattatgcacatgtgccatgtaaagatattagccataaaatttgctgaatgtcctttaggggacttcaaattttagtatgtttcaaataacttaaagaacagcatttgtttatggtttttcatgtgtatagacaataataaatataactgatagtcacgtacatggtgaattaaactaaagctatatgatataaacaagttgtctttttgtttttgaaatgaacttaaaatgaattaaacatgtcaaagtcaatatttcaaaatatacatttttagctaaacatttaggtcttttggaaaacattttggttggttctaaacaacattattactttttttctagataagttttatttcttgtatatttcattgatatgaaattataagtattcttagagtttcaaaactacttatggcaagagttaaactgtgtatttaccatattttaaaggtcaagaaaaaaattttcagaagataatgtgatttataaaaattttaataaaaagcattggtattcctattattgaattcacattgaattttaacaatcagctgtaaactattttggcatctcaagtttggaaaagaaagtaatctgttaatttgtagaactcataaaatcactctcgagaaaaaaatccattataagaaaggaaatcacttctaagttaaatatataacattaaaaataagttcacaaatatgcgtaatctgttgtagctataaaattgtatagctttatgatactatatcttccctacattgatagtttttggttttaatttaaaaagcttgctatctttagattgatgtgttaggaaagagaatctgccaatgtttttatttgattatccaaataaaaattagattaatgaggcatgatgacagcagcacagttaaaagaacagataaatcatcagtggaccagcttcaaactttacttgcttttgctcttctgaatataaaatcttagtgggggaggtggcttaatctagaagacagaacaatcaactcttaggctcatgctgtgttaggataaataatatcatactttgttgaaagggtgggtggaaagtttattaaactgaaaacaacccttcctgtattataaatacagattcatattcaagcttctccctagatcattcacctttagtgtatatgttcatagagatgtgaatggagctaagtttaacttttcatgaaaaatcatgactgatacctagtaaaatttaaggacaatttctctttgaaaaaacaagaatgtcataaggtgtattttaaaattatttagataaaacatctttttttgttcaaggcaggataataaaagtatgaattttgaagtcaggcaaacctgcatataaatcttggctcaggcactattaaaaagccttattaacttattcagcacaaatttattaatactttgggttaaagattgcatttgatatgatagtataccagaaagtttctcctatttcagattattttttcccttaatctcagattactccaccataaaattggaataataatagatctatagttgctttttttctattcctaaatgagtgtgcttatagaaaaaccgtttagttctttagcgataaaggcagcttaatctatatgaaacacagcctcagtgtgttacattacagcagaaaacaacataactatgaattggaggaaaaaaaactacaataagtatgatcagatggttaagatggtatgcaagtatttgaaaactgagatcccaaatgtcattatgaagatgtattcttaatcttaaagtagtttttattgacttcagaaatgtcttaattatctagtttataaaatgcttaaatatttaaaggaaactttaaaaaactgtatgcctctatgaaacaatttaatgaaatagccaggctgctttaaaagctaattacttatcagtaagtttataaatatatatatcctaacttatgatatcagagaaaaacgtgttttgcatggtgtaatatagccatgcaaattactcttataaaaaaattaagcaaactagaaaaaatcttaatgctttattttatttactttttttgctgtaaagttttcataagaatctgtttcaattatagggagatttagtgatgtttattcttaggaggctgcatctggtgtaaacaagcaatcagattcttttcagtctcacagcaaagatgaagcaattaaatgggtgaattgaaataatattttacagttgatatatgtaattttagctgaaatatttaagaaatatataaatgtgatttgctcttttgcctgtggtagattaattttagacttataccttcaaagctaagaagtataacacaacaaaacaaataattccaatgaaattgtaaaaaaaaaaataaggcaacttttctaggtatcagacagcagacagtggaggattataatcttcaacagaatgtgtacacacaaaagaagaccccaatttgcccaggttttttgtgtcggggcattttttttttgaggggccggcgtaatgcaagaaggtgaaacctcagctgagagcagcagccagtgaattgaggaggcagtgattggagtctggggttcctgaggcagttcgaattttctaggaaagacactataaataaaggtgctatgtggaggcactgagctttccttgtaaacctgggggagtgttgcattctgtatgtgtaggctgagactctgcagggcctagcagagagtagctgctacagaggtgacttgaacaggcacaccagaagccaagtcatgtaaacatggacattcttgtccaatcagggtggagagaacttgctgacttcttgaacattcggttagggtcccagaaaggccacatcttaggagtaaagatacctaagataggaccatgccttagaactaagaacaaactgaaatagatccgctctaagaaatcacaaaatgaattttgacgggactaagaggattcaccagacatttagttgtcttccagaacaaacctcaacagaccagaaaatgaaaacatacaaactctctgcaacatatcattcataatgtccaactaaattttttaaaaaagtgttgtaaagtcacgatcaatagcggttaatagaaatctactgcaagatgatacagatatttgaattagcagacaaggatttggaaatgcataaatatgtttaaggatagaaaaatctctctctctctctctctctctctctgtctctctctctctgttatgggctgaactttgttctctccaaattcatatgttgaagctgtaactcccagtacttcagaatgtgactatatttggagataaggccatttaaaatgagattaagttaacataaagcctttagggtgaaacataattcaactgagctaatgtctttataaaaagaggacatttggatgcacagaaagaccccagggggtgtgtatgcacagagagacagccatgtgaagaggcagcaagagggtgaccatctgcatgccaagaaaaggactacaaacaaacaaacaaacaaacaaacaccaccaccagacctgtgacaccttgagtttggtcttgtagtctttagtactatgaggaaatacatttttgtggtttaagctaaccagtctgtggcattttgttgtggcagccttagcaaagtaacacaatatatatggactctgggccattatacttgaaaacaaatcaatagaaacaatttaaactgaagaaaagagaatcaaaattttttttggagaaaaacatagctccagtgaccaatgagattctgttcagtgttttaaaataacttttaagaagttctagaaggagagaagagaaaataaataagtagaaaaaaataactgaaaatttggtgaaaaacatcaacatcaacctaatgatctaaaacagcagcccctaacctttgtggcatcagggattggttttgaggaagacaatttttccatggatgcagggtgggatggtttcgctatgaacctgttgttccatctcagaccatcagccattagattctcataaggaacatgcaatgaagatcccttgcatgcacagttaaaaatagggttcgcactcctatgagaacctaatggctctgctggtttgacaggaggcagggctcaggccataatgcttcctcacccactgcttacctcctctcctgctgtgcggcctggttcctacaggccaccaaccagtacccgtctggggcctgggggttggagaccccttttctaaaaagcttagtgaagcctaaggagaactatactacgaaatgtacagctagttacatcatctttaagcagtttaaaatcacaaagaaaaatcttaaatgcagccaaaggaaaaaagacacattacatggagtagtaaatcaatgatataaatgatggctcatttctcatttgaaacattggaaatcagatgacaaagcaataatactttaaaaagataaaaatccatacttttgtaggaaaacatgactaaagtagataaagatgtattttaaataaatgaaagtacaaatatttcaaagcaacacaacctatatgataagaaatgctggaagaaaaatgtcagagtaccagaaaaatagtatcagtatcatgaaagaaatctatacaaaatttacagttaacattatattggaaagtaaaatactgagtgtgttccctctcagataaagaatcaagtaaggttatctatgctcaccatgtctaattcaacattgaattggaggtcttcaccaggaaaataagtcaggagaaatagaaggcataaagatttaaaaagaagaaataaaatactctttatttactgacaacataagtatttttaaagtcctaagaaaaacctacacaattaataaaagaaaaatagttagtggattcagcaaggtcacagaatacaaagttaatataaaaaattgtatttctgtatactgacataaaacaattagaaaataaaattaagaaatatttaccgtagtatcaaaataaatttaacaaaacgtgtttaagatttctatattaaaaactgtaaaacatagctgaaataaagaggcgaactgtgatttcatcaaaataaaaaacttctgtttataagacaccattaagaaaagtaaagtcagagcttcagacaaaatattatcaatatacatacagaaccaagcacgtgtctaaagtatatattgatttctacaaataagtaattataagataaataacctaatagtatacagacaaaaaattgaatagacacttaggaggaggcagagctcctgttataggtatatgaatggcaaaaaaaagtctgaaaaggtatttaatatcattattcactagggaaaagtaaattaaaataacactgtctacaatagcaaaatttaaaaaggataacagcaacaatattggtaaagaaaatgtacatataacctacggtacaccaattgtgctcctatgtattaattaatgttattcaagagacaatagacacctttgttcacagaccaagcatggtggctcatgcctataattccagcactttgggaagccaaggtgggaggatggcttgagaccaggagttcaagactagcctgggcaacatattgggagcctgtctttacaaaaaattgaaaaattagcctggtggttgtgaatgcctgtagtcctccctacttgggaggctgaggtgagaggattgcttgagctcaggaggctgcagtgagctatgattgtaccactgtattccagcctgggtgacagagtgagatcctgccttgaaataaattaataataaatgatgaataaataaaaaataaaaaccttacaaataaaagtaaataaataaaacccctaaataaataaaaatgaaataagaaataaaataaaaataaataagtagaatatttattggagatttattcatatagccccaaatttgaaatgacacaatgattcatcaatagacttatgcaatctaggtatgttatggcatactcacaagatgatataatattaatacttagcattaaaaagaaaatgaacattgatagacctgagaacatgaatgaatctccaaaacattttctatggagatgcaaattatatcttgattgggaattcagttagataagtgtattcgtctattcaaactcatccaattatacaattgtacacttaagatctgtgcatttcactatgtctcaagaaagagctctgttaaaaaacaaatatatgaatttgagcaaaacagaattagaatgaaaacaccatgtggaacatgttatttacagtttataattgttctagataagcatggcagcaaaagcatcatgaaaataaatgattctatagatgtttccaagggggaataataggatagattttttaaatgataaggattttttaaatgatataaataacctggagaagtccagatgtcaaaaacatccccaggggtttgggatcacatcaaattaaaaaccttctgcacagcaagggaaaaaaatcgacaaagtgaagagacatcacatggagtgggagaaaatatttgcaagctacccacctggcaagggattaatggccagaatatataaggagctcaaacaactctataggaaaaaatctaataatttaataaaaaaataggcaaaggatttggatagatatttctcaaaagaagacatacaaatggcaaacaggtatatgaaaaggtgctcaacatcattgatcatcagagaagtgcaaatcaaaactgcaatgagatatcagctcaccccagttaatatggcttatatccaaaagacaggcaataacaaacgcttgtgagggtgtggagaaaagggaaccctggtacactgttgctggagatctaaattagtataaccactatggagaacagtttggaggttccttgaaaaactgcaaattgagctatccaatgatttggcaatcccactgctgggaaaatcagtatatcaaagagataactgcactcctgtgtttgctaaagcactgtttacaatagctaagatttggaagcagcctaagtgtccatcaacagatgaatggatgaagaaattgtgaaacatgtactcaatggagtattattcagccacgaaaaagaatgagacccagtcgtttgcaacaatatggatgaaactaggtatcattaggttaagtaaaatgatccaggcacagaaagacaagcaacgcatgttctcacatttgtgggatctaataatccaaacaattgaactcacggacatagatagtagaaagatggttaccagaggctgggaagggtagtgggaggctggcagggagatggggatggtttggttaatgggtacaaaaaaatagaaagaatgaataaaacctactctttggtagcacaacagaatgactatagtcaataataacttaattgcacattttcaaataactgaaagagtataattggactacttgtaactcaaagaataaatgcttgatgggatggatacactattcttcatgatgtgcttatttcacattacctgccagtattgaaacatctcatgtatcccataaatatatacacctactatgtatccacaaaacttcaaaataaaaaaatttaaaaaataaaggagtacttaatgaaacagatttaaaagacttggccgatttagccaaagtataccaaagtaaatatctatctgtctgtctgtctgcctgcctatctcttctatctgtctgtctatctatctatctatctatctatctatctatctatctatctaaattagttttataaggatataaagagtcatttttttctttcactgttttattgaaagcataaagttaagtcaatcttcttaaacatactgtgttaattatcataattagttaaagaaaaaatgctctgtggtcgcccacacccatagttccagctactcgggagactgagtgggaaggatggcttgagcccaggaggcagaggttgcagtgagcagtgatcgcgccactgcactccagcctagaaaacaaaagcagactctttctcaggaaaaaaaaaaaaaagttactttaaaactttttctagttacataattttcagcaattcttcccatactttcaataccaaaaagcacatttgatagcactacttcttacaaatttgaagaagtttgcttataattattttatttttctacatattttgcctgatttaaaatttttatatccctgtagttaactttaagaagcgttttagattttagtgtgaaacaacatttgagatagattcaaggaacttcctaacactgattctttgcactggaataaaaaatcatgaaagtacagctgtgtgaacgtagagttgacagcactctggaatatgttagttggcaccagtctaaaggctgggagggtaaacaagataacctgggaggtcttccagtaatgcctacgtgtgtgtgtgtgtgtgtgtgtgtgtgtgtgtatgtatgtatgtgtttgtgtgtgtgttggtggggtgaggttaggcagttaagatctttacagcccagatattgtcaactggcaatctacaaagtcagtagacaaaaatctcattctgactactgatttatcacataacttggctaaccaagttttgtcaatttagatttctcatgctggacttctagatttaaacctctctagagtaatagaaaaaggtttctgttggtttgtttttacttttaaaatatgctctctagtctttgcaaaatagttacatacacacgttatataatttggttaatatttgctacttaatgctaacaattttgttgcaaaaatccaataataatcactttcaagcttagtctgaacagtagttattgatttttatatagtacttaataaaacaatgtgtttttagtactcaatttatttcatgaaatactttacgcactcaataaacatcatctacaattaaaataattgtttatcctgtgatattttgtgagtcttttggatatcttaatcaactttacaaatttgttaattttttgattgggaaaattgagctaggtagcctacatttaaataaacatatagatgatgttatgattttatttaatatttaagaaagaaaataccgtattgtgttaaatcaaaatgtattgaaaacatacagtggtatagattacatccctattgtttagttccaaactaatgctgtttaactttaaattcatctcttactttagtttcacatttaaattgaaaactgtttgtaattcttttccccaaattgtttctgacagaaaattgttttcttagtctcttgccactgaagcgattttcaagtgttgcaaatttgctctgttatctttccctcttgaacacaatgtaggctatagttggcatttcagaaaggaaaaatggatttctagaaattgaacataatccaagcctcagacagagggagaaggaaaagtaggaccatgtactcctgagaaaagaacgacatagcttagcattaaacacaacagtactgtctacaacatgcattgttaacaatgaaagctgcttttcattcacaatttcaagctgagcagcttgtacctaataggtgctcagtaaatacgaatagagctagatttgcagtttgagttgatttgcaagttagtatgtaatgctaaatgttaaacagtattgcttaaccaagtcaaagtgttcctgtacatgtgcatttgaaatccaggaaataatttctgctcagttaggaagttttgccccacccatgttacacatttgcatctgtttttatatgcttttgatccaatcttgagttttcttattttttcattgttgagaatttggtgggaaaaattggggacagggtcttggttctcataaaagtatttttcgataatatcttgaaaaataaggtaaatatttttctgctaatgaagctgtgtcaaaagaccaaataagaattgctattcacaatgaatttttctcaaactcactccacatataatttttttttttttttgagatggagtttcactcttgttgctcaggctggagagcaatggcacaacttcgtctcacttcagcctccgcctcctgggttcaaatgattctcctgcctcagtctcctgactagctgggattataggcacctgccaccatgcccagctatttttttgttttaatttttagtacagacatggattcgccatgttagccaggctggtctcgaacttctgacctcaggtggtccacctgcctcaacttcccaaagtgctgggattacaggcgtgagccgctgcacctggcctccatatggaattttatgttatttgtttggtatgtaagcacatatagaatctgtttctgtccatttaaacatgttattttatttatttttatagttaagtcaatgagggtttgtaaattatgagttttacttttttgggggaaaggatggcgtgtattcccttgacagctagtatagtatctgccatatgaaaaagtttaataaaatgatagttaaatttttatagccataatctaaatgaatgtatattggcctgaaaagacaaacaaacaaacaaacatgaaagcagctgagtgcaaggttccctttgagtcagttcagaatcctcagaaacaataaatatggccttctatgtcagagataagaggcaaggcatgttacatacatgaatatctagttttgcttatcaatcgaatgcagataatattagtaatatttacttttattattgaattcttttctcagaatataactaggggtaatgaaaagcaggattaaaggagcgaggaaaggaagtttctgttagtaaagtctaccctaaagtgacttcaagagaacaagacaatttaaaatttcaacaagcaacacattaatcacagatgaaaaaatgctcaatttaactaatgctagttccatgacctatatttcatctagaatcaagccacctcagagggtaattaggtgattgcttgcaggaagttaccctttgttccccattttcccaccttcttttgttccccaatcgtgtgcccaaaatggtggctaaatgataatcattcaatagacatgaaaactgttttcctcttttttcttttactaaatacatattgtattaaatgaaattatagatttttgcataatatctcataactgttattaaaatttttatagtcatcatcattgttgttagtggttctctctggacattgtaggacttctgaatatacaccaaagctttataaattcattaggattccatgattgaacatgggatatcctgcatgattttgggtaagaagaaaagagacactatatcctttagtttctgtgccactattaacatagttaacgacacagacttttatccttcagagattgctgtcctgtttacatattgcttgaatttactaggtaataaatattaatgagcttttttagcccttcattctttcagatgcattcagtttctctttcaaatgagttcacctaatcctttccattacccttgtcagctctgttctgtgtaatgattatttacatggcttcctagagttattttaagttttgctggtttccttcaaaagccgaaaaagaataaagcctgtcataactggaaacatgtaaagcacaacttaggtttgagataatttttgttttcactatgtgttaaaaccaatgtggcataggctggttagtgatgttgatatgttttcaaagtcatgccttatttgaggctgtgaacacacatcaaggggcgagaaaatgaagcagaactttaagtacattggctgtttctatacaagagcaatttttgttgtacttagttgtgattgtaggaataacacttgcattttgcagagtctaaacatcctgtactgtggtcaatgccatgcagattactgaaaatgctccctagtgttagatattcataatatctctgatttatttattttttatttcttagagacaggatcttgctctgtcgcacaggctggagtacagtggcatgatcatagctcactttaaccttgaactcctgggctcaagtcatcttcctgcttgagtctctggagtatctagaagtacaggcatgtgccaccattccccaataatttttttttttaaatttttgtagagacagggtcttgctatgttgcacaagctggtctcaaactcctgccctcaagtgatcctcctgccttagtctcccaaagtgctgggattataggcatggaccactgcacctgtactatgacttatttttaaatgaacaaaacccaaaggaaaagtgagacacagaattttggaatttgcattaacactgtgacagagcaaaaagataaagctcaaaaagaaattcagtaacctcctggcacgtttaataggaggcattgatgtggttaggtaccgatttgaatgcatgctccacagattactatacttatgaacttggataagttaatttttcttcaattagatatgtcatgttttatcaaatatatttcacatataagtacatgtaaaaccaattactattaaaacagatgagaagcacaaagctagatatttaaatacaggtgcttagtggattctttcagaggacgagataaacacagcctctgagtaaaatcctggcttaatttgcctaacagtttttaaagactcttttctggggaggtattgtcctggggatttgggggatctgccaagtggcaagcccaagtacagtccagccaactgaaacatggtgaggggaggtgagcttttctgcaatctcagtttgcaggctcattgtgatcaacagacagctctcaggagtagggaaaaaaagaaaacaaaaattcactggggagaagtgagtgttctcaaatgacccaagaggcagcatggctttgaggagaaagcaagaacttcatgaagacatgtcaggagagctacttgtaggtacagttcaagtctttgctcacctagactttgtcaggttcaaaagatggtacaaatggtaaatgggatatttgtgatgttagcccttaatatagctttccagtacggactatttgcctcctatacttggagcacagccgttgtcctgaaatctcccttcttaagcattatttttgtctctctctgtgttagaccttctctctcctgttacccatgtctttgtcttctttctggtttatttatttcttatatgtatgtgatttgtattttgtctctggaagcctgtaaaatcttctgttcgcctccagtgttctaaatgttcacaacgatgtgtgtccactgagctgggaacactggtttttagtcttgaaattttttgtacttcagataagtgaattgaactatttctttgatgatttcctttttctttttttcttcatctctctttccagaaactattatttggctgattctggacattttttttttattttttaaagtcttcttttctaattttccacttctaattgctctcttttttgagaatttgctcaattcaatctttcaaactgagattaactttctgctttacttccaagagatgttttagcattgactgtttctatttctattttataggatttgtattagtacttgttccatggatgcaataatttcttttagcccttaaaggataatatagtagttttttttagtaggttcctccaagttcctttccttaaaaaaatcaatttttacgtttatatctcaaggtggagaattttctcagctatctggtaataattggttgtctgtgcttatttaatagtgagatattaaaatgctgattagcaacttagcatattggcggaacttgtcagtattattttccctttaggatgctgtttctttgctattttgtggaaacttggtcttttcctcttggatttgtcagatttcaaaaagaggattctcattctcttgcctagaagatataaccctagctgtcgacatcctggcaaccaagtggggaaagaagccgggaatttagcattcagggtgaatattcttgtctagttcctctgtcttgagtatgctaacacactctaactgtgcctggtgttgccagtgaagaaccctctgttttcccttctttaggaaaaaaaaagtctaaacttctcatgtaggaaagaacagtcactcaaaagcacagaatgtgaagagaaacctaagaatctacctgctttgtaaacttctaatactcaaacttgcttattttaacctcaaacttgtatctgcttcacacaatcatttctggagatagtagatatcatcaattcctgaccattttggagaatatgtgacttaaattgttttaattcagccttttctattgtaaatttaggttttatgtaacagtatatatgagttagttagatggattactaaataacattaagaacaagtcaaacttaacagcaaaagcatcagaaaacagatcatctgataactaacataacattggattggagactcaggaaattattaaatttgaatctaaaataagatggtctaacataaatctcaaaagacttattgttgtttccaggtgtgcatcttaagaaacttgaagggtttgtatatttgaactcaaaaccagatactgctcaaagatgcgtagctgaattttgctctgagttttgtggttgacctgaaatcccaatacaaaggaaaagtccaagagtgtgaaaccatatcaacccaaatatgagactgttcatgtgaatactctgtgaactgagaccactaaggatcccttgactctaattacagtgtggtctcattcaataaaatgtaggaagatcatgtgatttctttattgattctggcacctgttaaatctttattaaatacacatatgttctgaagtaactctccaattatacaatacatctttaaatacaatacattgattcatataactcaccattttaataatgtgctataaagagatgttaagtcatgtattatgtattccagtttctaactgtaaatgtaaagactggtaaagtttaatttgtaaggatgatattagggaaacttatgacatataatagcagtcctaacaaccaaatgtaaaagaaacacacaaaacaaccatacttttgaagggaccaaatgtttttaataccttaaaaagaagcttaaaaattataaatatgttaccaaagatttggttatattacatatacacagtttggtggaatatttttatatgcataagaaaaaatcaatgagaatatagaaattatcatattatgttcaaaaacatcacatatggtgtttcacaatgcgtaattcattctgtggattactttaatacaattctgataataaccataagataaatgttattttttttgcatggttatgtattttttgaattacctttttttcttcctcaagagtaatatattcattaaagaattatagagattctattacactagcatatgtttttaagtaccaacacaggtagtgtgaaactgaaaataaatgtgtgacattaggattctgtctagttatcactatttatttgaatttcctttgaagaaggaagtaaaaaatatatatatactattagaactaatattaatactattttgtggcatgagcagggctgtgccacagtagatggttgaggggttctgcttttgaattcactggaatggcagagtctggatttagccttccttatgaaacaataaaaaaaaatctgaaaaaaaacaagaaaaccaacatatattcctatatttatttattatacatgtatatgaatacctgctgtgtgctagggattgaggtaaggaagagtgtacggtagtaagcaaaacaaaagtgctgctgttatcaagcttacaatctaccgggggagacataaagcaaataatcactccttaggaaacaaacgtgggccacttgcagttcttgcctaaacagaacagaacatcagctactcctatattaattttagagtgtatatgtaatatattcttatagttttattcctaatcttagaaacctgtaaaactaatgtgtctctattaattatatattattccatatgataatcacatttctttgtgattatacatccatgtaccaaacttcactgatgcaacccatttggcagaaaaattcatagtttgtctttttgcaaaatgacagattgaaccacaaattgaacttgagtgaactctattatattataccaatttaaaattaaaagtgggtgatttcagatatttatttgtttgttcagctataaaaatcctcatatcctttaaactatacaaactgtgtcttaaacccactccatttcccccatagagaaatattgagcaaataaaatatacttgtcaacttctttattttttcaagtgtttttttcattgagtataattatttttttctaaataaaatgttcctaaaatataccaagataaacattgaatacactaaaaatgtgattttttaaaaacaaactttctttattatgtaaataaaatatgcaaactccaactattgatatacttagggtgagtggcttcactttgacatcatatgtaaaatggcatggagattacttgtaaattataatctaaggaagtgagaatggatttcaagctaggctaagagctgttaaaggggataatagacttttgatgtctgtcttttcacagtagcacaatagctaattcatgtgacttctgaccttttagtgtcttgtaaccaagtattggcattaatctactacttatctgtcacccaccacatttgatagtcccaatctctgttttcaattatcagtcattagagaaggcactgagcaatttcagaagaaaactcacaaaacctttgacctgtttttgtcatgtaaccacaaatattcactgtagataaactatcaactcactgatttcaagatgtaaaggaaagtcttttgtgtacatagacttactgtaacctctatcacctaaaggtggttaaaaactgttttattttactgatggagcagaagaattcacaagatcatttagtgaaatctggtgagattagaatggttgacctctagctgccagacaatctgtaaaaggaacagattttttccactaaagaaaatgtaagagctaaatattgaccaaaagatggctatcagacagttatgcctttattttaagttgttacaggtaaacacaaaacattctcaaatatttgtacatagtgtcattgaaatctgttatttgtgtagtaaatatactcattcatcattaaccatttttcattatacagaatgaatcagtcaagtaccaccctttgtgggtattctaagctaatttttgacatttaatattaacgtttaactcaaaaagatgtgtatttgcttctaacattcacttaataatttttcctttctaaaatgctcataataaaaacaatagtaaactatgtgtatacttcggaatgcattgttatcctcagtgataaaaataacttaatgactttaagacttaaaaaaaatttgtaagaaccagtaaatttgattacactgatatttcttggcaatttgtgaaccttcaaatatgtgctacgtgttccaccaatatataaacaagatgtcaagtaaatacaactattttttatctatccactgttgtaggaacctagcctgcaggtttttttttaactccataataacaaacatttttaaaaaaaccacaatgacatctagcttctagaaaattatattaagataccaaatgattaatttacctctgcttcctaagagcactcaggtcagaggaaaacccttcctcttagaattttctactatattacttaacaatcctaatgagtcctttctaacagccttttactgagatttgctgtggcatccatctcataatacaagctgaaacaagtcaatacacccaactttgttcatctgcaagtgtgttcccagtgttctattgtctccacaacactgacttaaggtagaggaaaaaggaagaaactaaatgcataggaggagagagcacgctaagaatgagcataggagcttgggagtaaggctaaagcagaaacattgttctggaatggaataggaaaactttgccctgagacagatgtagcagttgttattagttgaaactttcatgcaaagaatattaggagtaataagacctagatattatctctggctttgtgataactaactctgtgacagtgagaaagttaatattgtttatctgtaccatgagggagataatggaagctccaccttgttggatcaaattagggaagaaacaaaaaattaaaatttattaattatattaactccttcattaattaatttattgctacaattgtttatttgttattaatttaattattaaatatataattttcataccaatgcttggtatgcatagctgttatcattacagtattctaaataatcactgaaagctcattgctaggcctaatttaaagaaaacaggaacaccttgagaccaacttcattctaattttagagctttatgtaaggcttaattcttgtttctaaactattatatttttaaagtaaactaatattcaatcaacaattaaatgtcttaattttcaaaattatatgcattatatttaaattgattttgaaaatcaatttgtttagttatagtagaatattacaattatttaactatctaataattctttgagattttgcttctttataaaactgtattcatgaaatatttatgagtaagaggataataactgtagaaaatttgaaagtcaattgaaattatcctttgaaacaaaacattcagggagacaattttctttcattcaggtcacatattactgtgtattaacaggctcttaagacttctggaatctggagtttgccacactctctggaatggttatccattcatggaaaacatgtacatattctttcactgaccaataaataagtctttatagaactaggtttatgttttttggtggactagttagcgaaggatatcttggaaagtgatgcatcttggtagtcacatgatatcattgcttttttttcacttttacaatgcaacacagattagtaataattctatgagtaatctcttaatgattttttgcactcagcagcaaacaatgatctgtattctttcaacagctggctaggctcctgggagaatgctatctttgccttacagctactgctgctatttgtgtcttccaagttacagctcttgtgtgggagattaagactgattgcccatgaatgcatctccttaaaactgcagataaatcactacatagataaaactgtaatcctctgttaattaattctactcttcagataatgtagacatgaaaatatttagcccaggacaatttcatccagtttctattagtgataaagtcattcagagagatatctgcttgggaggaaaaaaaaaacaacttctatcagtcattaacttctgttaacttgtatctcaacaataaaagtcttcagtgtgtgttttaaacagagtttaacctttgcagaactttgacaattcagagcacttaggacatagtttggtgcttatataaaggcaattctgcttcttttcactatcagtccattaatcatgggatgtgaataatttgattcatattttacatcttgtatgctttgatgttaccactttttaaaccaaaatataataataaattatttctcttcttctagcagtgcagttgagttttctatttctctagatagctctgtaatttcacatagtttggagtacacacaaagaaacctgctccctagaagcagaaggaagtgtgtttaccatcattgttgtgtttgtgatttgggtggtaaaatgcatacgttttgctgaagttttgatgttttattttctgtgagtttgtgtatgtgtgtgtgggtataggaaagcaacttgttttaatttttttagagagcgctgttggcaaccatcagctctaataaataaacaaccctatgttgatggacttatttgaatggaataattttacatgataatatttgggatgatctacacctccatccataaagtgtatcattgtaaagtttccttttttcatttttatggtgatattaaatggcttacacctggaaatcttcaaaacgtgtgtgtcataaatgacaacgagagaagagtctgggattagtgaagtctatgtatggctgtttgcaaaatgcacccccctcttggtcttgttagacaggtcagcacatgtaagaatttgaacaggctgctgtggtctccttttaaatacaattattagaagcaaattgattgacacaagtgtttgttactaaacactctttctattctcacacgagagaaatgtcatttttggtctgagataagggatggtactaggaaaaaaagcattaacccctgatctcagtgtgtctttactctgtgtccttctatcccctttaacaagtctgggtctggcttaaatgagccaaaccttctgcctttttgtttgtcttgttttatttgtttttatatggtaattaagagatgctttttcaccaccaaagagggaatgtgtttagggcttttatggagtcttgtgtatctatatctgataaaacagattttactggaaatactggtaaagattctggaaattcatggtatttggttgatgtaaaatatacattaaggaatgaattaaaagggccaaatacatgaatctcaaagccaataatagtatacacttctctgtttttttttcttctcatttacttgtgtatcttttaaccttcccaagtcatttaccactgcagtaggttatagcatactgtaatatacagaaagacagaatgcttaatatttgccaaatttgtcacaatgtgaataagacaaagatctttcttaaaaagctgacatttaaggagtgttaaatgtgtgtgtttgttctttttcatctactttgggagttttgattttggtagcagctctggtaaataaaaggttgggtatgaaggaattctgccggtgaatcacaattatgtcaaaattaaaagctataattaaatttcaacatatggttgtagtgaaagtatgatgttacattaacatatatagtatataatactcaaattatataatcatttgtttattcataaaatattccttagataagaaatgtaatcaatattaaataagtgaataaaaacacatgtgctaagataaagataggaggaggtgtgttctaaaagaatgaactgagtccagaaagaatggcatgtctttattatgggagcatcataaagggaaggggaagggttctttggagagaggataacgaaagcactgaaacaaggtcaactttcccaagaaataattagattgaaaacataacaaaacaaaacaatattcagaaaaacacactccggctgtgttaatgagggcttagaaattgaaatcctgggatgaaatctgttatctttcgattacaagttttgggctctttgacaagttataaaactagtggacttaagtagggtcacggggattaaatgaaatatgtaccacacaaatgatacttaaataagttaccatggcttcagccaagggggaatgcagcaggagttgctgagtggaaagagatgactagattttgacccattcatgcaatttttcattcaattaatatttattaaaagatttctctggattatgtattgtgatgtgttagatgctacatactttttggtgatcaaattccttattctgttcttcacttttttgtgtactgctgaaagacattgtttaaactaacaatgaactagcctctaagtgcagaacagtaggatgtcattatgtaggtggtataggtattgaacgaagatttataataaactttaggagacagacatctgttactatgtagctgtcatcacccaatttcttattcttaagtcagggatattaatatttgccacctccctagtgttactgtttgaggtaactgagattacattgttgaatatttgtgggcatcattaggctgtaagtcttattccattactcattccaatatgtcccatggaatttattgttgcaattatgattcaaagcagtaggatataaggatttgaatcaccagacaagtctgcaatgcaacttcgttctgtgtggtatatttaatataaaattttattaaactctttgaaaatgagtccccttaagggtttaagttaaatagcttggattagaaaactgaaattttataataatggctgaaattctagctttctactttattacactaacatctcacaggggattccagaacggtagattacataacatgaattcaatactcatctgcattaagcaggtgcacactttaggttggatcctagcaaactcatgtcttagcctttatttttaggactatacttgttgctttttggttaaaattttaaatatacaatttaatattaatgaaaaaatgaataatggttgttatcacttagaattatgaatattgaccttcagaatggagaaaatatattttcaaatggctggttggtgcatatatcatgaagtatagtatttgtcaagcagggtctgggacagtgccacctaggccaacacatgacaatttctgcagcaaagcaataaatatttatagaaactgggataaaaagagactttaaatcacttcatgtcagttaacttctggttcttctgtcaaaagagcttgaaaacaaactcgtagttttcagaatgttttggattttggacttgtaaatacaagattttaggtctatgttaacaaaataggacaaagccatagtgtgttagcagacgcagcatatcctgacatttaacaaccatggattggtgacaccaaatgcctgggttcaaagtttttggtaaggtatttattccccatgcttccacagttgcttcatttctaaaatgaggataataagagaacctaccttgtaggctgttatgaggcagaatatgttaatattaataagatgataaaatactgagaatatagtctggcatataaatgctatttagatatggtcacatgatgtcatctacttcatttaaatttaggataagaaaataagaatacagtgagttagatttagttccctgaaagcaaaagttgtggctagttttagcattcttacatgcacatcagttactagctacttaggtagcaggcattttcttcccctagacttccactctcacacagcccagtcaaatggacaaaagggagaggaaggaggagtgtgcagtctgcactatcatggcagtctgcactatcaccagagacaagatttaaattatggaccaaaataacatcttacaaatgggttttttgtccttatttaggaaaaattgattaataatctctctggaaatggacctttcttaggaccaagataatgatattttaagagaataattttatgaatcatgtgaggtggtgttactgtagtcagagagccaaagagcatcatccttgccaagatccacaggacaaaaatgcttccaactgggtgcagtggggaacacctatagtagtcccagctacttgggaggctatggcaggaggatggcttgagtccagggtttctgtaaaataaaatttaaaaaaatatgcccccaaatgtagctacatttttctgtatgcctgctttagattctgagatggaggtgaggatcagcttcttgctctctcctgaaccaccttccacttttctggggaaaataaaccagagattattatggaggatgaaggcaaagcattgtgggttcctttgtcaggagcttcaaatgtggccacccatctggccttagaacatgatgttctagcagccttgtctccgcagcatcattcctgatggtcattatcatcttttcccttccataatcttaatgcttctagcttaggatcctaagtttcatatatgtatagcagtgttataaattttaattaatcttctaaagatttccaatttttgagctttgtgaatcaattaataccacttgtacaatacactatcttacacagccagattatataataatatgtctgatacttactgtcctaaattcttcagcatttcttaatattcccaaaaggaacagttctttgacttcatttgtttggaaggttactaaagagggaaaatatgttcccctctcaattctgaataatgacagaggtttttgagagactttgtactggaccaggggtaagaatttataaaaaatgctttaaaagcaaacaaacaaacaaacaaacaaacaaacaaacaacacggggcagagtagctcatgcaagtaatcccagaactttgggatgccaaattgggaggattgcttgagcccaggatttcgagaccagtctaggtaacatagtgagaccctgcccctacaaaaaataaaaaaattggctgggtgtggtggtgcatgcctgtagtcctagctactctagaggttgaggtgggaggatcacttgagcctgggaggtccaggcgtcagtgagcggtgatcataccactgcactccagcttgggcaacggagtgagacctttctcaagaaaaaaaaaatgtttttaagaaaaagaatattttatttgctgaaaagagaaaaaattttctggggaagacattttagaaacaatctttcttgtaaaaattagtttgctttatttacttgaactttgaaaggccataaacacagtccttgtatacttgcaactcagtcctctttcccatttccctcccatggctgtgctgtctctccagtcatttcacctggaactctggaggttacggtaacatattcagaatttctgtataaaattttctatggtctgatacttgatacatagtagtaatcattttacagccttcacttttaaaaacatttttggataacctttccatttaggatccaggaatttgtataaaaccgcagaggttatattgcttttgaactaaaggctgttggtttgtggaatttcctttaactggaaacacgtttcagtttgtggttttagggtttttccagttttatactatcctgcttgtttgttttctttcaaagctggagaatttatcattaatttccatattttataaaagactaacttttttccccctcaaccccctttattttttcagttgaaagagacaaggatttttctcaccagcgaaggcattacaaagaatttcgatttgatcttacccaaattcctcatggagaggcagtgacagcagctgaattccggatatacaaggaccggagcaacaaccgatttgaaaatgaaacaattaagattagcatatatcaaatcatcaaggaatacacaaataggtataatctttttatttaacttattatcctggcaaatatatgtaaaattttagtaaaagccattgataactcatgtgatctatcaaacaaattatttttttgggggcaatgtagtaacatttagagccaggtagagatattgaaaggtaaccgtaatcgatctgaaaattttctcctacattccagagctgctccctactcctgacaccaattcgtatactaaatagtctcatgcttctaaaaatgtgctttctaggtctgttgtctcattttgtaaagttgtccttcatcccagaaaacttccactttgttctgcccacatgaaatgtataattaagataatgaaattacttggtgttctggaagttagagaagcactgctttacttttcactgacatgagtgtaaaaattgtatgttcatttttatgtgtattttgatgtcctctgtctataagttggttaattcggaatgatacaaaaatggacagatagtctgaaatactaaatgcataaaaacctcagttgataatgactgcaaatgaaccattgaaaataagtgttaaatatcagtcattttctctgatatttaacaaaatgcagaaatcacttggataacacattttttcaggtgatgaatctacctttgtcagacagctcagatctaccatctatctatctatctgtctgtctgtctgtctgtctgtctgtctatctatctatctatctatctctcatgtatctaaatctatttgaaatcctatattgaggtgatatctctctcccagtagctttcattcctcacatctaggtcttccttttgatgaaataatatatccttttttgattagaaaaatatttaaagattgctatcctgtctcctgtaaggtgctgttctctccttgttgacaatatttgcagttcttgatgtttagatttgtcttggtcttccagtttggcagaatttcgcaatagtgccttgcaatactcaatgaagaaaaaattaaaaagcttctgaggtcatgtctattgctaaagccttcctgttagactatcctctcggagattcacaatgcatatcagaatattaaagtcttttttaaaattttttattttaaatcaatttaattttggtcttgaattaaatacaatctaatttgggacattgtgatgtgcccaaagtttgagactaatagtttatcttaaaataagggaagttcttgttctgattctttagaaaagcaaacagcaacagaaaaacaaaacagtgattatatttgagagccagaaaaactttgtaaggaaatagaaactttttatatgcgtctgatataataatcagatcacttatgtttgtcattttgagtggctttgcaaattaggtaccaaaagattaaaaaaaaaaaagccagacactaatgctgctctatctctggtttagaatccaccctgtatacatgtcatctaaagtcatcccatgtagacaaccagaacccaaaaggaggctgtggacaatatatgaatatatgcaggtcttccagcctaatggcacctcccgatattcctgacatacaaaagggctttatgttatcacagtatggtttactcagaagttagtctgggggtgccattcatctgagttgtttggcttgaatacacaaagacttttgtctctaccttggctattttaaataaagtattattattatcattgcaaccacagaagaccatcaatatgatggactcatcagggtttccattatgtacattgtttttctggttttaagctatttcagctgcttaacattcaattaggctacgccttggcttctggattgtaggagtgtttgtcattgtggacagttctgaggcagatttcttttttattttattttattttattattattatactttaagttttagggtacatatgcacaatgtgcaggttcgttacatatgtatacatgtgccatgttggtgtgctgcacccattaactcgtcattcagcattaggtatatctcctaatgctatccctcccccctcctcccaccccacaacagtccccagtgtgtgatgttccccttcctgtgtccatgtgttctcattgttcaattcccacctatgagtgagaacatgaggtgtttggttttttgtccttgcgatagtttgctgggaatgatggtttctagcttcatctgtgtccctgcaaaggacatgaactcatcattttttatggctgcatagtattctgtggtgtatatgtgccatattttcttaatccagtctatcattgatggacatttgggttggctccaagtctttgctattgtgaatagtgctgcaataaacatacatgtgcatgtgtctttatagcagcatgatttataatcctttgggtatatgcccagtaatgggatggctgggtcaaatggtatttctagttctagatccttgaggaatcgccacagtatcttccacaatggttgaactagtttacagtcccaccaacagtgtaaaagtgttcctatttctccacatcctctccagcatctgttgtttcctgactttttaatgattgccattctaactggtgtgagatggtatctcattgtggttttgatttgcatttctctgatggccagtgatgatgagcgtttttttcatgtgtctgttggctgcataaatgtcttcttttgagaagtgtctgttcatgtccttcgcccacttgttgatagagttgtttgtttttttcttgtaaatttgtttgcgttctttgtagattctggatattaaagtcttacaaaggctttacagtgacaacacacacacacacacacacacgtacgtgcacatgccctctcaattctattttaactagtcttcctcaaaattatctggctatggattcattgggtgtgtagtacttattaatatcctatggaatgctagttcagcagaactcactttaatacgtactgactgatatgcattgttatttttaacagcagtaatttgaaggcagaaagacctatatttgtttctcaactttaacactgactacctatttgtctgcagataagttacgtttttaaaaaatctcaatctaatggttccatttataaaattaagatactaatattattttcttatagggccaggcatatatagtgaatactataatatgttatttttatgttacataataataatatctcaaaattagtgagaagagttgaaaataatattctgaatgttagttaataatattgccaaaactaacaaattgttttattcatagttatctttttctatgtctgttttcacacttggattatgagttttttaaagaagagataaggataagttatttatttttatcctcagcactaccattttcctcggtatgattcaatgctttgacatcattattactcaaaattggaatactacttccatatacatatcctaaaatgtttgaattatgtttattttttgtcagttatatatattttatgtatgttgagtttatagttggttatttatatcctaagcatttttttcaggaatgattggcataccagttttctatcctctagaatatatttattaattgtatttaattgcagaattttacattgatcacaattaaaattcctatcttttctgtatgcccactgttctgtctgctcagtatatttcttaatgtcatctaatgaagctccctctgagcttactttcacctttctattttctaaggatgtgaatggtataatttaacacatgacaaaaatgataaaaataaagaactaagagtctattaatactttatagtctatttctaaataaactaatgcttatttttattaacagtccattttggaatatttatggatattgatgcttagttcacgtgacttcatagttttgggaaattttaattatccttacaaaaatgaaatgtttgtttatcttgcacctctgatatttttctaattatacctgatttaaaaaatattactcttaatgtttctgctactatagctacgtattgtttcagtattctttggtataatttggctaagactttattttaacatgtgtttaaatctactctcagatttaggatttcactgatatttttcctaattcctttgacttaatttgtaaaatctaaagtgcatgtatatctttacctggcatcctcttccactgccattttaaactctgggatgatatagatttgataggtttctatttaatttgccaaatagtatttttaaaaattcaattcaatcttaattcagttctaccaagttcacatttttgaacatctgctattgagtagtgttactgaattatgattgttactttatcttctagggttatagtatatttattgtcctctgtgatatttgtttttgctaatgtatttggaatgttttactaattattttttcaatcctgaaatattcacagagactcatacttcgtaattcaattctttttttttttttttttttgagatggagtttcactcttgttgcccaagctggagtgcaatggcactatctcagcccactgcaacctctgccttcaggtttcaagcgatactcctgcctcagactcctgagtagctgggactacaggcacccaccaccacacctggctaatttttgtatttttagtagagaggggatttcaccatgttgatcaggctggtggtcttgaactcctgacctcaggtgatccacccgcctcagcctcccaaagtgttgggattacaggcgtgagccaccacgcttggccatatttcaattttatatactgttgatcaggtatgacaatctctagcaaaacactttttttattttaaaataagcattggttcattgacagaagttcattattctgcattgtaagaaaatgcaattctgtgccgtgttattacctatagatgcaggattcactttctgtactcccccttttcttccaaagaaagatgtttaagggaaagaacacatagaaatagcgatatgtcttatagaatatttcaggtttctatgaaggactttaaagtcaccacagaaaataataatatagtgccataagagcatagacttgaaattcccaaatagggaaatttctatatttcttggagtctcagtttgcaaatctgaaaaaataaaaaacagatgaaaaagtatttcagatcaagaaaaataatttcagatgatgtgggaagggctaatgcatatcccaatgcaaagatcatagttgataataaatacattcatcaatatattttcatataacttcatatgagcatctatgttagtttacagaactatatacataatggcaaaaaattgttttttattataataacagtaggtacagttttctgacacctacctttatgtaaagataaagtaagtaaaatgttctaggtgtctttatttaataaataattagttttattacataatttaatatatgaaaaataaatcggtaggttttgaagtgtaataataaaataaatgccacccaatttaatagcaatatcattgaatctttctgtgaataatagctgaaaacacaagttttagataaatagtcaaactctttaaaatacatttgagaagtatggggaaagggtagtgtgggatgagagagctcttatttatgaatttatcttacagaaacattgcagatatagacagatgtagacggattcatgtaaaagtgtttatcgctgtattattgcttacaattcacaaattgaacataattaaacaagaaaaaagttaaggtataatttttggaaaaatagcacagagaaaacacatattacctttttttttttttttgagacggtgtctcgctctttcatccaggctggagtgcagtggcgcaatctctgctcactgcaagctccgtctccctggttcacgctgttctcctgcctcagcctccctagtagctgggactacaggcgcctgccaccacgcctggctaattttttgtatttttagtagagacggggtttcaccgttagccaggatggtttcagtctcctgacctcgtgatccgcccgcctcggcccccaaaagtgctgggattacaggtgtgagccaccgcgcccggccaaattacatttttgaaaactatttactaacactgaaaaatgctcaaataataatgttaattgacccaaaccaagaaacattattatatacattattatactattttaaataaatttatatataaaacagattgaaggaacccatcaaatattcattgcaggctgtgggtaatttacattttaattcttcaacactttctgtgtttttaaaatttttatgatgaacattattggtataaacagcaatgtgaataattatagttgagagaaaaaaggtaatgaaatgattttatgctacacacatctttacaaaatagcattcccaacttctgccaggtatagagagtaaaaaatcaaaacaaaacaaaacaaaaaacactaggatttaaaaatcagttgctctcattttttcttaagccatggaaggtatttttttctcataggaaatgaagataaatagtatcttttttatttttcgaaaaaatttaccactgctttggaactttgactttaattctctgagaattctctgagaagagtaaatattttttggaaaatagttaccacaactttggaactttgactttaattctctgagacaagtattgcattaaaaatactttatttacatatcacatgatcacagttaaaatggaatttcaatttgaaaagtaattttaaaatcctattaattgttttaactattgattatttgtggcttcatatacttcttaaagaactaaagtggaagtagaaaaaggaactagtacctctggctatttttaaagcagagtcacctctcaaaacttctgtgtcaaagttgtgggttttatctacttcgtattttcagttaaactcagaaacaattgaaaagtcagggcagactgtactctttaatgtaatttatttgacaatgcatatatgttttcacatatgtaaagtttcctttccctaagatactgcctaggactggctgggtaagggagatctgtacagtaatttggactgatgttttatggatatgttttatattcaagacacagtctgacctattaaccatctaatctatgaattatttgacagtgttatgcaatcaaatttaaaatatggtagatccattatgtcacctcttttcttatttatttatcttagtgagacttatagctcttaaaattatatattttattcctaccatttctcccaccttcccaatttatccctactcatatttaaatgtgtgtaatttaaaggagtgttctgatacttatccaaatctatattttacttggtaaaaagttaacacactttgcatcatttcacttatttaatcttttcatataaggctgacagccccaaattctatatagaaggcattgctctatagtcacacctcatatatctggcattattgggaaaggaggtttccacatgattgaattttccagataattcagctgagcttggagtgcttttgttgagcgtctaccatgtggcaagcacagaggacataaggccgagtaaatagggcctcagaagctcatagcctggaggccagggactgtggtggggctgccacacacagactttaataactataatacaatgtgctaagaacgatgatgtaaatatgcactaagtgttgtggaaatagaaatgaagagaaagttaattttttacttggaagggtaagggaccttagggaaagcctctgagaggagttcactattgagctgaacttttcaagaagagtaggaagtttccataggcaaaacaacaaatggggaaagaatagggagagagagagagaaagagagagagagggagaaagagagagggaaggagggagagagagagagacagagagagagagggcagaggtgtatgccagaagaaatgttcctaagcactaaaatgtttaagtgtataaaaaagttcaagcgtataatgaattaaattaatacaataaaatgatcaatgccagtgttactactaataagaatagcatccagcacttacacatttaatggacactcaccatgtgtctggcgctgtgctaagtgctttacttgaattaattttttcacaaatatatatatttatgtattccctaaagaaaatgtgctatgtagaatcaaccttttcctaatgctctgctatgaatataaatttctgtactccattgtgaaaacattttaagctagcctgctcgatgtcattagccaccttcagtacttggatatatatagttaagctgtcatcattccagttcacagtcagcttcatatttacatcatctccccctgcctccttcttctctaagatttgtgattcttctgcggacatacttcagaaggtactctgacattttccactcaggaagatttcctgggctcttgagagcagggtgccagaacaggacactcagatgggagattatgtttctaaagtgtctagaacggtacacaagcatagcttgcatatcttcagtgtgtggggatcatgctctattttagaggttcttacctggggtgattttggtccctaggagacatttagcaatgtatggaaacactttattttgtcatccacaattgatagggggcaggtatgtgtgtgtattgttactagcatttagtgcgtagatatgctggagtagtaatgtgggtaggaatgctgctaaaccttctaaaatggacaggacagctcctctgcctcacagagtgctttgatccaaaatgtccttggtaccaaggttgagaaatcttgctctatttgaagatttaagatataaacctaaagtggaaatagtttgtgccataagctaatatgtcagtgaattttgctttgaccatttaatattttggatcataagactcataagatgaaagagctcttaggagtttgtactgggtacattgctcattcactgcatgaaaaatggttgaactgtctgtgtaatagcctcatgtcctttttgcttgttgaatgaggggacctcctgggtgtatacctggtagcacatgtttaaatttctctgcaggggaaaaatgtgagatgatgtaatgccaggaaacctactaaatattaaaaatgtcttggcaattaaaaaaattctgctcagtgaaaagtgattaaattttcttagtgagattccaactttttttcatttctgccatgcttttcattcaattgcatctaatattactattttaccagttttcatctgtaccttttaaatgcagcatggaattagatattctgaaaattaatggttagtaagatttatagaattgtataatcccacatttattttggggaaaaaaagcgatttaccatttgaaaacattgatcaatttgaattgaaacccaattcaaattctagcccatataagctaaaagctgctgatgagggaaactttgaaccttataaactctagaatttaccattattaatttgtagtctcttgaataatatgatggtatttatgacaaatacccagagagagatgtatgctttctccttgggtggccatcattatatttttattggacttgataagctattcaaggaaaaaaggagatggaagaaagtgaaatagttataataatagaagctttgggaaaagtggagatgtcgttgtggactacaagttttgtactttatgaaaataaagtagtgtggcatcctttcctctaaaatttgtctgtgtagcttctagataatttcttaaagcttttctggaccaggtttaagtgcttcatgattagatagtagagtggctatcctattggtttctcctttttgtttctctttgaatataaaaaatatgtggctatcctcttggttaagtatcctttttctctctctttctctctccatatatatatgtatataatatatgcatgcatacacacatatacatatattcatgtaattgaaaccacaaccacaaccagggttaatattccttttcttatctcttcttcttgattatataaatgattttacttattttttataagttttcaacccatttttttctccagtagaactgagaggtggttttattatggattatgtatcaaaaatattcctaaagttaaagaagatgaataaatttctatttccaaagtttctaagtacaggttgttaaataacttttacatttgtaattgcataaatcacttctgactataatgagttggatgcaagaataatgcatacaactcatatacatttacacactatacatgtagtttgttaagaaagtagcaattatagtaatttgtatatcatttttatttgtgtattcttttatccttgcaatagatttttgaggtagaaattactttaattttcatttagagaatattcatttaatcttcttttaatcttcatttaaagaagaaggaagataactttagaaaggtgactttaaagaacataatgatttttttctaatattaagtaaagcctgagtatagcaagtcagcgttgaaattaagcaggcaccaactccatctatgattgtggttcctagattcatgaaggtacatggatagtgtggctctttaaagtatctgtggggtgggtcaagatggttgactagaagcagtagcgataggaggctcccattgagaagaaccacaacagcatgcaaatcctacaccagcaaccgaggtatccaggttctgtcatcagaactgactgggcagctggtgtgacccatggagaggaaggaagagcagtggggtgcggtggcccacctgagggcctcatggggcagaggggccaccaccccccagccaagggaggtggtgagtgagcatgctatccaacctgggaaaacatgctttttccatggaactgtgcagcccacagattggaagatcccacgtgtgagcccacgccaccagtgcctagggtcccaaccatggacctgtgcaggttctcaacagccagtaagctagaatctgcttaagcctgctgagctcacagagggaggagtgaccagaaccacagctgtggttgactgctgtcaaagccatttgaggtccttgggggagggtgagagccaacaccgggacagataactgcctaatacattaacctcctatggcaggagaagggcagcagccatctctatagctccaggctgtgcttttccttagctggacccagggagactggatggcttggtcccaagaagtatccctcacagccaaacacatcagctgtggcatactgtggacagagtgcctcttcaggcctgaccttgacccatccctcctcactgggcagggccttcctgcaggagcttctaaaactccaaccaggtgctcagggacagaactctgatctccctggacctgatcccctagtgggaggggtggtcacagtctccaaagaccagcagacttagtctttcctctggctagttctgaggaagtcaggaagcccagaagagtgggtttctccccccactgaagtacacctcctccatcaaggaacagtcaaagtgctttgttaaactggtcctgctccccatgccatccaactgggtgagaccctccaacagggatcatcagacaccctatacaggagcgttcctactggcatcatgtcagtatataaacacatgtcagtactataaacacctctattcaaataaactataaaatctagaagaaatggataaattcctagacacatacaccctcccaagacttaaccaggaagaatttgaatccttgaatagaccaataacagttctgaaattgagccagtaataaatagcctaccaaccgaaaaaaaaccaggaccagatcgattaacagccggattctaccagaagtacaaagaggagctggtaccattcctttagctactatttcaaacaattgaaaagggatgagtccttccttccttttatggggccagcatcatcctgataccaaaaccttccagagacacaacgaagaaagaaaacttcaggccaatatccctaatgaacatcgatgtgaaaatcctcaataaaatactggcaaaccgattccagcagcacatccaaaagcttatccaccacgatcaagttgacttgatccctgggatgcaaggctggttcaacatatgcaaatcaataaatgtaatccatcacataaacagaaccaatgacaaaaatcacatggtcatcccaatagatgcaggcctttgataaagttcaacatcccttcatgttaaaaactctcaataaattaggtattgatgaaaaaatctcaaaataataagagctatttatgacaaacccacagccaattcatactgaatgggcaaaagctggaagcattccctttaaaaaccgacacaagataaggatgccccctctcaccattcctattcaacatagtattggaagttctggccagggcaatcaggcaagagaaagaaataaagggtattcagataggaagagaggaggtcaaattgtctctgtttgcagatggcatgattctacatttagaaaaccccattgtctcagcccccaaactccttaagttgataagcaacttccaaaaagtctcaggatacaaaatcaatgtgcaaaaatcacaagcattcctatacaccaataatagacaagcagagagccaaatcatgaatgaactcccattcacaattgctacaaagagaataaaatgcctaggaatacagctaacaagggatgtgaaggacctcttcaaggaaaactacaaactactactcaaggaaataagacagaacacaaacaaatggaaaaacattctattcttgtggataggaagaatcaatataatgaaaatggccatactgcccaaagtaacttatagattcagtgctattcccatcaaactaccattggcattccccacagaattagaaaaaactactttaaatttcatatggaatcaaaaaggagtctgtagagccaagacattcctaagcaaaaagaacaaagctggaggcatcatgctacctaacttcaaactatacatcaaggatgcactaaccaaaacagcatggcactgctaccaaaacggacagatagaccaatgaaaaagaacagagacctcagaaataacaccacacatctacaaccatctgattgtcaacaaaccagacaaaaacaagcaatggggaaaggattccctatttaataaatggtgttgagaaaactggctagccatatgcagaaagctgaaactggacccctttcttacaccttatagaaaaattaactcaagatggactgaagacttaaatgtaaagccccaaatcataaaaaccctagaagaaaacctaggcaataccattcaggacataggcatgggcaaatactttatgatgaaaatgccaaaagcaattgcaacaaaagccaaaagtaataaatgagatctaattaaactaaagagcttctgcacagcaaaagaaactatcatcagagtgaacagacaacctacagaaggggagaaaatgtttgtattctactcatctgatgaaggtctgatacccagaatctacaaggaacttaaacaagtttacaaggaaaaaaaaataaccccatcaaaaagtgggcaaaggatatgaacagacacttctcaaaagaagacatttatgcggccaacaaacatatgaaaaaaagctcaacatcactaatcattagagaaatgcaaatcaaaaccacagtgagctaccatctctcacaccagtcagaatggcgattattaaaaagtcaataaacaatagatgctggtgaggatgtggagagataggaatgcttttacactgttggtgggaatgtaaattagttcaaccactgtggaagacaatgtgccgattcctcaaggatctagaaccagaaataccatctgacccagcaatcccattactggatatatacccaagggaatataaatcattctgctataaagcaaagacgtggaactaactcaaatgcccatcaatgataaactggttaaagaaaatatgctacatatacaccatggaatactataaagccataaaaaggaatgagatcatgtcctttgcagggacatggatgaatctggtcaaggggagggagagcatgagaacaaatagctaatcatgtggggcttaaaactttgatgacgggttgataggtgcagcaaactaccatggcacatatatacctatgtaacaaacctacaggttatgcactagtatcccggaacctaaagtaaaataattaaataaataaaatcaagtatctgtgagtcttacagcttattggcacctgataccaatgagaaatgttcaattatatttttaaaacaagcaaacacttttgccatgtgtctataatatagtactcttgataaaagagatttcatcaaaagatgaatgggcatcccatccagtgcatattagtttacccaatgtctcttgctaagaggtgatttcatttataatgaaattttgcatttgaactctaaggatagtgttgtagagaggtaaataagcatttgcttattccagaagattttctgtactgtacatacatctcttcttacattgaaatagtgcaagaagttctatcttccacatacaaacttaaatgcatcctataagtagcctcatgattatcacattaaaaatccctttacatgactgtttgcacctatttccccaaactccacagtatttgtcctttccacatcataaccatattcacagatataaaactttactttcaattccttctctttctcatagttaattcacccctcaatgcactgtaatttgattttcataactccactcaactagtcatctaccatcagcctcctctttaccagatcttatactttttctttcttcttattctcctcagtatttgatattgttgatcattccctatttaatatgtgaaatatcctaatcaggggaatatattagtttcctagaattgccataacagatgactaaaaactatgatggcttaatacaataggaagttgttttcttacagttctgaaggctaggtttcccaaatcaaggaattggtaaggccacgcaccctccaaaacctctagaggatgatgcttccttcccgttttcatcttctggtagccctagaagttccttggctgtgtgaagatactgtaattccaatctcctcttccatcttcatgtggctctcttccttctgtgtgtctctatctttgtgtctctcctcttcttcttataaggatactggttatattgaaatatggcttacctcatcttaacttgattacatttgcaagcatatttccaaataagatcacattcacaagtatgagggactagtacttcaacatatgtttttgaaagacacaatttaacccataacagggagtaagctagatagtgattgataagaaaaataaaattattgtgagtcataaggaataagatatttattatagggatttgactttctgcaatcatgggacctggttaaatagttcttgtaaggctgttgcttctctatcttgtgatgggtctaaagttagcttcccataggcagctgggaagaaaaacagatacagaattggagagaaaaagaagaactagaacttttcaggatatgctggagccccaaggacaaattagaaaccatgtctttctcatgcctttggagttccaactttaatgatgtgcgtggcctgcaggggagattggtatgcttcaccatgaattccacaaactcctttgcttaggatgtagagaagctgaaggaggtgatcttgcagaaggaattgtgggccagaatttggagaagctgacggagctgttactcaatggaagctgaaagagcccaggtgctcccaacagtaaggtgagctagcagatcagtgacaatgtatgcgagcagcagaaaagcctggcactttaccaattatccaatcataaacttgggtgctgcttccattccactacccaactcctgtgcagatttctctgatggctaacttcaaagcagccccaaacaaattcccaagggaattctggaatttgtcatttctgtttaggtaatatgacaatgtacatagtcacaacagtccatccttgtcaatttggcactaatatacatcttttatacccattcataacttcttcctgtttttttttttgtttgttttgttttgtttgaggcagagcttcgctcttgtcacataggctggagtgcaatggcgtgatctcagctcactgcaacctctgcctcctgggtttaagcgattctcctgcctcagcctcccgagtagctgggattacaggcgcctgccccccccacccccccaccccagctaatttttgtatttttagtggagacggggttttgccatgttagccaggctggtctcgaactcctgacctcgggtaatctgctcaccttggcctcccaagtgctgggattacaggcatgagccaccgcacccggcaccattcataacttataaaaaatgtaatagcaaagtaattctgccttttaatccatctttggatgttgttcattccttttctagctgagccatactccccctttgaagtattgtaatttcaatactgaaatatgtgattagctactatcaacactgcttatactagatgggaggtagatggggaagaaaaggggaaaaaaagaattatttaatatatattaggtaggtgcaaaagtacttgtggtttttgccattaaaagtaatggcaaaaatacatatatatttaatacaaaaacataaatatattaatttcaaaataaggaataaataccatattacaatactcatttctgcagctagtcacatggttgcagttggtatttataatttccttcttttactatgctatcaattttctgtttattttgacaagcaccatggctggtcacttttccttatctagtaaggtaaatcaaatatttattgttgaagtgtctgggccattagcgataatgcctgcaatgaactgtgattttccatttacttttgtcatatgacaagggagtacgaagtggtgttccaggtgatctcttgtactctatgcatactcctcattactcatattgtggtagtagtagtccaatttccctttgatatttagaatcattgattcacatggtatagtaaccacttactggcttcttgattcactggcatgaggagtcgaagtggccgggtagctgtttcaacttccaatttaatagaactattgccatggacactagagttagcattgtaccattgggaactaagagctctggaccaacatagcccaatgtcttgggagtcagaagcacagattttgctagttgaatcatagatagtgagttgagaggaaccacttccatttccaccccttgatttccagaccatgagacatctggctatgagagaaacagtcatccttgctatattggttactgatttagatcatataaagcttccttgaaggatatcagttcattcttgtaaaatattggtacccaacttgtggcataactgagtcttcaaaaggccatccttttgatgggaagcatgggaagaccggtgacttccgtaagcatgagcccattttttatcagaagcgatgcagtatggaattctatggataagtgaataaggcattctggaagttcatgtgtggtaattttggggagaagcatcatggacaaagaagacagattcatatccagagcaccctttccagagagaacgaagtactgcccttccagtactgaagtaagtgttccagtataattagccaagagcaaagtggagatttatcctcctgggaaatgcttctgcaaggatttatggtagagatttgaccttatgcattcctagagctaaccaatctatttaagtctgttgctctgcatctgaagctgggcttaaggtccacaggacagagtcagaaaggaaagatgcattgggggaaacaaggacaaaacagaacctgtgaagataatctggaacccatgaggacaaagtggaacctacctccaagtctccaacttcaatgatgcagttgactttctagccgccaagtcctttcctttagaagcggatgccttgccctagattcagaggaactaaatagggagaattagtgggatctgaaggagctgcatgctcaacaccaataagatgaaccagcagatctccacaatatgtctaagttgcaataacacttgaccacaaggtagtcttctaagcataaatatggctactgcttcgctgccaccttctaaatgttacccaaatttcctttgcagccaaccctaatcccaaacgatacacagtagttccagcttagttgaattgatatagtataaaaccaccatggagtgtgaaaatacgttaaattgaaaaagtgaataaatgaattaatagatagatggatttgtgaaatgacagccaaagtcacttcttagctgtttctacccaacttgttttaggctagtggctcagatcaacctttcagtggtccagtccaaatatcagtgcttttcttcaagataaggaaagcaattgagttatggtttgggagtaaagggagctgatattttataagagaaagtgttctgaaaatggaaaactgggttctgatccccctattggctaagtgaacatggaaaattatttgatttctctttaaatttccttatgaaaaaatagtttggctaagtaatttatatctcactcagttctagtattctgtgatttattttggtcactttcagagttaaaatcccagactcattgatttcacatcaaacattcttggtcaattttttttgtcttataatgagaatactccatttattcagctgactagaaaaatagaggaagttaacatttccaatactacatgcctggtgtgctactaggcctgttcacatcccttatatatcgaattataaggagaacacattatcataatataatcatatcaaatgatattccctttactcaagtaaaagatcaaacaaattagagcaagaagttgaatgtttatacacttgattttttgtataagcataggtagataatgaatacacttaaaatagacaaaactataatagtttgttaatatttcgcatacatattttaattcacatgttgtctgaaatgattaatatagtattccttgtttcactctcaaaacatatatatgatggctttttcttcaaacttgtctcatgcatctttgacattatgcctttatcactagaatcacatttttaatcatatatcacagtgttaataagtatatcgtcttcagatccatctatgttgtttgaaaagtagcatttttgtatatttgtgtatgatactgtcattggaaatactatgctatcgaaagtgcaggaatccacaggttgtgtgtgtgtgtatacatgtgtgtttgttgttgttttttagcatttatttaaatgcataaatgttatatccacaatgcaacctctaactctattcttatataagggaagggtacttatataagtgctttttaaaaaggtgatgtttcactgtggggaggtctgtgcaaacctaccccaaagtcccaggaatctgagaggctgaagagacaggctgacaaaaccagtttccttggaagaaatatttaatagggacttaggaacagaagccatgtctgtatctcgggcagcagcaagttgagatggtggattcccacaccatcacccagggagcagagatggttcagaagggagctgtaggacaattgaagtatgataacataaaggttgtttgacctaaaggcagaatttgcgtaagtacctgctcttacacaaggaagatagataaactgaaaatattagagggcttcccagaacagaagttaatcagaagccaatagagtggattagctttcaagatggagttgctttggcctccacaggtaaacttctaaagacagtcaatagttgaagttttgaaacaacactcccagaaatactttctaaactttttgtgccttgttttctctacctcctccttctccttttctcctctttctgctcctctctttttcttcttccccctttttgtaaatacaaaattaacactgatagaggttatttgaaggtaatgttcttctctaaataatactttcccaaaactcataggtcaaaatgaagcaatttagagacatttgtattatggcagaccctataaaagattgcagatttaagtgtaatttacctcttaaccagatagatattcaaagtattgcacttggtcttgatcaaacattttaaggcagggattgtcataccatttttaatatacagggaaattgaggttgaggaattccttaattgttcaagatctgtctgatctccaaatctttatagcactagattgatattgataaaaagatgataaatattaatttcttagctatatagcttctatattctcattccaccaattagcatcttcggttgagttatgctaatggtagtaacttaaattctgctgaattttggttcctgctgtttagtctttagtgtagtgtccttctggtattttaagattctcaaggtatgtatgcaaaactctttcttctttcactaaaataaaaggcactcatgcaagtaaatatacacaaacataccaatagcccatgtataactagacatgtttaaacttctggtcatgatgagtcagacctgctcaaatgtatttgtattgacaataaatgtatgtatatattatatattactattcacctttgagcagctaaacttaatattccaaaatatttcatatctgataagcttatttgatactacaaatctaactttatctgttaaacctgactctgtatttaacaacagcatgatgactttattaaccatagaggaaattattatactgatctatatcacaatcaagatgaacaatgaaattttacctgaaaaagaaaatgcaaattttagtcattatgatttctattaatataaatttactttcacatatttgtttttgaaaacctctcagtcttgataagtgctatgttgtcaataaagacagactattcacatccaggaatatttacattcccaccttaaaaaaacccgctttattagtattatgtattagtattagtattatgggttgaattgtgccctctcccccgatgttgaagtcctagcctccagtaactcagaatgtgaccttttttggacatagggtctttgcaaaggcagttgacctaaagtgaggtcagtagaatgaatcctaacccaatacgactggtgtccttatgaaaagaggaaatttagacacaaagacatgcataggagaaaagatgatgagaagggatacagggagaagacaacagtctacaagccaaggagagagcctggaacagatcttttcctccggtttcagaaagaaccgaccctgctgacaccttgattttggaattctagcctccagaaatgagagaaaatcaattgcaaactctagtctggtattttgttatgacagccttagaaaacaatcacacgcagtggctcacgcctgtaatcccagcactttgggaggccgaggtgggtggatgacgaggtcaggagatcgagaccatcctggctagcatgatgaaaccccgtctctactaaaaatataaaaaattagccgggcgtggtggcaggcgcctgtagtcccagctactcgggaggctgaagcaggagaatggcacgaaccctggaggtggatcttgcagtgagctgagatcgcaccactgcactccagcctgggcgacagagctagactccgtctcaaaaaaaaaaaaaaaaaaaagaaaagaaaataatcacaaacaccattctgaaatatttgcttatgcacattcatgtaaatgggctttttctttgctacaatgtaggctttaatttcaagtattgtaactgcaccttatttaaaggatttatggaattatttttgctacaaataaatatgttttttctttatacatgtattttctctatcgcactgttcttaaatgcattactatttaaaatgttcttttattggatattgtaagaatttcttttaaaaagtgaagcaaaactggtgaggcaggacaactttaacaagtttattttatactgttcatgggaaatacttaggatattttactattcccggtagtataagtgccatattttagtggagaaattttatacttcaaaataaatcccctctaacattctacagaatggggttgggggggacttgtttttaagaacctgctatgaaaggggccatatgagtaaaaattacagaattattaccactgtgtttattactcatagtcttgattctcctcaagcatattctgttgtctataggtaatgcagaagagcttcgtatatgaaaggagaaaggagaaattaaataatttgtcagtcaaaagtaaaatagctttgaccattaatagaaaactgtgcacttatgaaatcaattaaactttcataacttttcagaggtgaactagaaatatatggctctttttagaccataccacttcatcttcccagatttactttccaatgaattgcaatttgcatcaccgaaattcagatatttaggccattcttgatgctttttctaaatatatacatcatcattctcagtaaactatcgcaagaacaaagaaccaaacaccgcatattctcactcataggtgagaattgaacaatgagaacatatgggcacaggaaggggaacatcacactctggggactgttgtggggtggggggagggggaagggatagcattgggagatatacctaatgctagatgacgagttggtaggtgcagcgcaccagcatggcacatatatacatatgtaactaacctgcacattgtgcacatggaccctaaaacttaaagtataataataaaaaaaaagaaaaaaaatacaaattccataagaaaaaaatatatatatatacatttaaactggaactgtctccttcatagacatgctggaaagttttgggatttgaacatggagagtttggagaatttttttttcctgaagagatggcacaatttaaaaataatagaaaatatcattgaaatgactaccaaaagaaatttgttaattttgcttctgaaagtttacctccttgttcttttttgtttttcatgtctttattaatatcatgccaagggatgacattatgagccttgcagaattgattaggacatttttgccatatttcaaatgaaagcagacctgaaatcagtgtagcactcaagtatttcccaaggtacagggtgactgctcctgtttaagaagtgaacagtgtaaatgagttaattccaagattaaggtctcagagatatttaccaaatatctcaaaactttaagacaattcttattttcttgtctgcttatttggaggatttttcaatttaggaggaagaggaagaatttaactgacctgctatcacactgggactataaagggttctacaaattctagtgagaactaaaggaatcattttactgctttgtatgatatgcttgttataagtctgcagtatctaaaactgaatcctatatcagatgtgaaaaaagcaagcgtttcaatccttcctttggtaaacactatgactgtaattgtgaaaagacaataaaacattcatagtttgtattaggatatttagattatttccttatcatattacatttatttgaatttctctagattaatagaaaaaaatctagttaagaaacgaagatgtagtttctaagatacacattttttaactttgtttttgttaaaatggttcacttttaaatttgagtatttttcattaaaaaagtatgatttattaaaaatgtgttttcacattttgtaagccacccttaaagtgacttctatgatgtatacagacagaaaatgcagtaaaatagtatttaacacagtatgttgatatttaacctagtataataatattaaacaatgaatagctctattgttttctatataaataatatgctcttaaatagattcaatacaatatcaaaggtcataaaatgcataatggtgttatttctactctatcttgagggagatacagtgttttacagttaacctatttgagcctgaatgttttcaatactaaggagctgttgtaaagattaaatgtcagaaataggtaattttagctcagaaactgcctgtagtaagagaataataaattattcattataattcaacaaatgtttatacatttataaatataatgctaaaattaagattcagcaatacaaccataaatgttaataacagtaacactgtgcagattattctaaaatatataagtaagttcatattcacagccattactgtcccaaggggacttaagcttgcagaagatattaacaaaagttctcatagattgtgccactcaactcatgggatttatccttaaaccagtggtattactctgtaatactctcttggtgtttggtatccataaaataattatataataaaaatagaaaaaatattagaaaactccttctaaaacagatgattgcattacatcctgcctgtgttccattcatttgagaattcacattcatccaaactggaacaactactttcatttgactctattcagtttaatcctttgttttgaggactacttacagatggtggttaccgggaacactgatgaccagggatcaaattaagagcactaagtcagtttataaaggccaatgaaaagcaggaaaatggaaattactttcagatagagattactaatttgtaccaggtttggttgggagcctagtaacaaaggttttgtatcttattactcatcacttgagtcacttgttcctcttgttctttaactaactgctgttattttacaaactgcttttgtaatgttttcacttaagtctaggaaataatgatgttcatttaaacctttaactttttttgttgttccttttctttttagggatgcagatctgttcttgttagacacaagaaaggcccaagctttagatgtgggttggcttgtctttgatatcactgtgaccagcaatcattgggtgattaatccccagaataatttgggcttacagctctgtgcagaaacaggggatggtaagcactgaattttatatatttttttgtgaagcttgtttgacacattgagagttatcgttttttatgtgatataaccaatatatgttttatatttatgatgtccaagtcaacgcattctatagggtagtgcaaaactatattagttagttaatcaattcagaacacatttatccaatacatttattgtcaggctctggggtgggaggtaaagaagacgtaggtactgctactgttctcaaggaatttttagtctagtgttgaagacctgtatatgtaagtaagtagcactactctaatacaacaataccaaaataatatagttgtggtggttacacaactatacgatttgtaaaaatttatggaactgtacatcaaataagaataaatattactatatgcaaattatgtcttaaagctcgactaaaacaatgataaatatgtatcaaaaaagacactagggaagtaaaggagctaccaataatacaaagtgggagagaggagatggggatggaatgagtcacaaaaaactgcagaaaaataataccaagttagttctttacatattgcaatgtttgatcaaagactactgctccagaagtacttgtggaagggtctgtgggaaatcttcacttttaagaaggtccagaagtaattcttatgctcacaagtatttactgggcacctactatatgccctaatactgaaaaatagtgacacatcaaagacaccatgggaaagcagaacatacacagctaaagacacctgggatggagccaaaagagccacttggtgagattctggagatataaaagtgagccaatgcagatggctttatgagacttgcatttgagtgatgcacgaggtagtaataacacaatagtattagtgaatgcatatcacagcacactgaggtgttcaatggatctgtgaacataggatggtgactagatttgagctataatctgaaacacgaagatgtgattaggggaagaagttggggggcaggcaattcagacacatggaacagaatttgcagactgtggtgatggtgatactggcatatttgctcagaaggctcaggaagccaaggccaatatattcagatctttgttgccctttgatcactcaaagttcaaacactctaaactcaaatctagacttgcaggtcatttaaaattatatttgtcatgataggaggataagacataatttaatggtgtcctacctttaaatacttaatatttaattttaaatatttataaaaaacatcatggagatctacattgtgctgttattctctaccctaaaaatgttatcaccagggacagggaggataatttttaaaaagatcattaataagagaacgtatcttatttaaggttcactgcttcttgttgtcacagaatcaggcaagaaaaacattaggcctacagtctacctccctcatttttcattgcggtgttacacaaaagccttgtttaataaaccacagaggtaagtaaaagctgtgtctgtcttggacctttttcaaggagatttattgctataaatgcttaagacttcactatggcgttgttttacctgcagccagtttcatagcctatggataataccattaccgatgctgtgactgcaaagattgtatatatggaatgaagttcacacacaaattgaatatattaaagggttagtctagtgcgtgttttatgtgtctcaaatcttttttttttttttttttttgagacggagtcttgctgtttgttgcccaggctggagtgcagtggcgcaatctcggctcactgcaagctctgcctccccgattcaagccattctctcgcctcagcctcccgagtagccgggactacaggcgcctgccaccatgcccggctaatttttttgtatttttagtagagacggggtttcaccgtgttagccaggatggtctcgatctcctgacctcgtgatccgcccgccttggccttccaaagtgctgggattacaggcgtgagccaccgcgcccggcagggtctcaaatcttgatctagaaaaagaaagttcttactgaaagtattataggcaaaggttcagaccttccctatgctctcaaatccagatttttccatagcttttaattacaatgttgaattttcataaacaattcaaatattctggattataggttagagtacaattatggctttacgattatcattaaaggatcctcagagttcaagcattataaatgtagactgagtaaagcacaaatttaaataatcttccaagaattcttacaatgttaagctactgtacatttatcgtcagaaatgtgactgggaaattggcactggggaggtaagccaatcgttccttccctggtatgtggcccaaacaagaaaaatgaaattagtggtatgtgcttctcccactctcctctttggggatatgcttgaaatgtctaactaaacaaatcaagaaatctatgaaatatgatcagcctgtttccttttaatttccatcttccctcttgctccacgtggactttctaaagtttctctttttgttttttcccccactcttatcttgtattggttctctcttttactatttccataatttaacttctatgttgttttcaatttatctttttctctctgagaactagtctatattttgactttccctttctctatgattaattttctcttatattacatgggtaattttactttaaattactagtatgttattttttagcctagagtaaactaatgttttactcctttaaaaggtttccaaattccatatttgagagtttggtttgaaatatacagccttttgttgcttttccttatctctttgatattgtctaatttgaagaattttcaaatggttaaacatgctaggctagctggctttttgcttttaggcagtacttaaaacagattttaaccagaggtggaagagatagggccttgggaaagcaactgattctctgggcaccttagttttattaactgcaacttcatggagaatatacatgtgacatttccttataaatatgaataaccagatgcttcagcttattacagcttcactcattaccactgcttgtgttctcaatgtgacattgcttcagagcagacagaccatcttttattttcagtaatatattcctaacgttttcttctaagcaaaaggagttgaaaatcatgaaaggatgataggaaagtctgctttcaaattcatttgtaaactattattcatttatccatttgtccaacatataattattgagtatctgtgcatgcaaggtagcgggttacaaaagcatatcacctaagagacagatataggtagctaattttagaaataacaaagtgccctaatactgaaaaatagtgatacaacaaagacaccataggaaagcagaacatacatggctaaagacacctgggatggagccaaaagagccatggtagcggtggccttgaaactgggtcagcagttagattcgtaagaaatacagatgaagaggaagggaagtcatggaagtatgcgaagtgatggtgagggcaggataattcattcctggatgaagaaacagtaagtaaatgcacactatgtcaaaatggcgtggtatattctggaaaaatttaacagtccaggattggctagaacaactttcatgtgtaaaatgtgattgcagatgctattaggcaagtgatctgtaaacaaatcatgtaaggaatatgaaatctaaattaaatgtaatattctcttgtagcttgatcgtcagccataaaaaagaactaaacttactactttaatcaatcacagtaacaccactgtgattacaggtttgaatgaatgtcagtttcatgaggtcatgggacttgtatcactgattcgcacttgtaccctcagtgcgtggcacaatgcaggtcgtaggtattgaaaatgtcttgaatggtaattgagtgagtttgtaattaaaaaggtcttgtagttcacttgccactgaacatgttcctcttaagaagacattccaaactgtgagttttggaattagtaactaaaccagtttaatgtaacataggagcagaattttgtagagcaaaccacaatacagaaattaaatagtttaaatcataaggaaaggagaaagtcagtgatgtgtattattaaattttgtttagcctgcccctgtgaagaaaaaataccaaaaaggtctaaatatattttgggaatcaaaaggctgctgaaatcaaaagtagcattttgattcctcagagagcctgtggaaattatgtcagtttatgaaatactctttttagaaatttgacaaatgaactgcaatgtatttggcaagagagttcaagaatattttattattttttcatgctgaatagataattctcagagctccatatgtttgtttcagcaaaataatacaaacatatgagcaagcaaatgaaaaaatatattgccgcttcttaatggcaaaatttagacattccagacaagatgttatatccaattttacaaaattggttttaaagttctcaagcactttctcatggtggttaataaacctctatgataaaataaattctatttttgtttttaatagcaaatgagtaggcttaaatctgtcctaaattattgtaagatttctagttccctacattataatgatacattaattaactgacatactaggtctttattaacattgctaataaatctacagtaatgatttttcctacacacatatgcacatagtttattacacagatagcaatttaatctaactttaaagacttgagttttccccccaaacactataattttccgttgtttgatgctttatatagcttaagccttccaagtagattaattctttttttcaaacttgggtttatagaataatttagagattgaaaaacaaagatagcattttggggttcattagaatgtcttttaaaaagccctatgttttcagacattttcggtttggcaatactcagaatgaattttgccagtgactttttttctttctattcaaacttgcttatacatcaagaaaaattcaatccgtatgtttctgattcatttgtattcaagtcatcaaaatgtcgttttgtcagagagttgtttaatgtccaagaaacattataaggttattttttagaagtaggacttaagagccattttgaaaacaaagtcagcataattttcaaccacatcaaggtaaaacttcaggtttaaagtcagaaagtttaaagtttcactaaattttgtacccaaatcaagaaaaaaaaaagatttcagaggtattaaactgtcaaattaaattatatggtaactgatacttaaatgtaaaataaagaaacattgcttacagtaacttagaatttaaagttttgatatttaaatgaggaggataaatgaacagatagctacattctggaaataaacattttaaaaagaaatcattaggaaaattagattaaaatctgggctctgataaaatacttaccattctagccattgcattgcatcaataaaatgagtgtgatagtaattacctcacaaggtatgtgaagttgtattagatgatagtagctggcacatggtagggcacaaataaagttctgtatgataaattggactagagattgcacagacttttcacttacattagctctggttatcactcctttaacttgggactagttcttttattgtggaggttttgcagatgatttaaatacattttagataaattcacaagtgatagtccacagggaaaaggtcagattgatgtatattctgaaactttgagttgacagcagagtatataggcagttatgttattaagctcatgtttaataacattgattgataaaataattactaataagaaagttttaacctgtttcaatctagggtgtgaagtcaatagaaatgaacccattttgttcttagaaaaacaacatatttttggagattactaatttaatcaatgaaaataagggaaacaagcttttcgtaatgcaataggattatatatggggctaatttattaaaggctggccaacattagcataaaaactcctgtttaaaatgcctcaggacaaattactagtatttgagttaataaacctattagtaagcgttaaacagtagaatggattcttacaaagataattgaattacaagcaggattttaatgttcatagaacacaagatcaaataaatattagtagtctttgataaagagtagggtccaatggtccctaatacatgttgtgctgatgtttataccaaaccatataaaatctccaccatgtaaatggtatttcccaaaaaatgctgggaaagctgagattttagattttgagatttagattttagaaaatcagagattttctaaaagtaccaacagtttaatcctcttttattttcgccaatattattctgcaaacttcaaataaagtcttttgttatcaggacaattatcttgaaagtgggtaattttacatttcattacccaggatgttgctgtgttctctccttttcaacctgtgataatttttgttgttgttgttcattcccagtaattgacaactgttacagctatgttaacaaagaacaggattcatctttttcttcaacattgggttgtttttcattcctacctgcacagtaatttaacatactgataacatttcttttccaaattaaaatatccagtaatatttcctaaatgtattctgttaaactcagtttttccaaaattgccacatcttttgaattgcagtatattcctaattagaaacatatattccagtatctaaagtccacatgtgattatatattaaacaaagatataatttacaactgaatattcttttaggtttataaaatttaagtgtatttgtgtgagaaatgcagagttcttaatataatatctacttaaatttagtaagtcctagaatctgctatttttaaatggaagtatctgcctaagtttgttgtgttattcttcgtatccctaagagagtggtttttacctcagggaaagagctccaaattaagcctctgtgttgtcagaggtttaatttatctgtgtcaagggttagatgatctatatggctgggtaatctgaatatcagctgacagtgctaataagtagcagaagaaattcaaagatcaagggtgatatttttctttttctcctgctgttttgactacagtttctcattattatttatctaagttcaaaaagttgaattatgtccacttatctgaggatcttttaaacattctaagatttgataatatttccttctcttatctgaatcttatcttttgaagtaattaagtcatttttgttcataaaaccatatggctccccttttgctgaatttatggtgatgacaattggttttaaataaacaaatgagagagtatctatatccaagaaactgaaagaatcacatatcttgctggaggttctgaaaggaaaaaagaagatatacacttatgatttgctctagataaatattgttataaataagtagttctttatgtattgtctaatgtttaaggataattagctttgacttctggattaatatttaagaataaattaggaggacagcagaagaatagttatcttccagtacctgaagaaatgaaattaataaataaaattgaactttttctctacagtccacaagttaaatcaatgtgcataaaaggcaaactgagggctctttacaaaagaaaaaaaaagcctgaataatggaagccaatggccttagaattgtttgttctgtgaggaataagctctatgtgacttgaagaattcactatttagttgacttcttgtctaggaattatacagcataatgtaaattttcaggtaatttctacagtcacttacaaccttgctgcatcatggaatggtacgccaattgtaatctttaagcatatatttatactttaagcattatattcatgtataaaaaaacactatatgtagagagggtacagtgaatggaaatgcattgtcttagaggaggctggtattaaacagttacattcaaaccccaacttaagatatggtataaaaatagtgatggagaaactggtaaagagaagcgagaaagttagacatgtttttctgtgcgcatgcatgggtgtgtagacatggaatacccaggcatatacacattctcaagtaattgtgttagggatcaaatataaattcatagttgaaaatctataataagatttctagagagttctttttacagcatttagcaggattgtattttctttttaagtgccatactaaatgctttagtatcatagcaaaacataaaactcaatctaaatttttccataacattttagagtgccttctacttttatcaaattttttcatcaaatttcaaaaacatcaaaacataaattatctatggccatgtgttactttctgaaaaaatttttttttttttgcaagaaatcaagccttggagaaatatttaaaagatgtggctaagagaaacaactatgttggtcattttaatgtgaatgtttagcaaaagtgtcattgagaattcctgtacatttatggtaaacatgactagatttctactgaaaataaatatgacatagatttcccttggggtctgaaatcagtatttgttaattttccaaacccacgtatgctgtgacccatgggttttctaactcgcgtaatgtcttaaagcacatcggagaacataaatcttccctgtatgctttagttttttgtcatttgcccactgcatacaaatgagcaaaatgtctttcatggcaggagtaactgaacataaataacggatcactgttaaatttctacttggttcaaccagagatctcgttaattctcttattagccatatagaattttcataaaatatactccatgtattttcaaacattcttcttatcaacttattttctgtctatacaaatatcctcttttttatacgctgatttcagcaataccttttgccaatatcaatttgttctttcatgctaatatttagtatttttaaattctacatagttaatccaggtttaactttctaggtatatttttaattcattttcagtaagaatttaaaccatgcatttcctgtgatggacaactgaaatcaaataaataacattagtggaaactaacattgctgagagcttactcagtgttaaccattttgctaagctctttaaatgaaatatctacttcttcttaacccattttgtacacgagtaaatgtagcttaagaataaatctgaaaacgatttgttttcagagccaccctcttatatgctgactcttacaaattaaattagtcttttataaattctgaactgaaaaataattgtattgttataatttccaaataaaacaatgccattaaaaatgattataagggagagaattgaatttttgctgtatctgttgggaattatttttgggtttttatattttctgcctggagtttaattgtgatgtggtccacaatatgtaacagtaattctgtcacattttttattttctaaatcaaccttttcttttgtctctttgtgtaattatagttaatttgataaattaataaataggaaaggagaaaaagaaacttttcatctgctgatgattcacttcaacatgaaatttagtcaaatttaatctttttatttagaacttgataacaaaccccctcttcttaatttagtcttgtatgatgattcttaggcaggaaataatttctctttatagttattgattatagaatatattcaataataaattgaaagactaaattttgctgttttatcatgtacattgtataaacaatattttaaaaatagtctttttttcttttgaagacttgcatctctttgttatgtcctcttaggataattacatagcagtaaacattttaaaaagaataatatctgaaacatttggcatagtctagttactaagaaacgacagttctcttcttcaagtcccaaagcaggtaacatatgtaaggggagaattgcaggtttgatcatacttaagaacatcttacactggcagatcacaataacttaattcggaagtcttagcttttgttttaatttagtttatttatatttgaatgagagccatatggttaacatagtttgcttatccaaagttcagcatcgcaactaaaaaacatatatgaaaaaaggttttaaaattattgatttaaagtaagcagttacaaacaggagttagttgtggttcactatctggcaaaatatatattttactaatttttaaggtttcttttaatgaaaaggggttcagaagtgcttggctacatctgtatttctgtttttgattttccctaattcagaacagtaactatagagcaccagtcttaccaaacaaatgccaaagtcagaaatattttttagtttttgttgtttgttatattttctcttctagactctagctaaactgatgatctgtggggtaaatattttcatggtaatatcaatttaggatcatgaaaaatataaaatactacttattgtcatcatacactagggttgactctttcttttcttttctttctacttaagtttaacttattgttgacatatctctcaaagatatattgcaaaactagcagtagtgctggtatttgtatcctgagcagagagcacaagtgagaagaaaagagaacctttaatccttataaggcatgagcaaccacagtgtatctatactgctgagagttaaattttggcatgcgggtaataagattataagagagagaggaaaaccaaaacagaaacaaacaaacaaaaaacaaaggcatctaaccatcaaatccagtagtatatattggaagtggcaatcaaaatttggattagactaatactactttgacaattaaattatatatccccactccttaaaaatgtatgctaatttctctgtagtgtgacagtaattgaatctaagtttcaattagagtggaataggaactggggaagccacctgccttcttatggctaataagaagtattgagtcttcatcttcctacttacttactaaggaaagtctgatcctgaacttaacgaaagaagcagctataacattattcttggaaactacaatacgtatgccactgacaggctatttttcctccattcttctcaaggtgaaaatatttatacaggaacccaagatgaaagtattcaccaatctctaaaaagtggactactgtgtacttagaggaaaagcatactactttagtagtgtgacaaggctgagttaaaaatctgactcttttttgagccttattttaagaggataacagttgctttgctgtgaggagtaaataagatgtatacaaatcaactggtaaaatagttgtcttcagtacatggcagctgttgcttctctcttaatttcagaaatgttgaattggctttttcaattcccaatgtccctgatcctttcagacacgcttcttattactctcaggtaccagttatgtttatatgtagaagtattcttcacgttatttttctctgaagtaacacaactgatagaaatatggaagttgtacttatgctatgaggtcagatgacactgctgacctagattgagcacaagaaaacactcttggaaaccagctattattttgcatgcaaatggttcaggatgcttttgttctggaggccagcaaggaatcatggtggtgtaagatttcaccttgtaactcgtcccttatgtggggcaggctagatggccttctggccatagccagatacatgaaaaaatggtgaagaaaaattctgcttccttctactcagaagaatgctttatgatcagccttcatatgtgaagaaaataagccccaaatactaaaactccacatttttaaatttactttttatttataattgaaacaatattgcacatatttttgcggtacaatgtggtgtttcaatgcatgtgtacaaagtgtaatgaccaaatcaaagtgattatcatatccatcattttaaacgtttattatttctttgtggtagcagcattcaaaatgtgttcctgcagaagtagttactatggcatattacattaggtatctcagtatcagttctctactgcatattttagaaaatatagttcactttttttttcactttctttattaggtgccgaataatttatttttcttctattttgctggtactagactgatccaaagatcctggaagtagcctatgatcatttgataggttcatgtacaaatcaaaagggaaggtcaaatatttaacaaatagattttctgtatgataggccgaggtgggtgaatcacctgtggtcaggagtttgagaccagcctggtcaacatggtgaaaccctgtctctactaaaaaaatacaaaaacttcaccaggtgtggtggcacatgcctctagtcctagctactcaggagtctgaaggaggagaatcacttgaacttgggaggctgaggttgcagtgagccgaaatcacatcactgcgctccagcctgggcgacagaacgagactccatctcaaaaaaaaaaaaaaaaaatttggaataatatagtagctggtaaaagagtatctcctttagatactcagtaagtttcccaagtaactaagtttcaaagaccactttaattactataggtaaaatgcagaatactaaaatttcactgctgtgaaacaaactaaaatgtgtttgacatctaaaagctttttgtcattgatgttgtaacacaaagaaagagtttttaaagtttttggttgatttctgctgaaattctgcttccctatagttttactaaaatcccccaggcttctgaaggaaaagattctttcatttaagatatgtataatttttattttaaaaagtcacataataactggagaagaagaagaaaaataattcactgttctcatgattttgtgaaaagaatgtttctactttcttaaaataaatgagggctataagaccaactgctaaccaatctttttggggcatgtgacagatgatgtctgtaaagttcataggacctcaggggaaaggtgctatatataaagacaagagctattaaaaagtaagtgcttttgtggaggtaaactacaatccctagcgtgagattcatatttctagcggctgaaaatagggaccaagtaaaacacatttgttgggcttgtcatgcccgagacagcaagcccctcatttcagagtgatgtcccatggaaggaaactaatcattttccatcacctcagtcctgccctccatgcaataaaacatttcagcattctggacagcttccacaactgggcacaaacctctggccatgctgctttacagttctcagcttctctgtcctcaggccctacttcctggagcctcatgagcttgggttctcaagggtttgtgtttctccccctgcatgactttagttatcctgccaatgtttctgaccaaatatcccgtttcttttctaagccccgtcactttatcaaactgtggggcacgacagtatcttctgcaaaatttttagaaagaatgtcaacactttaaaaaatctctatcccctttaaacttctttatccctaacatacccaaatcatatagaaaaatggatttcttctactgctatatgttaccaggagttgtaaccacgtttctttctttctttctttctttctttctttttttttttttttttttttagtagtgatggggtttcactgtgttaaccagaatggtctcgatcttctgaccttgtgattggcccaccttggcctcccaaagtgctgggattacaggcgtgagccaccattcctggccataagcacgtttcttatccacagaaaactctcaactcatagttcatatcagtgtgtcagggtactgctactaataatagcccttcctggatttcatttttccagtccgtctttttttcccctttacttatgagccacagaatcctatgcttgtttgtacatattattacatttgtcccttcctttgattttcacacattaccaataatatataattatcaatatataatactggcaaagtggctttttttttagattactcttttaaatgtcagtaaaaagaagagaagagaaaagtccagccaaggtattgtacgccaaacctcatttgttaaacagaaccccagaattactgtgaagaatcactcaaaaatcttatcctgttctctacagttaaaagaaaattttaatacttaaaaaatagtttaaaatcccaacttttccttatttttgtttgaatttataaagcaatgtaaaccatttgaaaaacaagaaagtagtaaggaggaacgctaaatttctgtttgtgatacttcaagtctgtatacttaactctggcaacaggtctgcgcttttacaataaaactacaaaagatgcaaatttttcatcaaagtataacaaagttgaaatttgtagctagattacaatatacttaatttaagattatagtaaatttaagtatatatagaatttaagtagacaagattctatcttcctcacattccttaaaatctcatataaaaatgatttattctgtatgctgggtggtgaattctgtacgttttaaatgatcagtttctaaaaagggtagaattctagtataatttagagtcatataatccataatttcacagtaccagaatcaaagttaatcacaggttgaaaataagtgaagatcagatagatgtgtggatgggagataatacactgatttgactactgctaaggagtccataacggatactgcaagagccatttttgaaatgaagaaaagataatttgtgcacaagttccatcacaggtgttttgggttaagcagtcaattaccgtgggtttagaggagaaaaaaacgaactggaatgtatgctaacatctcaaagtgatatcaacgtttagactctgataaatcctcaaatgaatgtttttcaaactgtgtatcctagagggaaactcaatgatcatatttggaaccacttatccttataacatcaacatgtgtctgaagagctgttttatgtcagaatctcctttaataactctgttttgaaagaaataaacattttgaaaatcatattttccaaaaggagtggtctgaaatacaaaaccggtgagtctgggatagagctttggtttgccagtctaccttccctgtgactataaatttgaaatagtttcagttgtgttcttaggcaaatgtgaccacaatacactaacctcagtacttatatgaagtcatttgggttagagtagcagatctagaaggattgaatctccagccccaattatgacaaaatttagtagttcagcgctccagcctcatctacatccttcttgatctctttatgaatagaataataatttcttagaagatatcagtccaatcctatctttgttcactgagttaataaaactgtaaaataatatacccatatatttgctgctcaaattgtttctttatgattctggtacaataattttgaggagaaaataagatggacaaggtataaatatttcttaaaaaacttttcacgagcaaatatttaatatttttgtttgttttttgttttgttttgtttttgtaaatacaaaaagacaatatctatgtcaataacaaactctggatgcctacagttatagtcattaccactttcatttcataatccaagtattatatgatacccaaacctgaaataattaggaataaacaatgtttctttgggtctaactgccaccagcaagatcactgaaatgttggcacatccttcaagaaccctttcaatctcctctctgctgtctcttcttccctcccatttgtgtgtttaagcttgaacagcttccagcaaccaagctttttacctcctattaccaccccatccatttagcagatcacatccctaccctctttccagtgtccacatcaagacatggatatcatacaagggaatttttctcttgcaattggagccactttatcccatcactggcattgtctcttgctttgctttggtatagttattgatgcacattaaaactcccagtgttgtcagattgctgctccgctcagctttgagctggtactactctttgaagtcaatgctgatgactaatacagaagataatttcggagatcattctgttgctgccatcctgacccaatgtggaactgctcagaagccattcttctcatatagagagaatctttgttcaccacttctgccagtctgttaactaagttccaaagtagtgctaccttgtcttcccagtattttagagactttgggtaaaagggatgtattagattttctttgattccctttctttctaggagttaaacatgcatctattgaagctgtgccagaagtaactctgagttatagacttaaaaaaatatcactgcagctcatctttttcttaagatgacttcttgcccacaaaattgctcaatcttctttaaatatatgcctggcgaatcaaatctatcactgttctagctatgcctggatgtgtctgaatcctaaggtgactaagcttgggctcaagctggtatccttaccatactttattttaatgttctttttgttacctcacccccattttcatttccactgtatattcaatgcttcatctttatgtatgtttttaaactagaaactactctaaaacaagaatcagctttgaaaattaaatccatgttgatacacacatgtaaaggtaatgtgtttctaaatcaaaatgctttaggtaggcttcttcagttatatatttgcaatatctaaaacatactgtatgtttaataatatcatttaaaaagttcaaataaagttttataaagaatttactttttttttaatacatacggtgtagtctgggtttctctcagtacttctactaaaataactattcagtctttgaaaaggtttagtcaacataatcaatataagtgtattgtttctgaaatactaggtcaaatagttaatgcatctatggtgtagctcaagaccaagggtaactgagcaagcattaacttgtggaatcttaatagtcactccattgctgaagtaaaaaggaaaccaagaggaaacttaataatattaaaagttattttaaagggagttcacattggtttggagggtactttgcttcaaatacaatatccacctttgtaaaacccaagaaacccgtatttgtaacatacacacatcttttcagtttttagaacataaatcttcagatccgtattatttctccacagataaaaattaaaatattgaaagtctttggaataataacaaaagaaaccccctggcaacccaaaggaaacttggaacttcttgttaagtgcttatttaactataaaagagtcagtgtgtgttgtaatgaatggaaaattgattttattgtattccatttatgaacatctctcagcaacctatttcagtattagaaagatcatacattaaaaatgatttctgcagtcatcaatgtatacaagttaaaatttagctcctgttaaattaacacttcattaaaatatcaaaataaaagcttcgtcaaatacttttttatgttgtactccaagacagaaaaaaaaaatgaaaaaatttaaagaacagattgctagttattctattctataacagttaagtttctcagttcttttttttttcttttgctaagctctctgtcactggaaacatcttaaaccaatttcaagtgctacacctgaataaacatgttgtaaaagtgtttatgtattgaagtgggtcagttcaaggtatggtatttggctggaacttctaatttctctttttacagtgaaagggctgccagaaggaggaagtctgagctgaattaatacatttgttacagtggaagtagaatggaaactgctcggaccacaaatcaaactgcctctttcatttatgccagtgatagagtttttctaaaaaatatagactctggcatagagccactgtaagtttgcatttaaaagagaaatctatatgcttatttgtttaaggtttactgctttgattatttgtaagtcccttctcttgtagaactcagtatagtggcatttgtgaggcagatggccattttaatacttgtaggaattggacaacttttcccagtaggttgtaagacaactgtggaggatacctatgctgtctaaattgatgcagcctttttttttttttcaaccaatacctccacatttgaagaacccctgtgtccgtccctctcaacagctgcacaaccttatacgacacggtctcattttctgacggtcttgttctctgcacaatggaagtatacacaaaagtttttatgctgccaaaataaattttgttaagagcaagggtttatttgctaaaatgccattgatgccattttggggacttgctttcctttcctttcttctaaggtgggtcaggttttataatggactgaggttgctccacagtctttactgaataaatattttaagaaaacatgcacatctctcatggggcaagccagagtcaatcatgcacatatttcaaaccacattatatgttactcttaaaagattgctaacttctgtatctagagtagcaactttgcataagatatacataattcttaaccaaatttacaatttaaggttaaatatcatctttgaatgattttcattgaaccagatatcaatggttttctttttcacatatatataaaatataattttcagtgattattttaaattagaagagcctaataaaaactactaaaagaggatactattaatacctaactgtagggcatttgtggaatccaattaaataatgcatggaaactacttagaaagatgcctagcacagcaaccactccaaagtgatttgacatagttttaagtattattattactacccacatgggagaggtactttatcaactttatctctagggcaccttgacttttaactcactcctatattggtacttgttgtgtcccttttcactgatatataaccacatcaaagaacacataagggtctgagacacaggctagtttataggcaaatttgagtcttgaagctcacttggattgtttattcttctttctgagagtctccaggcttggtttgcctcttctgaattcctttcagtaaacatttaggtgtgtcaaaactcagaaggggaggaattccaaaatttctatgtttatttcacaatacttcatattgataattatcaggttggtgcaaaggtaattgcagtttttgccactacttttaataactgcggcttaaagcagacctccatccccagactaggcttccagaatgacttgtgaagaactttaagtgtagtgcagcttagtaaaggttgctgggcactggccagaagtgaaggtggaaaggctatcaccactaattaacacttgaaaggcttcgaataggctggagaaagtagaaacaccctgccaagtattcggcttttataacttaaaggaaaattacagggcatttagtgccgaagagcccatagctaatatttttttaaattgttatttaatgtggacatttccaggcgaatgagtagtcaaatcttccaatttatagtattcttgacttcaaggtctgagaagctctcagtgagtgaaagcagctggagggtattctgtggtggaagaatgatgcaagatgtaacaccatagatggataattgtctgtaatagtaagcctcaatatttataagaatcttggcctgtaaggaaggcattctgataatgttttaaaacttttccccttttcaaagtaccctcagaattcattcacatcaggtaattgttctttctttttcataaaccaagtgcttttgtattacgttctaggacgcagtatcaacgtaaaatctgctggtcttgtgggaagacagggacctcagtcaaaacaaccattcatggtggccttcttcaaggcgagtgaggtacttcttcgatccgtgagagcagccaacaaacgaaaaaatcaaaaccgcaataaatccagctctcatcaggactcctccagaatgtccagtgttggaggtaagaataaacccgagcagcagttatgcacagagagttatggggtcgtatgctgcaaatcaagtagccacaataaatttaccctctatgtataccttcggatggtacattaaatcttccagtgatgtttctagcatcccagaatgtttcatcagtgaatcactcagtaattcattttaaaatacatatgagttgccttcatatgttgaaagattcagttcaaattaaagtcaagatgacagtaataaaattatgaaatggctaatcaacacaatctagccagaactgagctacatgacttgctgagctaacttcctcagggcctttcaaaaatggatggtcaaccaggtaaattaaatgtaaaatcctttctttcgtacttaagtcaatacatgtgaattatgctactcagttttatttttctgagattagcaggagaaagacataagaagacaatgattaaaatatttaccttttcattatttggaggactattatctagataattttcttcaggtgtgtctacacacacacacacacacacacacacacacacagtctttcaacaaaatattacgaatgcacaattcatgtcagtctttgcaaattaatctgttaattatagagggatcaaatttcaattgatcagaaagcatctaactgccaaaatttgtagtggcttaatcgtattatttataccaagaagtaccttgtttagtccaggatgcaaacagtaagctgttagatgaaaatggtggctattttagttcaaaaattgatttcatgtataaaaataaatttgaagggggaactcatcctggaacatctcaatgtagtatcacatacttatctatttgtcaaatatgcattcttctgtgataatggccaatttatgcatagcactctgccaggcatgatggatgaactaataagcaaaagatacatgattcctatatatattattttaccaaattgaaattctaacttcaaacagtctttgtcattattcctaaaatcttcatttttctcaggttacttgaaaatgacaggtcatacagcagctatttattactcaaacatgcatgagtgtttagataagaaatagatgacgacctttatttgtttgtttttatttgctcagagacgctccataaaactactaggtggaattcattggacttttcctaaagggtaggcaccaggagaatcacgttagaagtcctatttgtgtggcaagcaacagaagcaggagggaagatttctgtatggaattgcattatactgaattaaatgctgcttataaggtgatgttttaaaataattttccaacaaagaaatttaaccacttttagtaaagcatgacactagtgccttattacaacgctattttttaaagatattcacaagatatttagtttggcaaaaagctgtaattacttaatatgaaagatggagaaaaataactttctaagaccttttcttcctggtaaatactaggctgtcaaacttgtatatttttcttttcatgtagaatggttctaagtttggttgaaatgtttttaatttaatgtagcagactgtattaagaaaaagttttgctaaaccttgaatagaatagtaaataattttggaggaaattacaaagggaaaagtataagtcacatacttattatttgagctcataatgactctggcagaggtgttccggtgactgaaatcatcaaagtccttttccctattggttaactctatttatcttctcttcctaaccacaagaaacaaatgtacgtctataagcagagatgaataaaacacatggagcagaaatcacgtaacttttcaccagtttcctaacaccatttagagtacaaaattattctaatatagaccaatattttctttttgaaattttgtcattggcaaccatttctgtgaaatatgtggtagatggttttggagtgtgttcatattttgataagaagaagaaagaaagtagctggtttgtgtctataagacttaacctttcaataggtagtaatcaagcagtctgggaaaatcctcataggatttggtctaaaagacaaggctttaaggaaagggaatgctaatataaacagaaaatttgatacttcagagacttgaaatgccagtgaaatttaaaaattatccaaatataaataacaaagttgtaatagtaactagattttacaataagatattgtgcaaaggctctatggataagaaggggtgggatggggatggagttagggaggaaagttgtattgcctgtttgcctgattgctgggttttttgcaaagcatattatcaaatgttgaaaatctccattagtacagaagaattaaaacccaagtcatttctgctatctttatcacatttcttttctacttcaacgattcttccttctgacttcctgatgttctttttttcttccatattcctgtgggagagcttagaacagaaaccagcacagaataggagtccccaaaatacttgttgagtaaattaacgtgctgacagcataggaaaaactaacttcgtttttcaagtaaaggtatatagaaccattacttccaggtttcctgcagaaactgcccggcactgcttgttcctcttcaggtttttggcaagatggttgaacagacacattgtggaagatatttcctgtttcatgttgaggcagtgcaaagggtatttctttgaatttgtgtatgagaggaaagaaaatggagccaatagctaaattctaagctagctatccttgaagatataaaggcactaggtggataagatttttttaaaaacctccagaacatgatgctgcttgaaggagtatattcagtgttgaaaagaatagagtacaggcataccatgttttattgcattttgctttattgtgtttcaaagataatgtgttttttacaaactgaagttttgtggcagtcctgcattaagcaagtctattggtgacattttttccaacagcatttgtttacttggtttctctgtgtcacattttggtaatttttgcaatatttcaaaattttactgttattattatatttgttatggtttatgttatcagtgatctttgatatttattggtaattgttttgtgacaccacaaattttacccatataagatgggaagtaaatgttgtgtgtgttctgattgctccaacgatcggtcattaccccatctctttcccttctcttgggttccctattccctgagacacaatattgaaataagttcagttagtacccgacaatggcctaaaagtgttcaaatgaaaggaagatttaaacatctctcactttaaatcaaaagctagtaatgattacgcttattgaggaaggtatgttgaaagtccagatagattgaaagctaggcctcttgtgccaaacaaacagttgtcaagttgtgactgcaaaggaaaagtacttgaagaaaattataagtatgacttcatcaacacaataatgataagaaagcgaaatcgttttcttgctgatgtggagaacgtttgagtggtctggatggaagatcaaaccagccacaacattcctttataccaaagccttattcagagcaaagccctgattctcctcaattctatgaaggctgagagagctgaggaagctgcagaagaaaagtctgaaagtagcagatattggttcatgacgtttaaggaaagaagctgtctccatagcaaaaaagtgcaaggtgaaacagcaagtattgatgaagaagctatagcaagttatccaggagatctatctaagatcactgatgaaggtagctacactgaaccacagatttttaatggagattaagaagccttattggaagatgttatgtaggactttcatagctagagaagagtcaatggctggcttcaaatcttctgacaatctgactctcttgttatgggctaatatacctggtgagattaaattgaagacaatgctcatttaccattctgaaaatccttggacccctaagtatcatgattaatctactcttcctgggctctgcaaatggaagaacaaaacctggatgaacagtgcatctgttgatagcatggtttattaactattttaggcaaactgttgagacctattgtccagaaaaaagattcctttcaaaatattagtgcccattgacaatgtacttgatcacccaagagctctgatggagatatacgagtagactaattgtttttatcatgcttgctagcacaacatccattctgctgcccatgcatgaaagagtagttttgacttccaagttttattattttaaagatttattttgtaattctacagcttccataaatagtgattcccctgaaggatctaggcaaccttctggaaaggattcaccattctagattccatttaagaacactcatgatttatgaggggttgaaatatcaacattaacaagggtttggaagaagttgattcctacctcctggatgactttgatgggttcaagacttcagtggaggaaatcattgcagttgtggtagaaatagcaagagaacttgaattacaagcggaacctgaatatatgactggattgctgcaatctcataataaaacttgaatgaatgaggagttgcttcttatggttgagcaaaaaaagtggtttctggatataaaatcttcctggtgaagatactgtgaatgcaattgtaatgacaacaaaggatttagcattttaaataagtttatttactagagtagaggcaggatttgagaagatggactccaattttaaaagaagaccttcacaaagtaaagtgctatcaaacagccttgcacactacacaaagaatcttttgtgaaaggaagagtcaatcaatgtgacaaattttatcgttgtcttttaagaaattgccacagccacatcaaccttcagcaatcaccaacctgatcagtcagcaggtatcaacattgaggcaagaccctttactagcaaaaggattacaacttgctgaagactcagatgatcactagcattttttaatcaatagattatttttaactaaggtatgtacatttttaaagatataatccaattacacacttaattgactgtagtataatgtaaccataacttttacatgcactgggaaaccaaaaaatattgtgacactcactttattgtgacgttcacttcattgcagtggtctggaactaaattcacaatatctccccagtaaatgtctctgacatatgcctgtatgaagaatccaaaagaattaacagggcaaatggcaagtcctggatcattacagaactgctaagaaagattgctattgtatgctggatactgagaatcttcgaaaaataatccaatcatgtagtggccctgcctacatccatggtgatttcgtagggcaagtctttggtatacaggtgctcttcaacttaaaatggggttatatcccaataaacccaaataaagtttgcagtaccataagctcaaatatcatagcttagcctagcctcccttacacatgcccataacatttacattagcctacagctgggcaaactcatctaaaacaaggcctatttcataattaagttttgaatatcttatgtaatttattggacactctactgaaagtgaaaaacagaatgcttgtgtgggtactcatagtatgatttctactgaatgtgtattgctttcaaaccatcatcaatttaaaaaatcttaagtcaaagcattgtaaatcagataaaatgcatagttactaaaattgaaacattctattcttgttctcaaatttgataggcgctatctcttgcctaataaatacaatgtaaatttatgcctcttggaaaaacagatattagtcaaaacaagaaaataattaattgaagttatttccatcgaatgttttatattatataattaatacactgttttagtgtttagaaataataaaatcataaataaagctaaagttctcccttgtttacctaatccatacataatagattaccttaatatgctgatatcaacatggtacaaacctctctctcatctcttttgagagaatgtatttttgttatatgcttttaattacatgaattatatattttacaggttttataaacaatgtttagccatatgtcaaataacgtgagctaattcttttcaactgttgcagcttagtattggcatcagtttatttaatcatgtcactccaaaaagacattttgctttttttccaagttggcactctcaaaataaatgctgtactgaaaatcctgcaatgctgcacaagtgagaatatttctaatccacgtaattatgacagtaactaatattaaaagttgctatctgtgccctgaatcatgaaaaattctggaaacccctcctgaaacaagtatgttgatgcatatagtatgtcgttagctagctctatctatatatttatctatcatctatccatcacttaatatctaatactgacttcactacttactagttgtataatcttgcacaagatatattacctctctctgactgtttcctcatgtataaagtgggaatgttaattatacctgccttgcagagcaggattacaagagttctgaggattaaatgagttattatatataactaatttaaaatagtggtacacggcaaatgctcattaagtgttgaacattataattggttttatagaactggtacaaaaggagttcaaactcttacatcagagaaaactagaagttcacactctctcttataagtactcatacctgtggtcacaggatttcttatcttttgagactttagaagcaagagaaattttagtctttaacctaatttggctaatctatattagcaattaactacacactttaaaaaagacttgccaatagacattaaggcattgtgtctgttgttaaatttctctctaggaaaaatccacaggaagaatatatctgggtataatttcttataaataatatttattcaatatcaaataaactcccattatatgccaggcacagcattatatgctatataactatatgctatgcactatattaactatatggcccaaaatactacatgagggacttatctgagaataaatagacattttctagaattaacagacatggatgaaaccatttcaggttgtagaaatgaaatggctctacagttgtagagccatggaccattgtcaaatggctggggtatgcatgtatttttatgtgagaggaatgtggtatcagctaggaaattattaaggggccaaatcataaagagtagggtatgtgatgataaggagcagtgatgtcttcccataggcaattggaaaaagaagaatcataaccagatatgcattttaaaaagttaattttggccatggagtgcagaatggaatgccaagggtggagacagaaaactcaaataatgattagggtctagtataatactccaagcaatgaagatcatagattggagagagagatgtaagaaccaaaacacactggataaggccagcaggggtttgaagagggtggataacccaggactctggagaggggagtgttgagagtaagtggaatgtgtagggaaaagatatagctataagccaaattgttagatgtaggatgaggctgaccaaatgccacaggaaacaaagaaagaaaaaatataagatggagcctccttggggaacatcaacactgtaagtacaggcagaggagaaaaagaaattccataaaataagccaaaaaaaatcagagatgtcaaagaggagcagggataaagtgttattttagaaaaggttagcagaagaggacattgaggaagtatgaggcaactaagagtgcaaagggcttccaacaggatacctagattaaatagtgaaattgatcaactaatgaggctttgtggatccatttaatataggatcagaggggaaaaatgaaaatcaagaagcttattaaattttctggcctggacgactgatggtcctattaacaaaaatagtgaacattgagtgtgaggtcagaagtagaaatagtgagcaggaggcgtcagggaactgtcctttagaggtgtctagcaaattcaggtttgtggatagatttttatatcaaggagctctaaagtgacgatgttaattacatgatccacatggatactttgctgagcagagttatgcaaacacattacagagttattttgtggtgtcttgcgtcacacattggtacctacacaaacacaaaattgtgttaatatatctacaaaataaacaacagtacgtattactggcttgtgtgtaaatgcaagtgaataattcactgggtatagaaaataatgattaagctagaacaacaatagcattttaaagccccttatctttgggtaggattgttatttatttttgggcttatcctgaatttttctacccccaaggtcatatcaaaatccacattatggtagcaccattcctgctttttcaactcttgtaccttcattcatttatcattttaaatttttataaataaattaaggtcttctgatgctttaggtatcaacttcctttttccctctttctctttgggaaataagagtgaaaacactaacatctcctcttttgctttgaaacagcagcatatcatcatatttagctcattgaagctgttgtcatggttaaatgttaagttttatttctgatttttctttgcttttatagctatatctgtgtttcatccctttaataaactaatactatgttctgaagaaaaaaaatggtatatgaaggtttttggcctggattgtctttgtccagttcacagcaagtctatcccatgtttatttatttgtttttttcaggagctagtatgcagaactttgacagtccatgcagatttctggaatttgtttttattgatacataataattatacatattcatggggtacatgtgatattttgatagatgtatacaatgtgtaatgatcaaatcagggtaattaagatatccatcacatcaaatatttatcatttctttacattgggaacattcctaatcttgtcttctagttattttgaaatgtagaattaattatcgctaaccattgtaaccatactgtgctattatcgaacactacaactgatttcttctgtaagttttttaaaaagctgtagttttgtgttcattaaccaattgttcttcatcccctctttctgctaccattcccagcttttggtaaccaccattctactctctacctatcttcaggagatctttttttttttttttagcttacacatatgactaagaacaggggttatttgtctctctgtgcctggcttatctcacttgacatcttccagttgtttcatccatcttgctctaattgacttttttttcttttctttctttctttttttcttttttttttttttttgagacagagtcttgctctgtcgcccaggctgaagtgaagtggcaccatctcgctcactgcaagctccgcctcccgggttcacgccgttctcctgcctcagcctcctgagtagctgggactacaggcgtccgccactacgcctggctaatttttcgtatttttagtagagacggggtttcaccgtgttagccagaatggtgtcgatcttctgacctcgtgatccgccctccttggcctcccaaagtgctgggattacaggtgtgagacaccacgccaggccaatttcattctttttatggctgaataataagctgttgtgtatatgtaccacattttctttatccattcatacactgatggacacttatgttgcttctgtatcttgtgaatagtgctgcaatcaatatgggagtgcagatgtatcttcaacttattgatttcctttgttttggatatatacccagtggtgagattgcttgatgatatggtagctctacttttacttttgggaggaacctcaaaaaagaggttgtattaatttacatttccaccaacagtgtactagtgttcttcttatcatattcaggaatttttgtgttttaccaacttttacctccacgtatttattttgtttttcatgattttattctaagacaaaaagaatcaaactaaagaaaatcgaactaaagattaaatttatacaatatctagaaattgaccataaagaaatttgcataaagtatttagcaatatgtttactattttggcatgggcttcctaatattattactattaagagacaaaacagagaaatattattgataacacttgcactatggataagacatgttggtttactttttctagtgttgattgtagaacattttaataatttttgccatgactcttcatttgtaggcaggctcattaacagtagaattatatccatttcatactaatctcctaaaggctgcccatcagtattttaaaagacataaatctaacttccttgcccttcctcctacagcttattctgccaagcatttagagtaaacctaactgcaggcttttctagtttgggtacaacatttacttcactcactatccattaatttttatttctgacagaataagcatatggtcctaatgctctatgaaatcagactcttggaaccagattctgttatacatttcattgcttgttacatttatgtgatgttacattatatacatcacttagcctgcataaaaagacatatatatggaacagatatattttgactttaaagttttattttctttattttttatatacatagaattcaaataatcatatttgtagtttatggcttttcatataaacatgtatgtgctattggctacaatgttgttattcatatttaatatttttaattaagacaaagatgaatagataaatattcccattattacctaatgcagagtttgaaaaagtaaggcctaataaccaaattaagcctatcatttgtttttgtatgacctactaagagtggtctttacatttgaaaatgtttgcgtggaaaagaaggacaatattttgcagcatgtgggaatcatatgaaattcaaattttagtatccataggtagttttactggaatatagccacacccattcatttacatattgtctacggttgcttttatactacagcagcaaaatcgagtagttgcaaggagaccacttagcccaacatatttactatcagtttctttaaaaaaaagtttaaagaagtttaaaaaacttttaaaaagtttgctgacccctggtccaatgcatagctaacatttgtttttccccgttttgtatatcaaggagtttatgaaatcaaaccaatagtagaatcaattatttctttttctaaacacgatcgaggaaatttaaccatttcatgtttagtgttaaagtgttatttatccattgcctgaacaaagttagctgcaagggagatatttccctgaagaagaaccagaatgtagagtctgaaataaatcctctctcccccatttcccattatctacttatttaatctgttttaatgaagttaattgcatagtaggaataaataacctagaagaaaaataccttgatttcaaaatttaatcattagcttgttttttagattaacattaaacaaataattacttgaagtaaccatgagaagcaaggccctctatgatgggctcctttgatctctaacttgcctacactttcattagaggttgagagtaattaaacaggaaggtgacactttaacaaaaactgtaaaacaaattattttttaattttatttctttaatattttattttagaaataatcaaagtggactagtttttcgaatgttatttgtacaaaatgtgagcaaacccaacacaagacaagaatgaaaaatgttccataaatctctgtgtttcttcagtattttactttattccagatgcaagattgaaattctacatttatatttaataatttaaaacaattataaaaagttatgggtatttcagattacattccaaaatatgtaatgatagtatttcacttgcctcaaatcacttatggaacactatgagaaatttgtccattaactcctcagatacttttttgaatgtttattttatgccaggcactgttcctggcactagggatacatcagtgagcaaaacagagccaaacgagattcttgcccctatgacgcttatattttagtgggaggaaacagacaagaagccacacataaataaatgaggaaatgacatagcatttctaaaagtgataattgagatggaaaaaaatcagaacaaagtgacagaaatcaggtgtatcagggtgagagttgcaatattaaaagggtagtgaaggtcttgttgagatgttgcttaagcaaggacatgaagatgcgggaattagccatgtagctatccagggagagggactagtgagagaaaaggctctaaagtgggagcaaggttgactgtgagtgaaacagcaaggaggtatggtggctggagcaaggtgaaggagaagaagtgagagtcagaggggtaataggatcaaatgagtcagaggggtaataagaccaaaatgtaaagagccttgtaaccactctgagaatatttcactcttaatgatatgaagaccatagagggactggcagggaagtgatgtaattaagtttacttgttaaaaggtccacttgactagtttgctatagaggagcaagggcagaagcagggagactagcaatgaggatattgcagtaattcatgccagagatgatggtgtcttggaccaagaccaattatgaagggcgtgagagcaggtgcattttggacttattgaagatagtgtgtgagatttcctgacagattggatgtgtaaatgaaagaaaaaaaaagaactattttgattcttgttgttttgttttggtttttattttttaacccaggcaactaccattagtcaagaatgaagtctacaggtggacaggattttgggggatgattagaagctcaacttgtggtatcctgaggttaagatatttattaaaataaaatcagctaagtaagatcccagtatctgcctcatggaagatgttacaagttattgcacaaatattatatatatataatctctctcaatatattaagtacccctagagtatgaatgaattaatgaataagtattcattgagcagatggtactcaatgaacgacagacaccatgctgtgccctgtcaagtagatggcttaacagaatccatgttagagcttcatcaggtaaatggtattgtctacatctcacagaagaagaaactcaggacaagtaacttgactgaagttcacatggttagtaagtagttctaactttaagattgaaactcatttttccacaacttcaaataaaacccctttaaaaaatcttaccagtgatctcacaaaagaagtattagtatatctgtaagcaaccatttattcaaaatgtggtttttatcttcagattataacacaagtgagcaaaaacaagcctgtaagaagcacgaactctatgtgagcttccgggatctgggatggcaggtaggaattttcagtcaactttggtgcttcttttctgaattatcataaatccttaataagtcatagtctttggcagtaattttccaatataatacccaatgatttttgacatgaccatttagaatatggcttattcactttattttcatttctcaattaaccttttaccattgaaacatgattagtaggtatcacagtcaaacaaaaaaactacgctgaatgagacatagaacactaagatatttaggaagaaaaaaaagagtgccgttgtttaagtattccaaacttttaattttattgtaaatagaagatttgttcatattagtataagtaactccactaagcctctgagggtctccaactattggaatgtccctgtcatggggaagatgacagacatttttttttcttgcacttaaaaatgtattgctatcttttgggtagcctttagaaacaggatgaggaggaaaatttcaccaaagtaattttttaatggctctatgtggtgacagtttaaaatgaaattttaagacttctcctaatattctattagaatggattctcatatatgagttcctgtattgagaaatactattaaaatgtaaatatattcaaaattcatgataaactttccacatgaataactcaataattcctacatttgtgccaagttttatttctctgtgggaaaaatatcaaggcaaccattcatgtaccaattctttagcttcccgaaatttatcatgttcagtttttaggaatttgctccaatttattttttctaaagagaccataaagttaatgcatgaatggaaagaaaaacagcatgcagaaaaaatattaaggctttaggatgttgtcagacttataaaactaagaatgagttcttaagaagtaatgagaatgatctcaattaacttgattctcctttttctttcgggttcacttgaactttccagagttcatcatttcctgtttaaacaatatttagaatgctattttcttataatagttttattcgtgaatacatgtttaatacatactatgaatatcttacataactaccccttgggagtaattagagaggacaatttcttgtgaaaatatttatacttttgtcctaaacttcagcttaaaattaaagggtgtggggaagataattccattagaataattgttggaccaagaatagaaacctattcagatacaatatatttcaataacttttaagattttttaaaaatttttactttggtgatattttttcttgtttttttttttttttttttttttttttttgtgtgtgtgtgtgtgtgtgtgtgtatgtgtcaggactggattatagcaccagaaggatacgctgcattttattgtgatggagaatgttcttttccacttaacgcccatatgaatgccaccaaccacgctatagttcagactctggtaagctttgtttttgaaggattaagaaaagcttagaatgcaagcatattataaagttgttttagaggaaagcatctatttacaattttaatgcattattttatcttctcaaactcatttgtttctttttagagctgaagtaacaactgtgggtatagtcaggaaactcgggctggtttagagtaatcccagttacacaatggagaaggattcagctaggaaaactggagtaataacatgaaatggtcatcttgaactgtttgttcattacacagtatgactaagcacacaggttccctggggctgtttctaacctagcaattcattagtaatcattgcaaaaacattgagtaatagctgtactaaatttcatctgagggtttttaattatttaagaatgttctataacatactttggtattataaaagttcttcaatgtagtatacaaataggaagctaatttctatttcttattgttctcctcctcctcctgtaatctttaaagtagaaattatacttccttttctttattcctcaatctcagaaacttagcagtgattaaatctctaataatctaggcttatttttatgaacaatgtactgaagggttgacgtgattaactgattgccttgtacctaatgagctcatgaaacctattgagagtctgatgtacctcatagcatctggcctatcgatttggcagaggaacaatctccctaagactaaatgagaggctcctagaaaacataccagactatgtgacataattttaaatcaatgtttgggctaatataaaaattttaacttttgtatttaagaagaatgggagagaacacattattttagaatcaaggcttgatgggagtggaattatttggtggacgccagtaagagaaaagtagatagtagacaatcttgtctttgtgggtgaggtttatttatggaaaaagaaagaattactcttagaatttgtgaagattcgactctccataagtttgctattttcccccacaattaatttaaaacttaaagctgaattaaggaataaacaatgatatctgtgaactggcaaaagcaaatacttgaatgacttgatatttactggcatctttattgacttaataaaatacgacagaatatctagacaccaaaaagtgcaatctataacaactagagcatgaacgttatcaaagactggaaataaccttgggctagagagcaacagaaagataaagcaaatatacattttgataataaattatttataagtattcttctttttattgattcatgaccagtgagaatgcctactttagtgccatatacaaggtaaagagtaaatttctggggggatttaaagtctgatatgacttcacctttgctatctgtaagtataagctcttctttatatggaatagtgtttccaggagtatggagtgtaggtaggctttgcaaggatggatgttttgcattcaaacttctaccactaaaagaatttttaagaagctaacttttctctttgtatatgagaattcatgttgacatgaaagcatatcagataaagaagaatgctgttgtttcatcctatgaagagaacttcatgatcactgtctttctgtaaggtcatagaataactcctatcagttgaagtaatgctatttaatttctcagaaaattctttgcctctttttatcatcattttgatgactatgaaagcagacttttgcttccttagatatggatctaatgtatcaaaaattccctcaggctaagcaatgcctacttattgaaaaataccctttgtcaaatactcccccttctctcattttttcttttttaaaataaataaatacatattttcagctcttatggctgtagtaaagtatcaaaaaacaaatataaaaaaaatctgacacaaactttgaacaagagtctgctctgtatctctaccctgggatgtaggacataagtcattgcaaaactggagcatacacgtgaagtttgattttttttccctggtgttgtgcacgctttatgtttgttctgtgaaggacatgaaacaaaaagacggaggaaagcatgtttgtgactaatatattgagaaaccattcaagaacaatccattttttttccgttaggctgccaaggccattgaaacagcaggattatcaatcatgtatgtgtgggttatggaagataaagctgatgaaggacataagcagcatcagaaatttgtagaaactatccaacttttagttttgtgaggccttaggaaatttcaagttcatgtcagatcacctcatttttcctgctgtttctgtccacatgcaaggcccctatatcatttcagccaggacgttgtacagccaaaactgtaagaggctgtatttgctttttgtggatcccgtaagactcatcagtggaatttcccataaactcctcagggggaagggccagaataggtgggtgggaaatgggggaactgtgttctggctcttttctcaattatttcaaatcataggcagactgccagtctgatcaaaattattatcaaccctttacttaagcatttcacttttcatgtacagacacctttttaggcttttggggaggtggatgttcatttgtaaagtctctaggccctttgcttctgatttagcttagcctgctttttggcacttgtctagggggcaggcaagggagaaaaaaagtaaatggatattaaactccagccaatgtgataaaaaaattctatgaagagctgaaatcattgctctaaggcaagtattggattatatgtggattttattttattatgatttttatgcttcttttaccatggaaaattaagagttggcttaaaatgtatgatttattgcttaattttccttttaaaagataattcttagatccaaatctttctgcaactatgtgttttcattgatttgctcttgtaacttccatattcctcatgatatatataggaacagtcatttcaactaaaagcaacaacgtgctagttgctgtgttctttccctaggaaaacttccactgaatattctatagaggaagttttctttatttggtgagatatttttcaaggttcaaacacataattgaattggctgggttgattccaggtgttaatgcttaagaatacatccttcagtcccccaccccagtcatggaataaatgggagaagggagatcagcttaatggtgtgcctgattatgagtgataaaataatcataccattttaaaactgcaaaagaatgtatattttatttcttaataaaacaaaaccttttttctttcccaggttcatctgatgtttcctgaccacgtaccaaagccttgttgtgctccaaccaaattaaatgccatctctgttctgtactttgatgacagctccaatgtcattttgaaaaaatatagaaatatggtagtacgctcatgtggctgccactaatattaaataatattgataataacaaaaagatctgtattaaggtttatggctgcaataaaaagcatactttcagacaaacggggaatttcctaaaattagtctggctcattttgactcttttcctatgtacaatatcatgtatatagtcatttttatttatttaaacgtatatattctcttctgtggaggctttatcaataaaatctatttcataggccactacattatacaatagatcatctagtataattttcaatgggttatgctgagtccattcaattccatttcaacatttttttctaatacaattttacataattttctgagattagacagaactcctttgactgtttaatattgtggaaggaaattgaataatttagttatattgtgccaatgaaaaccatgatagaatatttatttagaaataagacttaaaaaaataacaacccaaacaaaaattcttggataaacacaatttctcttttagagttcctgcttcattagataaagtgaaatgttgaactggatttgaataaataaacggtaggcagaacatagaagctgaaagattgcacagaattgttttaactgtttgctttaacagaagtggtgtaactgtaggagcatgttcctttttggcttgtggattgtagattttgcaaagagctcaaagcttcaggagacaggcttgagcctgtgtccatagctttccaagttaacactaattgtagtacaaccttcttacctcaaataaatcatgtctgcctattatctagaacactactgctgcagaatttttttttcagatttaaaaacctagtccaaaataaagaaacatttacatgtgctccactttcctccccacaggcaagagtcactgcatgcgtaaaatgtacaagagcagaagatgccgaaagaaccattttctttagctctcctttataactgagtttgctgattgatgtgatgcaagggattttatttagaagtaaaagcactgaaactaaactggaggaaattaccaaaagtcccagaatggctttgacagaattgccatttctaaagaacagctgaaattcatttttcatatctttgagagtgagctcaatgaaaaccttattttgtaaaggcattttgtaaaccttcttccaagcacaaataattccaaacaggaaggttctgttgtgtgtgtgtgtgtgtgtgtctgtgtgtgcatgtgtgttcttccctctaaaattaatttattttctctatctattagaatgccctctaaggcctttctttaacacacactgactttttgaagaatgatctttagattgataacttgctatttatggtgactctgtggttaggcttatttaccgttaatctaaagtattcataaagcaccatttattaatcatccttttggatctttcaaaccaaacgtataccaaaaatgtcttcaaaaatgttatggctttgtttgtaattcgggtatattaaaatgttgttttgaaatacagtttatcttaaagaaaatttgacagtaactatattaaggggtacattaagtaatatatttttaattaatggtgtaccattgagagaataagaaatggaagtctattgttttattctttaaatgtgctgtttaaatatatttccatattttaaaatatattaaacagatgctaatttctgctgttcttgatttggttctttatttaaaaggaatacaaaatgtaagtatatcataaattgagacaataagaatatttatcaaatgtaaactgtggatcacatgattctttatgttgttcttaattgccaaaattgttttttgtgttgttaataattatctcactattaaatgtgcaaagcaacaatccatgaattaaagattttcttaatctgttcaaacaacaaattttaaaaatagcaaaaaataattagaatggagaaatacctcatttgttctttttcatatgagaagggaggtaattggcatcagtgcttttgcattttctaaaattacatatgtgtagcataatacgcacatatactcggtcacattagtttctaataactattacagtaa

SEQ ID NO: 13354 - DNA, 5231 bp, Human
aaaattcctttatgaccttgggatagtcaggatttcttaaataagatatagaaattcaatatgtgaactaaaaacaatcaattcgactacatggaatttttttttaacttctgtttaccaaaagacacaatcaagagagtaaaattagactctagaagctggcaaaaaaaaaacaaacttgctacatatatataaaacaataaatttagtatcccaaatgaacagtagaaaaatatgttggtaattatggatacaatgagaactcttataaacactttgttgggttataaattggtacagcctctttggaaaactggcattacatagtgaatttgaacattcccattatttattacccagtatttcctctcctcctagatatagccaaaggaaatttgtacctgtgtatgaggaggcatatacaagaatatttatagtaacaaaacctagaaataatccactctgcatttacagtagaaaggataaattgtgatgtattcaaaatatggaataatacacagctgtaaaaatgaatgaacaacagaaatatacattaacaggaatggttttcaaagaataattttgaatttaaaaagaaagtcattgaggtagtatataattacatatataaaaatgcaaataaatagcaaaataagacatatattttcagggatgtatacacatatagtaaaattataaagtaagcaaacgaaatgaatattataaaattcaaaatggaggctacctcaggaaggtgagaagagtaggtagcacgatggatagggcaacacagctgggcttctgttatacaagtcatgttctatttctaaagctgagtgaaaggtacatttttaaactgtagatatatatttggatttgcttcatgtgtttcatcataaaagaaaaaatgtacatgaatgtcttagaaaatcttgatcaagatgtcattttatatctgcactgtcatattcattgcaacattatccacactagccaagaagtggaatcagagtgtccactggcagataaatgcataaagaaaatgtgtgtgtgtgtgtgtgtgtgtgtgtgtgtgtgtgtgtgcgcgtgtatcaatgtaatactacttacccttaaaaaagaagaaaatcctgtcttttgtaacaacatggctgaacctagaggacattatgttaactgaaataagccaggcacagaaagacgaaaactgcatgagctcacttatactgtatataggatctaacaaagttgaactcagaggccgggcgcggtggctcacgcctgtaatcccagcactttgggaggccgaggcgggtggatcatgaggtcaggagatcgagaccttcctggctaacaaggtgaaaccccgtctctactaaaaatacaaaaaattagccgggcgcggtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaagttgaactcagaaacggagaggagaatggtagttaccaagggctgagaggaggtggaaggttggggagatattggctaaaaaatacaaaatttctggctggtatggtggctcacacctgtaatcccagcagtttgggaggccgaggcgggggaatcacctgaggtcaggagttcaagaccagtctgaccaacatggagaaaccctgtctctactaaaaatacaaaaattagccgggcgtggtggcccatgcctataatcccagctacttgggacgctgaggcaggagaatcgcttgaacccgggaggcagaggttgcggtgagccgagatcacaccattgcactccagcctgggcaacaagagagaaattccgtctcaaaaaaaagaaaagaatacaaaatttctttagctagggagaataagtttaagagagctattgtagagacactgaccttcagcgcctcggctccagcgccatggcgccctccaggaagttcttcgttggggggaactggaagatgaacgggcgaaagcagagtctgcgggagctcgtccgcactctgaacgcggccaaggtgccggccgacaccgaggtggtttgtactccgcctactgcctatatcgacttcgcccggcagaagctagatcccaagattgctgtggctgcgcagaactgctacaaagtgactaatggggcttttactggggagatcagccctggcatgatcaaagactgcagagccacgtgggtggtcctggggcactcagagagaaggcatgtctttggggagtcagatgagctgattgggcagaaagtggcccatgctctggcagaggcactcggagtaatcgcctgcactggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggaccaggaagtacacgacaagctccgaggatggcttaagtccaacgtctctgatgcggtggctcagagcacccgtatcatttatggaggctctgtgactggggcaacctgcaaggagctggccagccagcctggcgtggatggcttccttgtgggtggtgcttccctcaagcccgaattcgtggacatcatcaatgccaaacaatgagccccatccatcttccctacccttcctgccaagccagggactaagcagcccagaagcccagtaactgcccttcccctgcacatgcttctgatggtgtcatctgctccttcctgtggcctcatccaaactgtaccttcctttactgtttatatcttcaccctgtaatggttgggaccaggccaatcccttctccacttactataatggttggaactaaatgtcaccaaggtggcttctccttggctgagagatggaaggggtgggatttgctcctgggttccctaggccctagtgagggcagaagagaaaccatcctctcccttcttacactgtgaggccaagatcccctcagaaggcaggagtgctgccctctcccatggtgcccgtgcctctgtgctgtgtatgtgaaccacccacgtgagggaataaacctggcactaggtcttgtgaaaaaaaaaaaaaaaaagagagagctattgtacaacttggtgaaaataataactttaaaaacaatatattatattcttgaaagtcacaaagaaaatagattttaactgttcttatgaaaaaaatgataaaatgtaaggtaatgtgtatgtgaattagctggatttaaccatttcacgatgtatacatatttcaaaacatcatgttttatatgataactgtatatatatgtttttgtcaatgaagaaaataaatttaaaagaggaaaataacaaaacaagaaaaaaaggatataatcagacaaaatgttaaaagtttatgtgttagaggtttactagggccttgcagataattgtaaaaaattgtagaaacaacataaacattcatcattagagatttgattaaaagataagcaaatccatagaaacagaaagcagagcatagatgagtaggagctgggggaagggagaaatgggaaatgactgctaatcagtgcagcatttcttttgggaatgatgaaaatattttaaaattagattgttgtgatagttgcacaatatattaaaaccattgagttgtacaaaatgacaatcaaattgggtgtggaagagacaactttaaaagatagagggagttggaaatttgcttctttaagaaaagtaaaacgtaaaattgtaaaaagcacatacatgtagtttatgcaggaatgaaaggttgtaatttaacccagcagtccccaacctttttgtcattaggagctggtttcatggaagacaatttttccatggatgggggcaggggatggggagtttcaggatgaaactcttccacctcacatcatcaggcattagattctcataaaagacatgaaacctagatccctcacatgcatagtttacaatagtgttctctcttttatgagaatctaatgcccaggctgatctgaccacagtttctcaggcactctcacccagcgctcccttactgctctgctaccaggttcctaacaggccacagactgtatagtcggcggcccagcggaggggggggtgggggggtgggggctgctttaatcagtacatccatatacaaatgaaagtcttgaatttatattaaaaatctaggcaaaacattgtgcatgtatatgttttaagttaaaatccctaatatacttaaaagtctgtttctatgatttcctgcctcaccaaactttttcaagtaaccaaccaaatattaataatgagcacattagatagaaggcttctatggtatttcttcactcagttaaactaaaatttagtttcttttctttttccgttacccagtgaatggcagcttgtgaaaaaacaaacatgaatagcttatagagataatgcctgtgtatagtgagagtaaaaattttaagtctgttaacaaatatgatttttgtgaatgaatacctaacttttgaatatcatgtctatttaatcgatgtttagtattgtgacagagactgttttacttttctcagaatgaaggctagaaaagattttccaattgccctgtaactggatatggccatatgactaaattttggccactgaaatatgagtagaaatggtgctaaacaacgtttaggcttgttaaaaaaaaaaatacaaaaaccaagaaacacaaaaaaaaaactaccctaaaatcctcccaggtaagatcttccatgatacactctccatccagctgactcaaatggaaatgaccgtaagtggaacctgagagccaaggtgaaggcagtggagctctgaaatggaaggagccttagtcactgtaacataagttgcaaaagaacctacctgaccagatcaccagtactggaggatgccatgcgcaataaataaacttcactggcataagatatttcagagatgttggggtttacctgtaacagccactagaatttaccctaatgaatatcagtaaagcaatttaagaaaaggggaaaaggagagagagagggaca

SEQ ID NO: 13355 - DNA, 15331 bp, Human
atttttgacaagagtggcaagaccattcaatatgaaaaagactatactcaacaaacgctattgggcaaactgtatatttatatgctgaagaatgaagttgaacccttacctaacaccatatacgcaaattaactgaaaatggatcgaagacctaaacataaatgtgaaaactataaaaattgtagatgaaaacctaggcaaacatctttataactttggatttggtgatgatttcttggaaatgacaccaaaacataggcaataaaagaaaagaatagtgaacttggacttcatcaaaatttaaaactttcattcatcaaaggaagggaatatatttgcaagtcacatatctgataagggattaatatttagaatatataaagaactcctacagcttaacaacaatagaagaacgccccagcttaaaaatggacaaaggatttgaatagtcatttttgcaaagatatacatgtggccaataagcacctgaaaagatgttcactatcattcacattaggaaaatacaaatgaagaccacaatgagataccaccttataccaattagtatggctattactttaaaaaaaacccaaaactagaaagcagtaagtgttgacaaggttgtggagaaaacagaacccttgtgcattgcgggtgggaatgcaaaatggtacagctgctgtggaaaacagtgtggtggttcctatagaattgctgtttgatccagtaattccacttttgagtgtatacccaaaagagctgaagggacttcaacaaatatttatacaaccatgtgcatggaagaatagccagaagctagaaacaaaccaaatgtctattaacaggtgcataaacaaaatgtagtatatacacacaatggagtattatttagccttaacaaggaagtaaattctgagtgcatgcttctacatggctaaatctcgaagacatgctaagcgaaataagtcagacacaaaaggacatatatgattgcacttattgtagctacatagaataaccacatatataatggagacagaaagcaaaatggtcactaccaggatctagcgggaggaaagaatgggaagttattgtttaatagttacagtgtttcaatgtgggatgaaaaagttctggattctaccagtaggtggcttttattcctcctagggggccctccctgcctacattttggctttgtcttcctttgctcataatgtccttgtccctgctccccacatgcctcatctgtagttcctagcactttcttcttcccttgattccaacccattctccaagaccaagttgccatgccctgtcttagaaacccctttctaatctctattccagtgtgtcctccatttggaagtagtgctaagaaaattaaaagaataaaactgggcaggggcatgagaataggatgcaaagatgaatttttggactgagtggccaagaagctccatggtgagcactcacagtctaaggctggaagtttaatgaactgttttctacatttcacaggtaagaaaactgggatactagttggtggcagaggtgggtctgaaactcaggcaccatgattccagggcttcactactctctgcttgtgaccatcaggcccgagaaagccaagccgtaggattttgaggaattactgagttatagtggactatttgatcttttaaattcttaaaactcggaaaatctgttatcctttattgttgcttacattttatatgttgcttgctcttctgtctgcctagatttaaagttcccaaaatgtagggactccattttgtgcacatataccctgtgtggccccccaggatcttgactgtatgggttcacaaatgccactggctggattgagacagggatttaaaagtcttggaacacatggcaccagggtcactgggatcttgatatctcacctgcctcccccagggcagccttatccctgcccctcaccctgccatgggcaaggctggcttctgagtgagcagggctcagttttgtgttacaggcacacatggcattcagggatgtggctgtggatttcacccaggatgagtggaggctgctgagccctgctcaaaggactctgtacagagaggtgatgctggagaactacagcaacctggtctcactgggtaagcctgatatctgttaggattcccattcttattgctgggaattttaggctatgcttgaagcagccatcttgctttgttacttgacctttgggttggaccaaaaagcaactacattttattcgtgtttccccagggagggtctgattttgcagagtggaaaatgggtagatttgttgtgtgtgtgcatatgtgtattgtgtgtgctactctgcatttctaggccttttttctcaggctggggttctcatcctatgttaacttgttttaaatgagaggggtgttcatctactcggcatggaatagaatcagtgtactctcatctgagttcactgcccactcatcccttccatttctgagagccccactcacctcttccaactcagggctttgtactacctttgaagtttcctaggctgtttagctttgaattcttgaatgggctcttgagcccataacctagttacttattttcttttcctgtgagcaggaatttcattttctaaaccagaactcatcacccagctggagcaagggaaagagacctggagagaggaaaaaaaatgttcaccggcaacctgtccaggtgagtgggaaaacactggacaaatgagacatgagctcagcagctcagaggactgggggagaggaggcgttgctcaggtgctggggagggaagctgttcccctgacctcctgggctgctgtttagattgcctgacacggcctcccttccagatctccatcttcattcgagtatggacggggctttcctggtgtctcgtctccttcctccactaggaagccttttttcctcccagtgggtttctcctctctagctcactcagttctctttcatatatatgggcttctttctcttgttactgttttttaaaaagatcatcaagaatatggaaacaactgtgacctacagaaagaaggcaagcccagtgggaggaagaaatctaaaaagccaatagagaaattgaaatggaattctaaaaaaaactgtgagctattcaagaatggcttttacattttataatgttatataaatatctatataatatccttaattttgcctcttaaccatcaaagcctgaactatttactatctttaagaaaaagtttgctggcccatgctctaagggagtacaatacatagccttaactttttatattctattaatacttaatctgggtaaaatataaaatgtaagagcattgcaattacacagttccaatcaccccccctcccaacatcctttgtactataattgtcatttgtattatacactccttattacaatgttaaaatgtttgttttaaatgttcatctggatttgttttctacaatgtatttttttaattaagagaaaaaatagtctttaactcatccagataatttatcattttctgttctttttgtttgtttgaaaatccgagtttacctttggtattatttttcttgaaccttaaggacttcatttggcatttcttatggtacaggtggcagtgtattctctattgcttctgaaagtgtctttattttaccttcattcttgaagtgtatcttcgctcgatgtagaattctacattggttattttttcagcacgttaaagataacattccattgttctgcctgccattgtttctgatggagaagtcaccatgaacataatttagctttatttcctttggctacttttctccatacttttggtattcagcagtttcactgtgatgtgactgccttaagtacattcttcctttacatgtttttatctgcctgaatctctctgtccccttttgggactataggcacatgtatattagtcctttttatataatcccacaggttatagatcctttccatacttttaaatcttttttttctctctgttctttagactggatgatttctgttggtctgtcttcaagtttactgtctcatttgtcatttccaatgtgctaagctctggccagtgaatccttcatttcacttatttttcagttctgcaatttccattcacttttactacacttttctttgtggtgagatttcctatctgttcactaattataattaaattttactttatcttctttaaatcagacactaagtggataacttattaagtgaaaaagttataggattttgtatactatgcagttgagtttgttgttaaacaaagagaagtgtatgaaagagtatatatccatatgtttatgtgaacatagaagtctgttgttatttaccattactagtggttacctctgtggggatagaattggggagggttggacaaggggctgctgagaatttttcatcctactttgcattatttttaaatgacagacacatagataactttaagaaattatatatgtgctttaatttttaaaattcttttgacagttttataaatgtttgcacagaagtatatattttctttttctgggtaagaaattttctcctcttgtttttattaaattgattaattctgtcttcaaattgagggaccatagcatacataatataaattgtcgctgtttttcaacttgcttgtatccttactgttcatctgttagaaggaatcctaaagctctccacagtcgtaatttatatcaacttctccatttatttctaagtttttgtgttatatttcactttattgttctattaggtatagaaaggttcaggatatttttatcttactcattaatgaagtttttaatgctgaaattctcttagttccatgagctattgtttcctttaacttcctctttatttctttttagtcttagcactgtactttctggtgcatctttttggtattttattgttcatccttttattttaaaataaaaacattgtcatttgggtgttttgcttttaagcagcagcatgtagctggtgttgcatttgctgtcaaaccaagtggtgttaacttttaatagtgactttacttaataacagataaatttcatgagacttgctcaggggttgactgaggcagatgagtaggtgttttactacagcaataggaaagaaggaaggtcagggcaaaggaagtaaagcatctgtattagtcaccttgggccgccatgacaaaatactgtggactagctggcttaaacaacagaaattcatttagttatagttctggaagccagaagttcaagatcaagttgtcagcaggtttggttgctctgagtcctcactcctgaacttacagatggccaccttccccctgtgtcttcacatggccctttctcaatgctcacacatctttgtcgtctcttcctcttcttaaaaggacaccagccccattggattagggcccacccttacgaccttatttaaccttaattacctctttaaaggccctgtctccaaatacagtcacattagggattacagcttcaacataagaatttgggggaaacacaactcagtccataacagcatccttgtgagagcaccatagtgatttcatagactctccgccgaatatatagttccataaaaggtcagttggatatgtaagtccattggatctcagttgtatgaaggagtaaagatgagggactggtgtataagctgaaaggtcatggattggagccccaaataaggtcaggaaccaatgtgcccatggtgcttgagcaaagtgagtcagaaggtagaagaaaaggctgtgtcagagaagggaatgtgcacaggagagaatgtgaagattgtgcagtgtctgtgaacagcattcacagtgcaggtgaggtcagtgttgctgagaagttggagtcttagccagaggctcagccctgtggagcaccctgagagtgctgacaggtattggtgtggagaggatgtgaggctggtaggtgatcaaatattcagggcagtgtgtgaaaccaggagacctgtggatggtcctaaaaaaagtatggtaggtaatggtgtggaagccacattacaaaacaaggacattcatcccactgtgtaatgcttgagatatgaaaggaagaagctgtctatctacttgagggaatcttacaaaaatcttcctctcaaggaacaagagaggtgtctagccaaggacatggaaggaatgttggacagagaaggagaggatgtaggggcattatctgacctgtgtgttcattctagaattggcaggtggaggctgggaaaatgctatacaccctgacctttgtacatttacacaaatatgtgttttctcaacctgaaaagtatagaattatcaaaacatttatattaataacaagcagcttacctatcattgtcttaaagcgaaacctatcttttttgtctcgtttttaatccttgttttaatttaaagaaaaacagcagctcttacaatgatgttgagcacattaaaaagaatgctgtacaatccaaggagcaagtcattgtggttgcccaggaagctgtcttggaaacccaaaatatatgtgtaacgggaggaagactgttctaggtataaaatacatcttaacggtttcattattctatatttgggacttggatttaagacaggcaatatcagaatcctcaaaataggctagttacaagaaaagtatttaattttctcggctgtttcattaatcagaatgctaattcaataaatgtaacagaatcatttgcaacaacatggatgaacctggaggatgttatgttaagtgaaataagccagtcacagaaagacaaataccacacaatcttacttatatgtgcagtctaaaaaggttggactcatagaggcagagaatacaatggtggttactaggggatgggggtggttggggaagatgttggtcaaaggattttcacatagaaagaataagttcaagagatctattgtataacatgatgactacagttaataacaatatattgtattcttgaaaatcactaagagtagattttgggtgttctcatcacaaaaaatgataggtatgtgaggtgatgcaatatgttaattagctcaatttagccatgtcacaatgtatatatatttcaaaatgtacacaatgaatatatacattttttgtcaatttaaaaattaattagttttttaaaagtaacaggagttaccataattatgaagaattatatgccctcctgaagtgactaatccttgttatttatattgactaagaagcctggtaagaggtaacacagaagcctaagaatgagaactaaagccaggtgctgtggcttgcacctgtattcctagctactcaggaggctgagaccaaggcaggaggatcacttgaggccaggagttcaagaccagcctgggcaacatagcgagactctgtctctaaaaaattttttataattagccagggtgaggtgttgtgtgcctgtagtcccagctacttaggaagctgaggagggaggattgctcgagcccaggaatttgggctacgtgatctatgattgtaccactgcacttcagcctgggccacagagtgagatcctatctgtaagaaatttaaaaaataaagaatgagaaattggatatctggtgaggtaaaaatagagcttttatttctaagttgagtatacaaaagacaaaaattagttatttttcatatggaggacagaaatacaccaagttataattcttttttagttaccagtattattgtcaagtttaagcttttttctgtttattggcaagctaaataattgtacatgtttttaagcatatatagtgttgatggacggtatttaaagttttaagtttcagtctcaaataattaacataaggctgatctcattagtttaggcaaaaatacaagtaaaattattgcatgagaacactttgtatagttttgtttttgaattttttaacaaaaatatttattcttataatgatttcctaacagagatcttagaaattgaaaaacaacttaatcagtcttaagttaaaaactgcctgaaaaatatgccatttctggtatttactttgagtaaagtaattgtagattcacgtaatttctggcactgtctgtaaattataagatactagttggacacatatatctacatgtgcctaatcttacatatttatgaaggcaatattagcctatctgatttttaaaatcagtataggttgactctcccttatccaaaatgcttaggaccataagtgtttcagattttgggtttgtttggttggttggttggttggtttgcattttggaatattaccataaacataatgagatatcttgggtataggaccctagtctaaacaggaatttcatttatgttttgtgtacaccttgtacacttggcctgaaggtaattatatttttcctttgaggatgctgaataaactgaattttatgtgcctgtgttttgactatgacctgtcacatgagatcagctgtggaattttctacttgtggctgcatgttggtgcttaaagattttcagattttggaactttgcagattagggatgctgaacctatatattagtcttggaagtttagattagttaaactttctttgagaaagcctacatatcagaaccaagttttatatcactagaatattatgctaatgttatgtttacactgataaaataagggaaaagacattgcatttgtcttatttgcaggctttatcttactttgaaatattgattccaccctttagttacataccagctagtaaggttgtttacatattgtagtaaataagctctgagtgcctcacatttctttcttatcgtgcaacctaataagcaaggtgcctggcttaattcacagctaaacttttttcttcagagccagagcttcagctgcagcaagaaagatttccttcagaaactggcatatttgaatcattaggagttcaattttcaattttatttattttttatttttttgagacagaatcttgctctgttgcccaggcaggaatgcagtggcgcaatctcggctcactgcaacctccgccacgcaggttcaagcacctgcctcagcgtcctgggtagctgaaattataggtgcacaccaccacaaccagctaatttttatatttttagaagagacagggtttcaccatgttggccaggctggtctcaaattcctgacctcaagtgatccactcgactcagcctcccaaagtgctgggattacaggcgtgagccgctacacctggcctgattttttttttaatttagttattctcgagtttttaaattttaaatttgtgtcagtgcccattagtctctataaacctatcagtgcaggagcaccttagatttaaaatattttataaataaattcattaacctggtaatattttgtgttaaaatttcttctaagactaaatattcctagtgtatacacagaatgccaaatttggtgaccaactgaaaaaactgactaatggagaattaaagttttgtttttcttctgtcactccatacaaatgttaaaaccatgttgaattaagatttctctgaaggcgcttctataattctgaaatacatttagtgtaaataaaagcctgccactttacacataggcacagcagctagggctgtaataagcctacatatcagaagccttggttcttataagggtgggtgggaggtattacctgtgtcaaaattatagtcactgtgcttaactcaggacagacacaggagttccttttactgctgaaagacctacttacccatgactatgccctaatatgtatgaaggtaagccaaggagatatgagctgttgcttcccttctcctgtcgtattcaagagaaacaaaatagccaataaatcaaatctgacaactccacccaactcaagtttccataatgtcaaggaagttgctggccagaaatagaacacaaaatcagttatgagttgtggaacctcagacaacctagattaaaccaaataaacttagtgagaactcagtgaaagcagctaggatttactgctgaaaaagggtcttgagggaccacccggcacctgtcctgaatacaagggctggaagagcaggctttctctgcaggagctcctcagcactggcgtggggagaggcaggcatcaggttagattgttggttcctctgtctgtcatcaaagcctgaggtaaaggccaccagagctactgaaaggagaaaagttgagcttatttactggccaggcagtgaaacacagaagggaagacattcacttgggcagtttgctgagtaggaagagtcaggaatttttaagtggtaagaaaaggtggttctgctcattgtaattaggattgaaaagtagcatttcgcgtagcatggaataattctggaatgtggatgtgtgcacttttaataagcttgatttttcattggtcaagaaaagagcattcgggtagatccatcgagatctctacctggttactcatattgcctggtcattgattgccttcagctgactagacccagttgtgataaaacaatatactcaatgttgacatctcctacacaagaggcactataagtagaaatttcttcttttacactgatttttggggaaaattttatttacactaattatggaaataggttgggggtaccaggagggagcatcctttaaagtcattggggacctgggctctgtgttgtccactgctgaaagcctactgcctcctagaaattctggcatagagtaatctaacaaatctttgttgagtggggagacagcagctcgggtgtgtcacatactgtttcactaccctctcatgctcctccctacaccagggcttctctgttcactctaaataactgctttctcaatccatccccttgtcctcatagggaaataaggaaggacatttccacatgagtcctagggttagacatctttccatcaaagaagaaagtacttgtggacatgatttatctcagtgtgcatggttgtgagttagaaggtaattaattgtattgaaggtgagggggaactgttccatactggccctatttacacacccaaaaatgccagggatgcttgtgtagtcttatatgtagagcaggtcttaacaagtgggttttctagattgtaatgctagacgtaataagtagcagtaggctggagagtaggccatgtaaaggaagtcccggttggatggcacttaaggcctaagtgttttgaagcctaggggatctgactaagctgattgctcaggctgcccactgaggactcagttgtgactcacacttttctctctgcagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagtcagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgtaactgtgcctgtgtccctcattcactcatctataacagggataaggaatgatacagacatctgaaacccttaagtccactattccacaggaattcatttcctcggaaaacaagaaccaaatcatttgcagatttattagaaagactggacctttgtatggggagagaatctaggaactacataaagagatttcatgggatgggaggggatcttccagaaagtgtagcttcctctagtccggctccatctgcagctacccccatcccttggctctgacagcccctttcctgcttctctcctcccagctttcaaacatctccgttgttgcctttgcccctgactacctttgttgtgtttctcaggcttttttagtccctggtccttccatcgggggccctctcaccaatacattgtccccagcactccagtcccacggcctggtcttgcagctgtgaccaagcagagccttggatctcagttacacccatatcagaccaccaagaaaatagataatctccaaccacccccagctataccacctcatcagcacctccataactacagtcaggcactgcataatgttcgtctgcgacggactgcatatacagtggtgggctggtaagattatagtggagctgaaaaattcccgttacctagtgactttgtagacctcccagtgggacaagatacagaggtggataagacagtgatatggatcctgaccctgtatagacctaggctaatgtgtgtgcttgtgtcttcgtttttaacaacaacaacaacaaaaatttaaaatttttaaaatagaaaaagcgtataggataaggataaaacaaaaaatattttcgtacagctgtacagtgtgtttttgttttaagctaagttacaagtgagtcaaaaagtaaaaaaatttaaagcgtataaagttaaaagctacagtaagctaaggctaatttattattgaagaaagaaaaatttaaaaataaattgagtgtagcctaagggtacagtatgtatgtctgtagtagtgtatagtaatgtcccaggccttcacactcactcaccactcaccgcctcgcccagagcaacttccagttctgtaacttgccatgtatggtaagtgtcctatacaggtgtaccattttttttttggcttttatgttgtattttaccttattttttctatgtttagatgcatagactcacccagagcagcttccagttctgcaacttaccatttatggtaagtgccctctacaggtgtaccattttttttgtcttttatgctgtattttaccttactttttccatgtttagatgcacaaataacttagcattgtgttacagttgcccacagtactcagtgcctacagtactcggtgtaacctgctacacaggtttgtagcctaggagcaataggctataccatatagcccaggtgtatagtaggctgtgccatctaggtttggtaagtacactctatagtgtttgcaaaatgactaaattacctaatgatttctcagaacatatccttgttaagcaacacttgactgtatatgacaatctttaaccatgtgtcttcctcagccctccaataacagagattaaacccttgaagccacattccccaatcagtcctgtaataccagtgtttaggactttgaatcatgctcctctatcccaggacccagtccccatgtcagtcatcaggtaactgatctaaggtctttaagccacacagtctcaatagttatcctatctcagggcttaaggtatttaaccctacataaatattattaaccatacctccttcagtgtctggttttgctcaaaataagtgtccttcaaggtaaagatcatctcaagggtgcaactgtaagacccctttttaagacttcagaaatatttaagtgtgtggctccttgactatacacaaaatggttctaaattttaagggaatcatcccatagcaccttgacactcaacccaaatg

SEQ ID NO: 13356 - DNA, 31820 bp, Human
caataaagttttctcagtttaagagagtaaaaaaggcctgatttatagcatttgtattgggtgctatctttttttttttttttttttttgagatggagtctcactctgtggcccaggctgtagtgcagtgacatgatctcggctcactgcaacctccgcctcctgggttcaagcgattctcctgtctcaggctcccaaggagctgggattacaggtgtgcaccactacgcccagctaagttttgtgttttttgtagagatggggtttcaccctgctggccaggctggtctcgaactcttgacttcaggtgattcgcccacctcggcctcccaaagtgctgggattaataggcgttagccaatgcacccagcctagtgctgtcttctgaatgattctttattacagtacactaaataaaatgtctgtatttatgcaactcagggtttgtcagcaaatattaggaggtaaaactaattggaactgttttagacccttttggcccctaaatgccatatcatattacacaaaaatacccacctatagttatacataaatattgaggtgagttgcagttgatgttatatttttaaaagaaaaatattaattaaatatgtattaatatacattagtgttttgaagtctatccattttttcccccagccatacaaagtttggtaggattctaaaagcttgtaggccctcaagcaccactcttctagtgcttaatgggttaaatgtccctaaagctaatttgaaaagcaaattgcctcattctttctcttcatatctttctttcaaactgtaaattttaagagctgtttattccttattctccttgttcttaatttgtttaataaagttttagatctttagcgaatattttgcaacaacagaaatatccccaaatttcctggtgctagaaaacagccacaatagtaagtaggtcaagtctgtattgcttagggaacagggagatttttgttttaaagcagtgattcttctgagagtagggctctgggcgcaggtgagtggtaaacaatcctttttcctgcagggatgttgctgttgtgtaaaagcaaaagcattttgtgtaaggatgttaggctccagtaagtatttcaaagccacattatctttctcattagggggagtttctctctgtactttaaaagaagataatgatgcttgaaaaagctcaagattgactaacttttaggaagctgccagagttgtgcatagacgtcctcactacagtagcttcgttatgtcttacgaacaatttaaccttcacttctagtcatcgtttcgtcatcgtaagcactgggtcattacagagttcagtgtacctaaaacgcaagctgtgactgatgagaatccaagctgcaaactgggcggcttgggcaactgttttcttaaccaccctccacgttgtggcttacgtcttttagcaccgccctcagggcaaaggatggtggtcagaggtaactaccacagtaaaagaaggctatttatgtggtctgtttacagttacccggtttcaacactaagccagctttccgccacgtctcgggcgaacctccggcctgaggtcacagagacgcccgggtggctctcaggagccagcatggcagcctcctcaggacgggtactcaggaatttcgcccgcagggactaacaccacttggacccaggaactccagcttcactccgctttgtgcactgggtggggcggtcgcggtgacgtttcaggcaacgcctctgctgtcagccaataaggagcgggagacgcgtcgggcctgcgctcaatgggccgcgctggtcccgccccactgtgatcgtgagactgcagacccgctaataaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcggtgagctgggtctgtctggggctgtccacagttgggcggtaaaagagatacggcttatgaatttgaaaggcatgtaagtaatttataatatgacttataaattaggaaggcaaccgaaagatgtttctacactgtaattcttgcagcacagctttgtatcggatggtccagtgatcgtatttcttttgataagcaggactggaaggagccgtttgtccagcttgccatatagatttggcctgaaattcaggtgattttgacaaatttgcaattaaaaatcgaaggtcataacttttttgagttacctttagcagcataaattttaaagatgtagtacggagtcagcttaaaaaatattaagggtctgataacttgactagaattaagattgtttccagtagctgtatgaatagttattgagtacctactatatgccaaatacgtgctcgtatatatcatgtgtattacatgtattgtctcatctaatcctaacaacaaccctagtctgaaccaaattctcattttttcccaataaagaagctgagatttagggagttaagtaactagccttagactagtaagtattggagatggaattcaaactttagaaacttgaggttgctttaggaaccaactcctaggcactcagctacactatgctatctctaataatgctagtaacaatttagcctattgcgtcatttaagcactgtggcttagtgattaagaacacaactcatgaccgggtgcagtggcttacgcctgtaatcccagcactttgggaggctgaggcgggtggatcacctgaggacaggagttcgagcccagcctggccaacatggtgaaaccccatctctactaaaaataaataaattagctgggcatggtggcgggtaatctcagctactcgggaagctgaggcaggagaatcgcttgaacccaggaggcagaggttgcagtgagccaagatctcaccattgtgctccagcctgggtgacaagagtgaaactccaactcaaacaacaacagaaaaagagaacacaaatcttatagtcaaaggctaggtttgcattctgacaccacttcttctgagctgggggaccttgggcaagttagttaacctatcaaaacctctgactgatcctgtataaatggggataataatagtatctaccacataagttgttgagatgtatttaaggctgtatagtacataataattactcgatggtaatttgttttttcatgatgttcacatttacactatttccatttgatcctcacaacaaccaggtcagaaggcaggacaggtattatgtactttttatagaaaaggaactgacacagagtcatacatgaatgatctgtaaagcctacgaaggagccctctttgttaatcacatagcttttttcccccttttggtggcatacttgatggatcttagagaatttaaaagttgctgagatttgtaagaattagttaaagtctgtaagtccaaagccttgattatgctttggaaaccacttcagtgtgttatataagttgaggaaaatccttacagacagtcccttgttttgtgagatagagttctaaggccatttctacaactggtttagaatactctttactgtattttagaatcaaaatatgtacacagcctctctttctttctttcttttttttttttttttatttttcagagagagtcttactctgtcacccaggctggagtgcagtggtgcgatctcggctcactgcaacctccgcctcccgggttcaagcgattctccggcctcagcctcctaagtagctgggattacaggcgcctgccactgcgcctgactcattttttattttttttagtagagacggggtttcaccatgttggccaggctgctcttgaactcctgacctcgtgattcacccgccttggcctcccaaagtgctgggattacaggtgtgagccacggcgcccggctcacagcctctctttcaaacatgcagttcgtttcttgtgtagggtttaatgaaagtgtagctgcccaagctttggaacttagtgcaaaagtttaccattcaggtgtgatattaataattaaatgtttccaggaagccagcagggatggttaaatccacaaaaactctgcttaatatcttttttttttttttttttttgagacagagtcttgctctcttgcccaggctggagtgcagtggtgcgatcttggcccactgcatcctccacctcctgggttcaagtaattctcctacctcagcttcccgagtagctgagattacagctgcccgccaccatgcccagctaatttatttatttttagtagagacggggtttcaccatgttggccaggctggtcttgaaatcctgacctcaggtgattcacctctgaaagtgctgggattacaggcatgagccaccgcgcccggccctttttaaaaatcagctaagaccactaaagggaatttgaagagctgaatgagaaacgggaggtacctttctgtggcagaagccacgtgaatccaaacttttttttttttaatctgcagggtacagctgcaggtcatggtaagaaggtgatggtggggaggggtaaggatatcctggagccctataaaatatgtctgctcaggttgggcgcggtggctcacgcctgtaatcccagcactttcggaggctgaggcgggtgggtcatgaggtcaggagatgaagaccaacctccccaacgtagtgaaaccccatctctactaaaaaagtacaaaaattagctgtgtgtggtggcgtgcctgtagtcccagctactctggaagctgaggcaggagaatcgcttgaacccgggaggtggaggttgcgccactgcactccagcctgggcaacagagcgagactccctttcaaaaaaaaaaaagtctgctcaacttgtcataaacaagggcacatagcaacaaaacttttagaagttattgttgttaatactgggagcttctgaatcagaaacaaaggtgaaagagtggttgtgttttgttatgttatgtgaagcagagggagaaaattataggacttctaattaatgttcgaatccttggttcacaatccggttttgacactccctaggtactattgcatttggcttcactttcctcaaagccagtcataaggattagtagaatgactggatgaatatagctagcagggtgccatatatgtaaaaggagaataatgcaatttttttttttcccgagacagagtctcgctctgttggccagcctggagtgcagtggcactatctcggctcactgcaacctccgcatcctgggctcaagcaattctcctgcctcagcctcccgagtagctgggattataggaatgcaaatttttaaaaagtattgtgtggagctgttttgccaggaattgctccctatgctttgagccactcttgtagagccaagatgtgaatgaatgttgagcattggtaggatgtgatcataacttcctgttgtatgctaaatagaacttgaatcagcctgacagatggctcactcctgtaatctcagcactttgggagaccaatgtgggaagattgcttgaggtcaggagttcaagaccagcctgggcaacatagctagactgcctctacaaaaaataaaattaaaatatttgttaggcatggtgacatgcacctgtagtcttagctactcaggaggctgagatcggaggattgcttaagcccaggagtttgaggctgcagtgagctatgattgccccaccgtactctagcctgggcaacagagtgaggtcctatccttaaaaaaaaaaacttgtatcacttaatcatttatttcttaggaaatgaaatacaggttagaattaggtttattctgttggctcatgcaagtcccttttcctaatgtttccagattaatgaaaaaaggtgagtctaacataataaacatactaataataaaaactgccatttatttagtgattagcatgtgccaggaaacatgtagtgaatttgtgcattatctcattttatcttcacaacaattttatgaaccagatatctgtattttattcccattttacagatattgagattgactcttggaaatgtgaagtaacttacctagtgtcatgcagctcataagtggcagatacagaattcacatagagtttgtttgacttcagagcatcttgactatagccacagcactgttctgcttctgtattaaagcaagacatatcatgactaaagaatagaaactaattatggtagggtgaaactatagttctctatgttaggactctgataataaactgaaatctcttaggatgaactcgaacttgtttttttcagggttttgaatatagccgttctggaaatcccactaggaattgccttgaaaaagcagtggcagcactggatggggctaagtactgtaagtaatttccatttcacagtctagaatctatttttaaatgtatagagaaaaccatagaggcacagaatgtggaactgaaaagaaacagatttgctagttcaaaattcctgttctactgcctttgaattctttgcccaaggtccctcagttggtataatatgcatatgtgtaatcatcaggtaaaaatacgtatgaatagaggacaaatgaataaaggaaaaaattcacacgaatactacatttattaatactacatttatcatgtagtattcatgtgaaaacaatcttcatctgaaactgtcagtataaataaataaatggaaattaaatttaataacaccacctattagaatataaaatctttttttgagacagggtctctcattctgttgctcaggctggagtgcagtggcacaatctctgctcattgcaacctcctcctccaggattcaagcgattctcctgcctcagcctcctgagtggctgggattgcaggtgtgcaccaccacaccctgctaatttttttttttttttttttttgagacagagtcttgctcttgtcgctcaggctggagtgcaatggcaggatctcggctcactgcaacctccgcctcctggattcaagcaattcttctccttcagcctcccaagtagctgggattacaggtgcctgccaccacgcccagctaattttttgtatttttagtagagatggggtttcaccatgttggccaggctggtctcgatctcctgacctcgtgatctcccgccttggactcccaaagtgctgggattacaggagtgggccaccacgcccagccttttttttgtatttttagtagagatggggctattttggccaggctggtctggaactcttgggctcaagtgatctgcccacctcggcctcccaaagtgctgggattatagatgtgagccaccacacttggcctaaacttgcttatcctctggtttattcacctaataatttgtgcctgagaatagcactaaagttattttcagtggtcaataactcctgataatgtgctgtcagagattagagattaactccctaaacttttttttttaatgaagagagtcttgtgtattcattgtgattacacttatcagacaaatctcaggtctgattgcgagttttgttaaaatatttactgaattgcatattcatataattaacgtatgaatcatatctttgctctattctttatgtttgaaatttctcttttctttcttttttttttgatatggagtctccctctgtcacccaagctggagtgcagtggtgcaatcttggctcactgcaacctccacctcctgggttcaagcgattctcctgcctcagtctccctcgtagctgggattacaggcatgtgccaccatgcctggctaatttttgtatttttagtaaacacagagtttcaccctgttggccaggctggtcacgaaatcttgacctcaaatgatccacctgccttgggctcccaaagtgctgggattataggcattagccaccacgcctgccctgaaattcctttagtttgctatttttaaactgtagtttaactggcaataggccttttatctcagatatttgtaaagaattattttcttgaagtgtttcagagaaatattattaccaaggcaaaattgacttaacacaaaagtatctgtccacattatatattttttattttaaagatatcttattcttgaaatagaaaaggagattttgtaatggtattaatcaggggcctctagcaactcagcagtgatggcttcctatctgcattaaagtaagtcaggtaaatacttggaggtgtgttgtaacctataggcctgacttttcagcttactctaacttgatttttattttaggtttggcctttgcttcaggtttagcagccactgtaactattacccatcttttaaaagcaggagaccaaattatttgtatggatgatgtgtatggaggtaggtgacccctctcatttatattctgtaaacttgtattttacagataataaagtgagccctgaattaatattaacaatgttgccagtatttttgattatttattatagtttacaggtgtgacgggtacctctatgctctctcagacttgggaaaagaggagcataaacacttagggtccatgttctggaactgcttataagagagattatttatttatttatttgtttatttttagataggatctcactctgtcacccgggttggagtggagtggtatgatctcagctcactgcagtctccgcctcctgggttcaaatggttctcatgccctagcctcctgaatagctgggaccccaggcgcatgccaccacacctgactaatttttgtattttttgtagagacggggtttcgttgtgttggtcaggctggtctggaactcctgagctcaagtgatcctccctctccagcctcccaaagttttggaattacgggcgcgagccgcctcacctggccagagattatttactaagaatagtatttaaggtgctagaatgaatacgtagcacttgatcaacttgcagacatattctgctctagagaagataaggtttagagagacagtgttctcctgtaacttaatttttacctgtaataaagatgaaatacaactcaggttactctcaagagttcaaccccacacatccccttttgctttttattttttgtttggcaccagggaaactttcaaaaatttgttgagagatatgggcctcttttcccaaaaaatgttcttaagactacactgagtgattagcattttaattttaggggtctcatggattgaaccgctgaagcccatctatggctctaaatttaagaacttcccattaactcttcatttagcattaggtatatctcctaatgctatccctcccccctccccccaccccacaacagtccctggtgtgtgatgttccccttcctgtgtccatgtgttctcattgttcaattcccacctatgagtaagaacatgtggtgtttggttttttgtccttgtgatagtttgctgagaatgatagtttccagcttcatccctgtccctacaaaggacatgaactcatccttttttatggctgcatagtattcccatgtgtatatgtgccacattttcttaatccagtctatcactgttggacatttgggttggttccaagtctttgctattgcgaatagtgccgcaataaacatacatgtgcatgtgtctttatagcagcatgatttataatcctttgggtatatacccagtaatgggatggctgggtcaaatggtatttctagttctagatccctgaggaatcaccacactgacttctacaatggttgaactagtttacagtcccaccaacagtgtaaaagtgttcctatttctccacaacctctccagcacctgttgtttcctgactttttaatgatcgccattctaactggtgtgagatggtatctcactgtggttttgatttgcatttctctgatggccagtgatgataagcatatacctaacgctaaatgatgagttaatgggtgtagcacaccaacatggcacatgtatacatatgtaacaaacctgcatgttgtgcacatgtaccctaaaacttaaagtataataaaaaaaatttaagaacttccattccaaagaaattaaatgttagctatttaaagtggtgaatgtggagaagacaggcttgcccttgcctttaagcccactgatttttgtatttaaaacaaaagcaaggaattttgtgaatatacatatacatatattccagatgcttccaaataattaaaatgtgatttctagaatattatcattttatctatttcctatctgaacaaaaagttaaatcactaagtcctttaaaacagcagttcccaacctttttggcaccagggaccggcgtgtttttttttttttttttgaggtggagtcttgctctgttgccaggctggagtgcagtggcacgatctcggctcactgcaacctccgcttcccgggttcaagcgattctcctgtctcagcctcccgagtagctgggattacaggcatgtgccaccacgcctggctaactttgtgtttttagtagagccagggtttctccttgttggtcaggctggtctcaaactcccgaccttaggtgatccacctgcctcggcctcccaaagtgctaggattacagatgtgagtcactcgtgcccggcctcagggactggttttgtagaatacaatttttccagggacagggggatggttccaggatgaaactgttccacctcagatcatcaggcactatttagattctcataaggagcatgcaatctagatccctcgaaagttagattctcataaggagtgcacaacctagatccttcccatgagcaattcacagtaggtttcctcctgtgagaatctgatgctgccgctgatttgacaggagactgagctcagggagtcatattgcttacccgctgctcacctcctgctgtgtagctggattcctaacaggccacaaacctgtacctgtctgtggcctgggttggggacccctgctttaaaggaagggacttactcttagtaatcattttatccctcagaaatttgcacaatgtttcgtattttatcttagtttcttatattagcttgttgagttgaaattatagaaatctgaaacctttagatacttttataatgcaatataaaagtctcatggcaaacataggtataaaatcctgaaaattgttgattttaaagaactttttacattatttttcaattttatattacctagggtcagtctacataccatcaaaagtctagtttctcattaatgacagaatattcttttgttgttgttgttgttattgagtatcaatatcaattttttctttaagtttttatgtgtaaaaatcaaatctaggtgtatttataaaaaattattttaagtcaaatgatttaccttgtttcactgtaaaaatctggtagtttgatttatattgtctcattttatcgattaaaactttcagaactacataacaaaaagatcaaaaaagtacaaagaatagtaaccaattcttttccattacaaagtatattgaaatttattttgaacctttcattgacattgattcatttagtttagagttgagaactaggtagaaattgtttgaaaagatatgatgtttcaggaagcatgtcacttagtggagattggatgttttgaaaaacattatttgcttcatgctacttttggatctcaagtgtgttttatttgactcttgagcctttagagaacaaaccttattattctttactatatcagatagccgaactatttaaccaaactagaattgcttttagttgcattttccttggtgactgagagttccatatattttgtaagtgtttatacatagaaggaatgaatgtttcttaatgcaatgttcttttcattttatctgattcccttctgtctcaggtacaaacaggtacttcaggcaagtggcatctgaatttggattaaagatttcttttgttgattgttccaaaatcaaattactagaggcagcaattacaccagaaaccaaggtaactcagctcattttcagttttgcctgtttttccttcgatgttttgttttcatcatttctgtttactagaggatataatttaatgtgaataacaaattttattttatgccattggaaacatcaacaaaattaagatagactgtcatctccggggtgttatagcataatggtagtacatgatttctggagtagaattcaaattgtgattctgttatcttagttagtatattatcttgggcaaattatttaaccaaagtctcagtttcttcatttgcaaaatggagataattataccggttttatagaaacgggagtgtgagaatcaaatgagataatgaatatgaaatgcttagtatagttcctggatacatggtaattgttaaaaaaatttctatgcaggagcacctaatttttaactgcatagccaaaagagtattggtaacagaagtcatcacagagattggactatagaaaaagaagcctgccaaacccccaaactcgaagcacagtggctttgccgggctgtaagggatgctgcccagatactagttagatgtggagaataggccacaagcaatctttagcttccatcctgggaaatttgtatgccaccggaaggtgttttgtgtctgagtgaatggcatatgtgatattctttcttgggaccttatttaaattctgtgtggataaaagaaggaccagtgtcttttataagtcagctgtttacaactttttgctaatgattaaaaggttagaattgtacccaagattatgttgcaatgaatgctaaaaaataaatatcttttcatgtacaaataattactttgcacattaacatggttgagcttttggtaattaaggtttgtttccagaagaacttgttttttatcttgcttgggagaaaagtcacattaaaatagctggtctgagtcttttttttttttttttttttgagacggagtctcaccctgtcacccaggctgtagtgcaatggcgcaatcccagctcactgcaagctctgcctcttgggttcaaatgattctcctgcctcagcctaccgagtagctgggattacaggcgcccatcaccatgctcagctaatttttgtatttttagtagagatggggtttcaccttgttggccaggctgatcttgaactcctgaccttgtgatccgcctgcctcagcctcccaaagtgctgcgattacaggcatgagccaccgtgccgggccctggtctgaatctttctaagggaggaaagcaaattatgagtacagtaagtcttgtcaacagaattttatatagtgactctaccaacttgaattaataccttttccttcctaaaatatcaggtttttcacttgaagtagaatgtttaagtccatgtaaaacctactttttatttatttggtaatttttattttttttattatcagtaggaataataaattcttaccaggaataatttttatagattctttaaataattcaagatttttgtagaatatgtattatttaaccatcttatcttttccagagtaaaactctaaagtcagaagagtttaaaccagatctcttgcccatttaaataacaggtaataaaaaaagaatcagctgggcacagtggctcatgcctgtaataccagcactttgggaggctgaggcaggaggatcacttgaaccaggagttcaagatatatagcgagaccctttctctgcaaaaaaaaaaaaataataataataattggccgagcatggtggcacatgcctgtagttccaactactggggaggctgaggtaggaggatcacttgggcctgaaaggtcgaagctgccgttagctgtgatcatgccactgcactctagcctgggcaacaaagtgagaccctgctgcttaaaaaaaaaaaaagaaagtaattcagtacaatggcatttcgttcaacaaatagaattcttttctttggtctttttgataactatcaagcatctaccatgtgtctgaattgtggtaggttttgagatataaaggtcattgttactttttaagtaggcggtaaccacgttttctgttgtgggtgtcacttttcttctttagtctaaagcccatgctcttcaagacttagatacttattctatagtttctagagtttctggcattaagttcatattaaatatatttttggcatcatagggataattctctttcattaaaattctaggatgtattcttacacaatctatgttattcatctctgagacaaaatttccagacactgagctgtctttggaatacactttcttttttaagaaaagtacaataattaactttagtacttttctgtttacatgtacgttatctcacttgatctttacaaaaaattctgtaagataggtattaccaacccaattatacagatcaataggatacattacatacctacggcttcagaaatttgcaggtaaggctgggattcagatttgaacctcccaacatcatcatccatgtgtttccattatacaatgtagcttcccagattgttacaatatatgagatgtatgtttgtaaagtatatttttacaaactactgttatttgctgaattattttagcttgtttggatcgaaacccccacaaaccccacccagaaggtgattgacattgaaggctgtgcacatattgtccataagcatggagacattattttggtcgtggataacacttttatgtcaccatatttccaggtaaatgaaaataattttttttggcacaattagtagaccacatatatctgtaattaggaaagaaaggacttgcttaaattaaaatcatgatcaaattcatgaaatctaatcataattaattatttactggatcgagaattaaatttggacctcttctaccattagttaatatcttttcaaacctatgttaatatcctctatgttactttgtgttttttatttattaaagcttaccagttctcagggctgtgcgtggtggctcacgcctgtaatcccagcactttgggaggccgaggcgggcggatcaggagatcagggatcaagaccatggtgaaaccccgtctctactaaaaatacaaaaaattagctgggcgcagtggcgggtgcctgtagtcccagctactcgggaggctgaggcaggagaatggcatgaacccgggaggcggagcttgcagtgagctgagatgacgccagtgcactccagcctgggtgacagggtgagactctgtctcaaaaaaaaaaagcttacgagttctcttagagtgtgtaaactctgaagaaatggccttattatgtgattgtatctgctaataccttatgcatagtaaggacttgaatgtttatgcattgattacaaatcagtcatatttttcagtcaccttgaatatttttatatatattctaaaagaaaagtgatgctcaatgatttcagtatatattatacatattatttctcttcttctagtttttattccttcagcactccatatactatgcctagatctctttaacttattattattttgaacttttactttatttattttacattatagctgtaagtatttatagtgctcttatgttagtctctttgggtggccataacagaatactataaactgggtggcttacaaacagcaatttatttctcacagttctgaaggctgggaagtcctcaatcaaagtgccagcagattcagtaccggtgagggcccactttctggtccatagatggagccgtctcgctgtgtcctcacatggtagaagagacaaggcagttatctggggcctcttttatcagggcactgtattagtccattctcacactgctataaagaaataatccgagactgcgtaatttataaagaaagaggtttaattggctcacagttctgcaggctgtacagaaagcatgatgctggcatctgcttggcttctggggaggcctcagaaaacttacaataatggcagaaggcaaaggggagcaggcacaacacatgaccagagtaggagcaagagagagaacgagggggaaggtgctacacacttttaaacaaccaaatctcacaagaactcactcacaattgtgaggacagtcccaaggggagatgactctaaaccattcatgatatatccaccctcatgaactaatcacctccctccaggccccacctccaacatttggggattacaactcaacatgagatttggtggcgacacagatccaaaccatatcaggcaaaaatcaccctaatcacctcccaaaggcccacctcctaatcatactagtgattagatttcaatctatgaattttggaggacacaaatgttcagaccatagcagctctctttaaagatttctttcgctacctagccccctctgcatttgtttcctccccagaccacccctcccatacatctatcctttccttttttctctgtcttgtgtctagtttcatcctcttttgtgtttcactttcttttgtagatcactttgggatctctttataattaacttgtttcctgccttttccacacaagttctccctctctttcctctgagtaacccaactctttcctttccttgttaggagataccttcttcctgctcttttcttcctgcctgtaccttgtcatacttagtacacttcctgtagttcatctctattctgcagagttcctgaaaaccagctcattttctctggctcttcaattgggcagatgtttacaggttttattgtttacatttccccccttctgttctgggtccctgaagttgatccaggttgctgcctccatgtgactggctgactccctgggcagttggtataaacctgcttttcaccttcctccattttattcgaaggcattgtcatggtttattttcctttcctgaagcacacttcctggctacattgcattcagacaccttcgtgggccatctgcctttggctcataatgtatctttgattgctgattttatcaggtaaagcagtctgtttcccagtgaaaaatcttctggcattgtctatttggcatcttctatttgtcccaggtggttttcagtgtaagattccttatcgcaactccttagcccatatgccacttacattaggccagttaatacagcataggatagctttagctgagacacagtgagtcctgtatattcccaaaaagattgcatacgttttgtagcctggacctgcccgggttactcatcaaacctggccctctttctcctattactgtcactaacataggtctagtttttctacctttttgaagcccacatcacattccgcatgccaatgattggaatttgcttcatttcaatttggatttattccagctgaaatactcagaatcgcatcatccctaagtagccacatgtgttgtttccatgaagcaaatcttcctgaaaaaaatcttctcattgtcttaccttaatgaaaatggaatatattctctttcttcccagtcttttgtcctctggatcttctgtaagtctcacgaaaggcaaaatagacctaccatcatcaagtttcagagtagcacctctggagtcaggcagtctgggtgtgagtcctggctctaccagctttttaatctgagggatctatctcatttttcttagtcccctttcctcacctgtatgatgagagccataaaggtactgattttattgagttaggtattttgtacactgcttccctgggttatataaagtacgtagcatgattctcagaagataatgagatcagaggtgttagtgatttggtttttatttttccttctcttttggctgtagagtttacagaatgttagcactagaaaagaccttaggcctcacctactttgaccccatccctttaggaaccctaaatgaaaagttcccatagccacctatactaatatcttccaaagactaaacagctctaatgagggtgaaataaaaacacacagttctatgtttaggaaaatgtaaagggaaagatgttgataatgtatttttttgtttgtttgtttgttttgaaatggagtcttgctctgtcgcccaggctggagtgcagtggcgcgatctcagctcactgcaaccaccgcctccccggttcaagcaattctcctgtctcagcctcccgagtagctgggattacaggtttccaccaccaccccccgctaatttttgtatttttagtagagatggggtttcaccatgttggccaggctggtctcaaactcctgacctcaagtgatccacctgcctaggcctcccaaagtgctgggattacaggcgtgaaccaccactcccggcttgacagtgttttattaagtggaaagtctacacttttcactctggttgtaaacaaatacattttaagactacaggattaacctagaggacattatgttaagtgaaataagccaggcacagacagacatatatagcatgatctcattcatgtgtggaatgtaaaaaatgttgatctcatagaagtagtgaatagaacagcggttactagagtctggggaagggagggtggaggtggggaggacagaggatggtcaatgggtacaaagttacaattagaaggaggaatagaggaataagttttggtgttctactgcacaaaaggatgatcatagttacaataagatactgtatatatcaaaataggagagaggattttaaatgtttctactacaaagaaatgataaatatttgagatgatgggcatgctaattaccctgcttttgatcattacacaattacacatgtattgagcatcacattatactccatgacttaaaggattaatttacaggaaaattgggtgaaagaaaacacttttaaaaattccttttcatttttatttttcttaattctcccagtttcagacatatttatttatttatttatttatttgagacagaatcttgctctgtcacccaggctggagtgcagtggtgtcatgaaaagctcactgcaacctctgcctcctgggttcaagtgattctcctgcctcagcctcctgagtagctgggattacaggtgcgtgccaccatgctcagctaatttttttgtatttttagtagagatagggtttcaccatgttggccaggctgggctcaaactcatggcctcaagtgatccacccacctcagcctcccaaagtattgggattacaggtatgagcccccgcacccagcaaatttctttctttcttgttgttttttaagataaagtcttgctctgtcactcaggctgaagtgcagcggcttgatcatggtccactgcagcctgaaactcctgatctcaagtgatccttctgcctcagccccctaaattgctgggattacaggagtgagccattctccaactcccagccgtctagatttcttgtaatacctaatacaatgtacatgctttataaatggttgttacactatattgtttaggaactaatgacaagaaaaaagtctgtacatgttcaatacagacacaactgttcatctatttttccaagtatttttttacccatggttggttgaatccatggatgtgaaacccacacataggaagggctgagtaattaggaatcaagatcatgacaaaccccaaatgtaaataatcacagcatacgtcatgaggttttaatgattaaaaatctaagcagatgagtttatacttactctacataaaaattgctgaatgttcatttcaactattttatgtgtttaatgagtcataaaatactagagtctctactgtaggtaataaatttagagtcctgtcagcaattgctataaagaaacaggttcaagagaccagttgacctgggcttatctgcgctttccaagaaacttttgccttcagattcaatactggattcaatactttacatttttctttggtgggagggaggcaaaggagaaataatatcagagatcctggaaaattttaagatgcacatacttttgcaaagttagtattgattagaataagaatggaatttataattgcaaataggcaggtaatgaagcatattttcaaattgtttctcatttaaagtaaaaaacttgttctttcagcgccctttggctctgggagctgatatttctatgtattctgcaacaaaatacatgaatggtaagatgcatactttgaatgttctttttcatggataggtgaaaattgcatagggcttggcttttgatcccttttctttgattattttgtagattatttcctgtgactcatagagagagtaaaaaaaaaaatcctttgattaaatgtaggatttcattaacagtacacaaaactatgctcatgatttatgagaagaggattaaagttggccataaaaagttatgcttttatcttgctgacaccttaaagaaacattttgtttttatataatttttattttcttgttttagacatagcttttgctactgtccagttgaataaaggttacttaaacttattttatagagctttttccctgagagttttttcaagtgaaaatcacattttgaaaattataaaataaagagtaaacataaattgtttctaactgaaatttttgtttgtttgtttgttttttgtttttaggccacagtgatgttgtaatgggcctggtgtctgttaattgtgaaagccttcataatagacttcgtttcttgcaaaactgtaagtattaaaaagtgcaggttccctatgacactctcagtgactacatttgatatttgtatttccactaagtgatgtgaagtgatggcattctaataatttatgaagaaatgaaaaatagaggagaaaaattctgattttttttatttattaatttttttttttgagatggagtttcactctgttgcccaggcgggagtgaagtggcgtgatctcagctcactgcaacctccacctcctgggttcaagcgattctcctgcctcagcctcctgagtagctgggattacaggtgcccaccaccatgcccagctaattttttatatttttagtagagacggggtttcaccgtgttgaccaggctggtctcaaactcctgacctcaggtgatccacctgccttggcctcccaaagtgttgggattacaggcatgagccaccgtgcctggccaaaaaaattttttctgattttagaggaaagtgttataaaaatagttattgcaggctgggcacggtggctcatgcctgtaatcccagcacattgggaggctgaggcaggtggatcacttgagcttaggagtttgagatcggcctgagcaacatggcaaaaccctgtctttaccaaaaatacaaaccaattagccaggtgcagtggcatgtgcctgtggtcccagatactcagaggctgaggcaggaggattacctgagcctgggaggcgaaggttgcagtgagctgacatcgtgccactgcaatccagcctgggcaacagagtgagatcctgtctcaaaaaacaaaaaacaaaaacggttatagcatagcaaggctttatgatatgatataagaaatgagtttttttattttcatgtccatcttaattataatcataatttgataaagccctagtgaatttttagtttcaagacttaatggtttttttttcttttttaaaattacatttgaaatgagggctttcatatactataccttttatatcacgaatgatggttaattttaaatagcacttacagtataaacttacatttttcaatagatgtctaaacaccatttcctatttacattgcttagtttatctccagtatagttaaatattaagccattgtaacttgacaggtaaaatataaacatgattaggaataaaaatgtcctccacaagggaaactgaaacttattgcttgataagtgtcctttggtttataaaaagtagaaatgaagtatatatcctggaggcatgtgaaatcattgaccgctttgcacaaaggctaaatagaatattagtagaatattcagtaataataggacttgaactgctgtttttctctgtatgttaaaataatttttcaaagaaatacaaggttaggctatgaacaatttatgattttattaaaatcatagaaaggactacttatcttcatatttgagaagtttatatcattgtgcttttacttagttttcagcatatttgcttcccctcattttaaagtaaatttctctaagcatattctatgctttgttcttctgcttctgatttgatatattattttcctcctagaactcaaacattgagctttacacctagcttctgagagtcactgtaatggaaaagagaagccagataatttcttggccataccctgccttcaaacttatccaggatgtgttcattttgcagctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctggtatgttaatttgatttctaagcagatctactaggatttcagcagttatcctgagcatcgtgtttatgtaacatttatttgtaagttaggtgctttcacgtattgtttttgttcatttattattgagcactgccatgtgtcaggctctgtggtgggtcaggtggaaagaagatagacctggtctctactgttgtattgcctctagtttagtggatgcttggatagtagaaaatcagttttatgcattagttgttcctgtggtggtctgtgatttgaaggcttgtgtatacctattcaaagattttaacattagacttttcagttgatttgcttataatcttgtctgtctgctattcagcattagctgtcactttaatctgatagaggtttgtcccagttgagacttgatattaggtgctaaaattcccctgaggttctctctctctcttttttttttttttttttttgagacggagtttcactcttgcccaggctggagtgcaatgatgcaatttcagctcactgcaacctctgcctcccgggttcaagtgattctcttgcctcagcctcccgagtagctgggattacaggtgcccgccaccacgcccagctattttttgtatttttagtaaagacggggtttcaccatgttggccagtctggtctcgaactcctgacctcaggtgatctgcctgccttggcctctcaaagtgctgggattacaggcatgagccactacgcccagccccctgaggttctctcctgtatttctctcctgtatttttattccttcacctcttccagcatctagaaagtcttctgtggagttggctgacttacatcttactttttgaatttatttttaccagtcttttaagctgtggtggtcctaagtagttcttttctttttagatccttttgagggttctagcatctagaatatatagaaaaattaagactggaatttcactaggaaattcacaaggaatttagagaaaccaaagcgaaatacatatgaaactaaatgccctaaaggtactttaggtaaagagctgttgattgatatatattttggatggagggagagagaagagttttgagctatgccatgaagaatgggcagcattggttaaaagggcatagacaaggtattggagatttattcaagaaatttttattaaacgccagctatgagccaggctttgcactaggaactgggatccaattagtaacaaaagaaatggatttgccctcatggagcaactctggtggctaagacagatactaagcaagaaattacaggatataattaacaagggaagtccaggttgaagggacagcatgtgcaaaggtcctgagatgaaagggagtgcagtggtgctggcataaagaaagctgaagagggtagaaaagatgaggcaacatgaagctggagagataggggcccaagcaagtagtcagatgtgagcatggcataatcctcgtcttaggcttatttgcagttaagtagacagtgaaaaataccaccctccccccccaaaaattacatgtttaattctaaaataagacttatgataccttatgattacagggctgccctctcatccacagcatgagttggtgaagcgtcagtgtacaggttgtacagggatggtcaccttttatattaagggcactcttcagcatgctgagattttcctcaagaacctaaaggtaaacttacaaaataggtttaaaattgtaggaggtaaggccttacagcagttcactatctctcacttctactcaagccagataatgtttttgtatctgcaggttacactcataaacctctttatcatgaaatgcattgggttgaaaacaacttaaacaacaatgtagcagacatctaaatatgttcacttacttaactctccacatactacaatcagtttggagacacagagtattctaatgcatttatttaaaagtgaaccccttttttcagatgaaataggtaaaacctcgaagtagtgtgcagttagtgcactgcacaagggctgttctaaaatccatcctgtgaatggctttccaaaccctgtgcctcctaagctgcatctgactggggtgaggcctttgtctaattttcaaaaagccaggaggaggctctcaggggccttgagcaagaggcctgtccaactccatacactgggcttaaccttgagctcatgcagtttatatactacagaatagattaacagaaagctgccagattagtcaaagtgttcctggtgtcaccttaatttaatacatttaccaaagtaacttttaaaacatttgtaaagttttatgacactatcacactcaacataaaaacagtggttttttttttttcccctattccagcagggatttaaaggatgtatttcataagtgatatatattaacaaggaagtatgtataacttgggaagcatttagagatttttttatttaagtggtaaccacagagcaaagtctcaaatgcaataatttttttttttttttttttttttttaggcagagtttcactcttttgcccagactggagttcagtggcatgatctcggctcactgcaacctccacctcctgggttgaagtgatactcctgcttcagccttccaggtagctgggattacaggtgcgtgccaccatgctcagctaatttttgtatttttagtagagatggggtttcactagttggccaggctggtctcgaactcctgacctcggtgatccgcctgacttggcctcccaaagtgctgggattacaggcatgagccactgtgcctggcctaaaaacatttatttttagattttagtatttttattttactagaaaatctaaattcatgttttctttgctatagctatttactctggccgagagcttgggaggattcgaaagccttgctgagcttccgtaagtatagttctgtttttctcagtattttaaatttgatgtcagctttaatgattgggaaagaaatatgataaggtcagggataattcaagatatttaacaataagaatagcaggacattaatcagaatggactctaaccctgtcaagatggagaccctgataaaatctcatggagggcttcttgttagtgagcggtgtcctcccaaatgttgcttccttccctgctctgtcaaaaagagattccagcagtaactgtattctaggatctctgatctctgacctctaagcaagggccacatgttctaccctactcagccttagaggggattggagactttgtactagaaaagctgttttcaaggctctttgggaaacagaaaatgtgtctctgatgaaactcctccatgcccttgattgttggagaacagccctactagatactgtcaaatcttttgttttctgttctctgtaggataaacctttaatgtcttcatgttgtgtacaagataaatccaaaccctaacttggtaccaggcccttcagtatctaacccaatcaattcatctagttttttcaaagcatcagaggatattggtacaagaagcagtctaagatcatacagtccagcagcttattttacaggcaaggaaacaaagatccagaaagttgagctgattgactcaagtgtcacacaggaacgtgttcgcagcttcactcttggatttgcatcagaaacagtgaggggaggtaaaaggtgcttggatctagatttgagatctgcttccaccaattagttaacctttaaacttccattttttaacacataaaatgagattaataattaatgattttcggcctggtgcaatggctgacgcctgcaattccagtactttgggaggccgaggtgggccacttgaggtcaggagttcaagaccagcctggccaacatggtgaaaccctgtctctcctaaaaaaaaaaaaaattatccgggtgtggtggtgtacacctataatcccagttacttgggtggctaaggcacgagaatcgcttgaacccaagtgatggaggttgcagtgagccgaggttgcagcaagccaagatcgcaccactgcactccagcctgggtgatgcagcgagactctgtctcaaaaaagaaccaaaacaacaacaaaaaattaatgattatcatttattgattacctgtccccccaagcattcctgatatatatattacctttattatatgctactatgaccatatgttgtaattactgcagggttaagtcaacatcataacctaactatttttaactgtactaaatgtatacggtgtatttctgtgtcttcatttttataaacatttatggaataacttgttttgcaagcattgtgtggagaaatgtcaggtcccaccaaagtttaggcctattttctgtctttgtataggagtttacagttagaccaaaagtcaggcagtctcaccaagttaaaaaaaaaaaaaagatgtctaaataatgacttgaaataattcatgtaacgcagatttttgttagtctttccggaagatgcctgctagtaagtttggatgcacaagagggcacactcagcatgtgaaatgggtttgtttttcacagtaatgaaatgtgtattacgttaagactctcttgtttaaaaaattgtcttaaaataaatctctcctgatttatttagggatttttgtttaaagttgcttggcccccagacactctggtttaggctataaccccgatgccagaggatgagtggatttaggtcagggcttgtctgttctatcacccttcattctgtgtctcccaactctgctgctactagtgcagcattgcaatatgggaggaaggaagtgaagctaatgtgtattagcttagtctcccagcctcacaacacatgtaactctgtgaccttagaaaagttactcatcctccctaaatctcaatttcctcaattttaaaatgtggacaacactctacatagctcttaggtttgttgcgagaacatggggaaaaaaatccctaagctaatgccttcgttcatactaagtacccaataaacgttagcacctactatgaactattatcttttattagacatctctactacattccaagtgcttagaagtgctttatacatgttccttcaaattaatgtctgtgacaaacctttaagacaggtgttatatccaatttttattcattaaaaaaatgaattaatgcacacaaaccacctagtagagtatctgtctcatggtaagcacacagtagatgcatctattattatttcagataaggaaataggcactgaggatgagtaacttttataaggccacataggcagtatgtggaagggctaagattcatacccaagtttgttggtctctgagacctgagttcttatttctacatgtacacactcttttaaggaattacgagtctcccagggcagaacattttaagatggatgtttgtatctaaacaacactttagtaaagtgacaaaggaagatatccatcactcagaccacagctgagatttttttttccccatggctctcatgtaagagaggagaaagcagcttaggtattgattttgctggtggtgtgcagggaaaggaagagtgttggttgtaatacacatactggggttaagtaagatgctaaacctctcctccattattcttcacagaaatttctccttccctggaacttggcagtctttttgtctatacttgtttggcattgtttatatagactattttgttttgtgaattgtcatcgcttttacctcctgctttgttatttaggttaaagaaaatatctcattcttcttggtttcccaatttttactgcagtgcttgacatattatgggtggttttcctttacatctgttgatgatggtaatgggctgctagatcgtttgaaaaatccttccaggcctctatgccaggagttatattgtggaattctgaatgcttactggttgctactagtgattcttggtcatctttctccgatgtgcctcagaaggtctagctctggattgatccagaggaaactaattatgacaggctcttggtccaagagacctcttataagtagcaatccagtaggttggtcatggagtacatgatttctggccaaacttcatttaggcaggtattaaaatatacacgttggggaggctatgccttaccctactgcatgggggtacttgacacacactttcagtatttggattgagcatatcttaccaatggtataaacaggataaaaacaatcttgcttttcatttaaaatcatagctagaagagataagtttcgtaattttctctttttttgcctgtgaattataggggtatgcaaaatttgatatttggaccagaaaaatgttgagggtaattgcagtttatgagacagaaacatgcctccactgacacaatatagtgatcaaaaatttgctcatgtcttctttcagggcaatcatgactcatgcatcagttcttaagaatgacagagatgtccttggaattagtgacacactgattcgactttctgtgggcttagaggatgaggaagacctactggaagatctagatcaagctttgaaggcagcagtaagtcttattattgtgtgtgtgtgtgtgtgtgtgtgtgtgtctgctttatcttgggcatggggggtcactatatttacaaagtgtggtctcactgtgaactctaaagcttttctgttcctgtaatagaccaggtgtataaataaacgtatagggagctcagtcaaagtgcatatttaaaggatggtagtattcagaaaaaggacttcttgaggagttgaagctatggcctatatgtttaataacatatttttcttgtgcactgttattatagcaccctccaagtggaagtcacagctagtattccagagctgctattagaagctgcttcctgtgaagatcaaatcttcctgagtaattaaatggaccaacaatgagcctttgcaaaattttcaagcggaaattttaaggcacctcattatctttcataactgtaattttcttagggatcatctctgttaaaaagttttctgtatgtcatgttataattacaggtcaattctgttaatatctttttgttaattttgctctatgtttgcctctgaaggaggtgagatttgtgctactttgggagattatgttcttttttcatgtctaagatttattttgatcatgtttataatataatggtaattcatttttgatgttttgtgaagaatttaaatttaaacgaatgttcttaaatcaagtgtgatttttttgcatatcattgaaaagaacattaaaagcaatggtttacacttagttaccataagccgaaaatcaaatacttgaaaagtttactgtgaaattctactgatttaagactatacttaatattttttaaaaaataaatcagctgggcgcggtggctcacgcatgtaatgccagcacttttggaggataaggcgggcggatcacgaggtcaggagattgagaccatcctggctagcgcagtgaaacccccatctctactaaaaatgcaaaaaaaattagacggacgtggtggcgggtgcctgtagtcccagctacttgggaggctgaggcaggagaatggcgtgaaaccaggaggaggagcttgcagtgagccgagatcgtgccactgcactccagcctgggtgacagagcgagactccgtctcaaaaaaaaaaaaaatctaattatcaaatgcatcccattgtgatattcctacattatgtgacattaacctatattcctgggtccttttaattcccaactactgctcttagaggtcttagccttttatgttaatttttataaattcaattaaataaatattattcccaaatcttagtgtttgcagattagttataaatcctatccaaggtaggttaaaggccaccgttttacagataaatagtactttttatatttttatctgaaatagtgcatttgttgagaataaaagaaggtatgtttaaaaatagaatcttttgggcctggtggtacgtccttgtagtcctagctacttgggcagctgaggtggaggatctccttgagcctaggagttccagactgcactggcgtcactgcactccagcctgggcgacagaatgagaccctgtctctaaaaaaaataataaaatagactattttatagttgaatgtatagttagcaagttatcatctgagccataagtcaaaaattaaatcttaaaaattgtttttatactaaaggtttttcatcttataatatatcttgatattgccatttgtttcggttaaaataatatcatacagcctgatgaataacagtgctgtttaggaggagaatacataaaaatatacattcttctatattatccacactcttgagttatacctattgagtctggaaattctgtctctagaggcagtagcattttgaggcaggtcctatctcactatggtttctgccagaactgatttcttgccatctcaaggccttagggctgtggaaataaatgatcaaccaaatgagaaaaggaaaggctattcttagcttactatagcaagggagttagccaccatcacctgggttttggcagaaagtcaaaggcgggcagatgggtggaaaagttttatagcagaaaaaagggaagccttcagatatgccctggttgaagactgttggcatagggaagccagaagcaggttgactggagtcagtgtttcacagtgggcaggtctgtgtaatcctacatcaaagtctaaggaagttgagaggccaaagaggcacccagtttcttagaaagaaacatttaatagggatttaggaacagaagccgtgactatatcttgggcagtgatgaggcaagttggtggatcccagcataattacccccaagacctgggacttttatgccatagggagaggagtggttgaaaaggaatttgta

SEQ ID NO: 13357 - DNA, 11411 bp, Human
cataaattttccctgtgatccagtaactccacccttaagtatctatcaaagagaaatgaaaaaaatatgtccgcacgaagacttacatactaatcttcttagcagcactagtcatagtagccaaaaattggaaactgatgtgcctatctaatagtgagtagacagataaaaatgtgttatatccataaaatggaatactattcagcaataaaaaagtaaggaagtactgatacatactacaatatggatgaatctcaaaaatattatgctaagtgaaagaaatcagacacaaagactgcatattgtatgatttcatttatataaaatgtccagaataggcaaatttatagaaacaaaaaagtagattagtggttgtctggggctgggaatgggacagaggattgattaactataaataggcatgagggaccttactggagggatcaaaaagttctaaaactgatttatggtgatggttgccccacttcagtaaagttaccaaaaatcatttaattatgcacttgaaatcagtgaattttatgatatgtaaaatgtgcctcattttgagtgagtgttatacaggaactctactaaccttgcaacttttctataaatctacaactattctgaaatttttgaaaaattaaataaaaataaaaataaaaaagtatatgtttatgaattgatatcagtatttggcagtacctatctatgtaaaatgacattttcaaagattaaataggtaaaaatttcctaacagatcagcattaacagatgaacacttaaaatcaattttgacaatagggaacactaattctgagccccaattaagcaaaatattatcccctaaaaagaattctattcttctcattggtagtcttcctgtattacaaaaaaagtactcaattactattatattttgaatttcatcaataaaaatttgttgaaatttgttttctcttttgtcataaaagtaccaacaaaatattcttgattttgccttttggcctacaaagcctaaaatatttactatctggctctttacagaaagtttcccaactcctgttctacactataacaggataaacataaacatcatgagtctctttcttgaatgtattcttatcgttacctagttgtggcataatgtcctctggatatgccctataaaggatcagtcttgcattgcttctgctatggcactatttgggatttctataaaaagaaacactattagcttaatagttgtagcaaagccttgacaacatagttaatatcgtgatattaaaatgccaacaccacagcccggtatccttaagatgaccctcatcaagctgtgatgtcaccaggctatggactcaccgaggtctcttagatatcaggtggctcccacggcatcacaccctgcctttggcatcaccctggcacatcacctcagtacggtgccatatgctatcactgctgtggtagaaccctgtcctgatgccacaccgccgagatgtcagagtaattaacccccacttctttccactccctaggcggtggcagggagggggagggtagccacagtcaccggttcgagctcaggaggtagtactcagctccaacccttgtcccttccgcctgccactgcaggtcaggaaccccgggggacaggacctttaggctctcataactcttgccctgcccccgaacctgtttcatatggccgactcaacgacccgccagcgactacccaccccggctctttcacacggttccactcaaagccgctccccgtacctgactccattctccagctgtcatcctgggccaattccaccggcaacttgactacggacggacggtcgctaggatccctgggacttgtagttctgcactgctaggggccaagtctgtgagggcagcaaaggcgcctccctgcccggaactgctctcaaactgcaactcccagaggcgccgcgcgacgggaaaagaaaagggaacgaggaaggccggtgattggtgaagctctaacggctgttttgactggcgtagccggagccggcgacgtgaggcgggcgttgctcgcgcgacaagtagttgctgggacagcgaaatggaggggtgtgtgtctaacctaatggtctgcaacctggcctacagcgggaagctggaagagttgaaggagagtattctggccgataaatccctggctactagaactgaccaggtaaagcaacgctaggtctctccgcagtcggcgacgtcggcgaagccctacgtggctttcggggcccggccctagcggaggccccgtttctgagagaagcagaaccccgcccccgccgccccaagcagtccccctgggtcacctcgggactcgcgataggcctgcgggagctagccccacagacctcagatattttcccgttggcccggagctccgctccctgatttttggatagttctagaacgtctaccgcatttctcagaaactcccaatcagtgaaaaggaaggctttttatatggatttatttacctttactagtaactgtattcagtaacgcatgtgaaattgaacgccccttccgtgccaggcagtttgctaggagctggggatacggtggagtggaagatgcagacaataaaataagcacaaaaacatgtccgattacaaattgtggtaaatactcggcagagaagtttacatggtgctttcagaacacgttaataggaggatctgatgctgaatatgactgtcgttaattggaaaagtttttgcaaagaagggaaggttagttagactttgaagcatgagtgggatttccatgggggaatgagtggacattctaagcagaggtagacagaagtttagaagtgtttctttctgccctcctgctcacaggactctcgtgctttcatcctcagtttctaggattcatggtgcctttagtaagcccacaaatatttatagatggccttgtgtttcgcagacagtgtcgtaagcactagtgagactgtcccatacttacagatctccattttgtgtcttttgggagagaattagaaatcaagagactgttttctcttttctggaactttcctttattactcaacctgaaaatggccttatctttacctggtttacttcattatggtctggtgatatttaaggatttaaatttaaatgtaatactttatattaagatttaatactccattggaaatttaaccattcttcagtcaagtcagtggcttaaaaagggaaaggaactattcagcatcaagagacgtaaaaaacatgaagaaatgcaatttatggatctcgtctggttcctgatttaaacaaaccaactgcaaaaagacatttgggagacagttgggggcaatctgaatacagaccggatattagacattctaaaggagttagtgttaattttagtaagtgtaataatggtctcatagttatataagaaatacctttattttttacatactgaaagagaagggtgaaaagtcatgatatttaggatttgtttttggaaagctcagcaaggaaaaaactagttaaagcaaatagggcaagatgtttgttgttaaatctaagcagtaggcctgtgggtttctattctattccctctatttttgtgtttgaaatttttttgtaatagagtttaaaataccattttctattctgtggggctaagaagtatagcagtcactgcaaatagggattccctttgacaaataatgactactatagcttttttaatttttatttatttttatttatttattttttgaaacagagtttcgctcttgttgcccaggctggagtgcagtggtgccgtatcacctcactgcaacctctgcctcccgggttcaagcgattcccctgcctcagcctcccaagtagctgggattacaggcgcctgccaccacgcctggctaacttttgtatttttagtagagacggagtttcaccatgttgccaggctggtctagaactcctgacctcgggtgatctgcccacctcagcctcccaaagtgctgggattataggcgtgaaccaccgcacccggccatagcttattattttttataaaaagtaattttcttgttttctgtgtgttgtgttttctaaattatatttctaatttatttatgattttaaattctagataatttcaactagtttaatgaacatttcttcccccattagattcatgtgttccttctacagcatctaacttgaggtcagtgtggtagtagagatttcagagtcagaacttcactgacagttgtgccccaacttcaccatttagtatccatatgaccgtccacaagttgcttaccctgaggagttttagtttcctcatctgaaaaatggagataataagcactgtgtagaatggtaggaattaaatgatactatacatgtaaaactcccagcacagtgcctgacataaaagtacgtaaataatgtaatagtaaaacaaccaaagatgtatttctgtcaaagcattgaaatcagtttcttgctctactactttccttgtcgtattctgcccagaattacgtatgttcatcaatgtcattctccccatgttacttaaaccttcatctgtcttataccagtaagtaatatagtttaaggttacctacctgaggatccagtgctctgcatttcgtattttcaaactatagatttgccagcaccagtattttttttcttgcttttttgccttctatttcaagaatgtttctattactgcttctctgtaggacagcagaactgcattgcactgggcatgctcagctggacatacagaaattgttgaatttttgttgcaacttggagtgccagtgaatgataaagacgatgtgagtactttgataaagttgagttgataaattcccagttatctttgtactccagactggtgtttactgaagcctgtgcattaagcttataaagaaaattgtaacctttatgactggaaagttacatcatggcccttgtgatcaagcatgagactcatggttgcattattttacaatgttatgtttgccactcatactctgtgatttaaggtaaacatacaggagaggctgaggtaggaggattgctccagcctagtagtttgaggctgcagtgagccattgtactctatcctgggtgacagactgagaccttgtctctaaaaataaaaaaacaaaaataaacatacagatcagggcttgttatggtgaaccctaaaagaccataaactctttctattatgttggattttttgttttttggtgaacatggcctgaataatgaggacctaaataacttttttgttacataaagagatttattctaatgatatggttatattaggattagatttgtgaagagtaagaatggaaccttttttgtaggcaaatatttttttgcctttgtaaagctccttgctaacccttcctaaatgttagcactaatccttgtgcctttttcccctggtatttctactacctacttcttttataggcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgaggtatggttccatcctaggctacttctgttgagttctaaacgtgtatacaaacacagatagatttctgcattgttttcttctttcttctccatctttccagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctgtaagtgacaagtagcagtcatttgtattctacctgacattagccttcttgcaataattcttatacatcatttctttttttattctgcttataaatgcaatacgtgttaatggcaaaaatgttaaattgcacaaaatataaagataaaaattgcctattatcttgccactcagaaataactactgatcacattcttgtgtatttcctcctggtcttttatattcaaatgtatatattttatacatacatattttttagcaaaattggggtcatactgtgtatgtagttttagctcttgttcttttcacctcatagtataagcatatattaaatatgtttaaaacctttttaatgggtatataaaattctgtatagatgtgccataatttaatcattcctctattactgtatatttaaacttttatgagtttttcactattataaataatggtacattgagccaggcataatggctcatgtctgtaatcccagcactttgtaaagccaaggcgggaggatcacttgaggccaggagttcaagaccagcctgggcaacacagcaagaccccccgtctctagaaaaaattaaaaacttagctaggcatggtggcatgcacctgtagtactaactactcgggaggttgaggtgggaggattgcttgaacccaggagctccaggttacagtgagctgtgatcacaccactgcactccagcctggggaacagagcaagaccttgtctctaaaatagttgaccaactttgtacagaaaacttttggccacatttctgatgattaccttcttatagactcctagaagtggaattgctgcgtcaacaaatacacacattttaagacttgctatatgttgccaaattgcttccagaggagttgtatcattttaccctcccaacagcagtgtaagagtgcctattaccccctcaccaacactaaattatccttttgttatgtgaaaatgatatttcatagaggtaatttatatttttattatcagtgaatttgaactttttttaatgtccataggtaattacatttcttatctaattgtaactttttgtgtccctttctctgtttccttttggggaattaatttattttcactgggttttaagtgctcttgatttggcatggtaaaatattaattttctgcaatgttagttgaaaatatttttcctagtttatcttttcattttgttcataatttcttttacataagagaagttttaaaatttctacgtagtcaagcccattcatctttcctcatgactagaaagctcttccttaccctgaaattagttaaatattcacccgtcttttattataggttattttaacgtttcattggttttgattgagggttagtgttattgttttgcatttaactcttaaaatccatctgtaattgaattatgtgtatgatctgaagctggcctttaccttgatatttttccacggtacttggccacttttcttctgtgttgaatggtgactttttcttgaaccagaagttctgtgagtcttctttttagtccagagtgaggttcagccttttccaatttgactttaagccaacttttaaaaagtattattttcttaactcttagtttttaaaatctttcctgcattctaagagaccctgtttagaaagacctgtatgccctacctcttttctccataaatagaaaggcaggatggcctagaggaaatctaggagtcagacaagatagagtactgggacgaacataggatttatgaatagctagatgatgttcacccaattcagactctaccacttactaacaatattaaatacttgtattaaacaatttataaaagttacttaatcttccttgaatcttaatttcctcatctgtaatataagggtaataattccttcctcactagattattgtgaggtttaagtaaagcaacatgtaaagtgcctcctaataccctcctggcaaactcttaagtgcatggcaaaagttgttaccctcttccactcagtctactgccaagacatgtcagcataggtaggaactttaacctctgtcaccatttcaactgtaaaatgatgataataatactttgctaacttataagatagatatatggactaaatgagataaaatcttttaaactgctttttcaaactttaagctgcacgaattactattaacagtttatgaactgaggcttttctaaattctaaccctgaattattacatgtagtgtttgaggtaaacaactacttatctctgtaaaatgagaaagttgttccttaggctagcatttagatcccttcttctattgtaagtagaaccagaattatgatttacgatctggtattacaaggctttttttgtagaattttaacttacagtctccctatgcaaactgatgtttctttcctgattaaataactttccaatgttaccatttcttaatcatatgcacttcagactacctagcaagaaatcctaaccattacatagaattggtagtgattaattggtctctggtggtccctgatttcagacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaccttatatccctctctgaaacagaacagctccaatagcaacaagctagttgttctgccagatgtttctatgtggattctgtaatgttcctccatacagttaaaacatcctaacttgtttttcaagctcactcaggcctacgccaaacgtttctgttttttttaaccatgaggtttaatttatttttgtgataggagggatatttacatattttagtggaccacattttaagttggatggtgtgctctaaaatactgaaaaacaatagcccatatacctatgtatttgtttttgatgggttgtttactctgaaataaaatgtatggttttcttaaaaggaagttttaaagtacctattttgtgtcatcctgtattgaaaagaatgtcaagcttgttaaaatgacatgtaacaaaaatgtattttgatttgtatttcagaaactaaaaaataaaatgttgaaagaatcttccaatttttctttcaaattagctagaattcacttaagccttagaatccttagtaaagacatttctcagtttttggtagctctaagtcaataaaattagtgaagcttgaattgtagctaaaatcttttaaaatagccatcttctgaattgctaattaaatgtagaacaaaaggaaattattaagtataaacttgagctccatttagggaagcatcttaactgatactagtcataaaatctaatgaactccaagtgactttcagattattttttatttgaattttatgctgcaaatactgctcgaaataagtgatccaagtgaacctacaaacttgcattaattttcggtcaaagtcttaatgatcagtagctaaaatgagtttcgtaaacacgaactgtgttactgatatagaaactttttacagaagtattgtgagtgctaaccttaacaatcagagaagcatcttatagaacaaaactctattgaatgctggagatagacttgatagcaggggaaataatatttctagtatttttagtgtgatcagagtaaagttttgtctgttacaactgaagacatttactcttcataaatattgagttaattgtctgaggtgataggtttcgtgggtgtaaaaggaaattcatccgagttcttcaataagcaatacagatggagctaagccacaggtaatttgtaggcttttggcattttaaatggcatgacttgttaatatttagatcacagatttgtataaaataaagatattagtggcctcggatattgatcagattgttacctgtgtctgtaggaaaggtgttagagatgaagctgattcaaggtcagcagattttacagtttcaaaacataatttggctgggcatggtcgctcatgcctgttatcccagcacattgggaggtcgaggcgggcagattacctgaggtcaggagttcaagaccagcctgcccaacatggcgaaaccccatctctactaaaaaaattagccgggtgtggtggtgggcgcctgtaatcccagctactcaggaggttgaggcacgaaaattgcttgaacccaggaggtggaggttgcagtgagccgagttggtgccactgcagtctagcctgggtgacagagcgacaattcatctcaaaatacataaataatttaatggtaaagcttaactgagaatatacgatggaagaaaaaggccaatgaaaatagtgaaaacatttacattcttaaatatgttatagagaattacaatttcactgaggttttgggaacttcaaagtaaatctgtgtttttcttcataatctttgacttaacatttaactgtatgacactagtgtttgattccccaatttctcagctgtaccaactacaatgaattccttagatggctgcgtctgctgctttctgctcccatattctgttacactacaaggcctccaaatcaatctgttggcaagtctgatagagtataaagattcttgactttgtggtttatggctccagcttcacagttctattgactgcctaaaattgaaagcagaaatttgtaatgtgaatttctctgggaagaggatttattgctttcatcaaattctcaaggacatctgtgattcccccaaaaggttaaaaatccctggttgagacaaaaaagaatactgaatcagttgtcaggagacctcatttctacaactatagttctactacagttttttaatttataagttttcacatctattctcactgtagtctttaagaaggcagaaatcatctccattttacagatgagaatatacccagagctagagaaacagccagtaccaaaatctagctttcctggattctaattcattttcttttctgcctcttcaaagacagtggaccaaatggaaggtattctggcattttgaaaataaccggttagttgaaacacctatcctggtgcttttctttaatttggctgtgacgtaataagaaatacat

SEQ ID NO: 13358 - DNA, 260247 bp, Human
gcctggcaaagtaacccgaagtaagaaagaggaggggagctcggggcagcaacagctcacccagggtgcatgcttgcggctcctccggagctgggtcccgggagactgctaagcggctccgcggcccgtgctcatctgggctctgctgatgcttggaggctgtttccttactcagaacagagtaggtggacgaagtggcccagtttggaagaaactaaacactgcttctagataagaagtgctccaaagggaaacaggctcagcggtgcccgttacaacttgcagcactcaggagatagttccatgcagcaggagaggaaagaatggaggggaaaggggcggggctgtctgctgtcaatcatcccccctaccttgggcagccggtagtctttctcactttcaggcacctttccacacaacagccctaagtatctccacagcttcacacacagccccttagagacctatacgctaagacctaagcaactgtgcatcatatactttcaactttactgttaggttacacataaagagacataggcatactattcccacataagacagatgggcccgaaagtgcccttgcacacatgcccaaatgcatacaacactgattcaaattgatagtacactaggctattgggaaggggagacagtttctggagttgtaaatccactctgagctaagcagaacctaaggatgagtgggccctcgtgaaatagatccaaaaccttgaaagactctaaagtggttaattctaggaagatagaaatgttgtgaagaattcttcatcaaattcttgaagattctccaaggagtccgcagaaagtattttctagttcttttgttactttaaaaaaaatctatatatcagaattatcaaaggaacattcaagtctttatatgggagatatcgattcagctgccatcaactctatttaaatatttccaattaagtgtttatattaattctaagaaacactgcactaaatttatttaattccctgccctaaatctttctgaaacacaactacaatgagagtcaataccttttacattagctcaatataggaggcattaattataggattcaatgcagctaaacagagatatagctgtattataataacataataccatagaataattaccaatacctgctgaatgctcccagatcttatacgtatataacacacataaagtattcacgcacatatacttattttcttacttgtttataagcatatactttatttattcccaatattttcacatcttctgcttgtatgtagaaactctctgttctgtgagcagctggaaggtaaagaagaccagcagcccagggagcaccgaccaaaatttgtttctaatgagtaacaataaaaagcacggcccctctgagatccatccgctaaaaaaatagtcccagtttagatctatttgtaattggctttggtacgcacaccaatgagattggaactgagcctagaaaagtagtatcaacggaaggtgcaaatgaacgaatagaaaagcttcccggttggactcatggtgctcagtcaactagtctggaagtttccctcccccaaataactgagcgtcactccctcgcaggttgccggtgcagtctaaaactgtggcggagtgatactcaaattcccttgtgctggtgaggaggggggccttgcacggggaagagagggaggaaagtagatctgtaggaattgagtgaagaaaaagtttgcaagtctggacagaagggaaaagttctcctgagagaccggctttggggaggggaggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggtaagtccttcctcccctcccccgcgcccatcaccgctctttcacgctgaaattaccttttttttggggggggggtccctttatcttccttttggcgttgactagggaattcaaatttgctttctcatgtttaggaagaaacgttatttgcaacaccggtaactcaagccttctgaagtccaacggagaggtttaagtgcttaaaaatagggctgcttgcttccctgcagctagctcctccgggggcaagagcaaagtcagaagtgggggacgctaattaaaggctcactaggctgtggtgggtatttaaaacttttcctcccctccctccaccgtcgggtgtttccctgcctggcgactaaccttttcactacttgtacccagcccactctttgaattttgtctgtagtttaatattttggctcttcgaaaatccagcttccatcaaagtgtttttagcgcctcagtgaagttcgtcccctttgctctttccttaagcaacaggaacctacccccacctcaggtcattcaagccactgacctccttttcccttttgacatccttgttacaaatgaaatgctaaggcaacataccaagaagagtgaggtaaagtctcaggcttcaggtcttttgcgtctttttgttgttgttgttttttctaaattatgggtttttttgtttgtttacttttttttaaacctaccaaggcatctgaacaaattgagaatttgcccatcacctattcaaaggaaaatactcctttttcaaaggagaatcagtgttccagtttaaaggaaagtgggggaggaggtacatgtgaaatagcagcaaaaagctccattcagttttaggaatgtagaattcaaacctcagtatatctcttagaagggtatctgggtagtcccacccactgtcctattggggatgagggccagatgttaaaaaaatgaatggctttgtgagagaaaatgttctccagcctgaagcccatcatctttaatttcatataacctctgaagaataagtgtgtgacaaattatttaaatttatttgagtgatcattatggatagttttaaaaactgtttaatatgagatcatggcttaggccttcacatggttgagtgaccgtcaattctttgtaagcagctgctatgttacagctcatctgggtccacttttaagttagctgtctagcttccctatagcacttagcatgcctcaaatcacatgtcctctttctatccttctgaaggtgtgtacccggtgtatgaaaactaactttcatattactctgagcacaacataattataatagcaaatttgctgaaaaaccatgcatatcaaatatttttactatgcatgccataattttcttccatcaaagtagacaaatgatttaaaaatgcttttttgatgcagagcatcttaatgggggtaaggtttagccagtcaatagggctacagacttggataaaactgcaattgtgctgttgaaaatagttcattttaaaaacatcttcttggtgccctctgtttctggcatttggcccagggacaaagattttgtagatgtttgattaaatatatatatgttttttgatgttacttttaacaaatttgcaccagatgacaactatacaggtatgtatagcaacactacacatcaattaatattaaatcaatttatgttaacaatgaggtttctttttattgacaaaacttgagagcaagcttgttttcttggattcttaaactaatgagtattcatgaagtcattacagctctttcccttttcctcctatataatttttaaagaacattttatatccccttttcctatcattaggatattgtgcctctattaaaaccaagggtttgtttttcctggttcatacataaatattttaataggctcaaaaatatgaatgatatcggctctgcatacttgtgctggagatatcggtgaccatttctagagtaaaactggttggtggtagggctagtctttgactggagtagtttagtattggggtttttatatcaaaaaagtgttgctatttaaagtgctttactcttttataggtaaatgatttctttatctctcaaatcatgccaaattggtacatcacaaatatgtggaagatcttttttttaggtagagcattcattaggtggaataaagtaacctctatgccaaaaggttagtaataagagaagacagttttaagttggaaatataatttttagtgatggaaataacatttttatgtgaaggtaattatacctgtactgattcactgtcagtgggatatgcacttagatttgtggatgtgggtagtatgtaaaattatgttagttttattttacatagttagtaagttgttttctgtgcagtagattggatatttttgtctactttaaacgtactatcttccttgtgaccagcggcacgaatttatcaagggtaggagtgttgtttgtagccatgaaacacttcatcctctatgaagtatattgctccataggaaaaacttgtcatcattgtcatcattattaatgtagataacataatgagtgtttactatgtgccaggcactgtgctaatatgataatacatattatcatatttaatcttcagaacagacttatgagacatataccgttattatcctcactttacagatgagaaaactacaaattacagacgttgaatacattcccagaaatccagtcatgtaggcagtaacttgtgaagctggaaaatttgaatccaggcagtttgactctagaatctttgcccttaatgactgtcctatactgcctactttgtatgtggtctatagagatttactggtgtgtaaagtatttggatctctgccactttttttggacacaggaggtgaaatggaaatgataatgggggttacatgtcttcctgctgatgttaggagaagcagcatggtgtaatggaaatagctttgggcctagaataaaaagatcagagtttgacctctgtatctgtatctagagtgagattatttaaaagcaatctaaaagcaaatgctgttgaaggttttatgattttatgtaatcacaatatgtaaacatttcaacttatataactactataatttgtgacagatgatttgttttgaaggaagatttgccttatgattatttaattactcagttactgcattaattttaagtccaccaaacttttcaggagcatgtctattgtgaaacaaccgggtatgtgtgtatggtaacacactttacttaacatgcttaatttagttttgttctttttttgtactaatttgcctacctatcatatccaattttattcacaaactatatagatatatatctttagtcttatgcatatatctatatatgtatctgtcccatggcagtgtaagagtttgtattttttcatgtgtttttatttaccttttgatgtctatacatgtaagacatgagactctttacatccctgaaagcttggttaagatggtgtctgctaggtttattcactataaagtcactattttttcttttgtaattacaaagtgagactatgcagggcaatattgtgagacaatgtaaatatcctgtttctcatcatatatttgcccactaattttagcatatgttgatgattctggcttgaataaattattgttgtgacatttgccagacattgatttcaattttcaacatttttacatttattaattgattgaattatactgtaataaaaaactttctctttacgcttaatgtatatatttattcagctgtttatagcagtatggacttaatgaatatttgttttattctataggttataatgaattatgctcttactactttttgtttttgctgaaacccagatttggccaacaggagccccttcaaattggctcctgtgtcctttcaacatgtctccatcattttttaagcaccctcttactttctggcaccacagatgttccagactcttttttttttctttttttttttgagatggagtcttgctctgtcacccaggctagagtgcagtggcgcgatgatctcggctcactgcaagctctgcctcccgggttcacaccattctcctgcctcagcctcccaagtagctgggactacaggtgccagccaccatgccgggctaattttttgcatttttagtagagacggggtttcaccatgttagccaggatggtctcgaactcctgacctcgtgatccacccgccttggcctcccaaagtgctgggattacaggcgtgagccaccgcacctggcctccagactcattttttaatttccttgccccaactctggaatcagaatcttttctccaaggagctctgattctttttattggagaatggtatgtagaagccaagatctgggtgcttggcatgcttattgctactgaggtgtcattgcctctaggccctctcagcaggcagaactaggaaatatatgtatatatgcacacatacctgtttctatatcgatttcttgaagtccctctttatatatgtcaaaatcatggattcataatgatacatctgattccagtccaagaccctagaataaatatacatgatctcattctcttctggtatttctcttcacacgttttgtggactttgtagaggtcttatacagagtcttcaagaggttggcctctgaagtcagacatggaatctgactggtagatgtgtaactttcagcaaaatagtaatctttgagacttaatttcctcattggcaaaaggaaggccgtagcacctatctcacatatttttttttttaggatgaaatgagaaaagttatgtaaaacatatagtatttgacaccatagtaaatgttaaatcaattttagatttcattattgtcattatatttattgacttaccatttcttactacatcaactctcaaatctcctgtctgattttcaaggcctatcatgatcttttcccttatccaaccttatttttcattacagtttataatatactccctccagtctagcctaggtaagctttcctacaatcccgtgagcactgcatacacattttggccctccatcttgattagaattttgtggattcaagtctttgctcaattccagcaaatgtttacatttattcagcagatatttattcagcaacttctaagtactcaaaaattctatttatgctgttctatttctattcatggaggtgtactgcctacaaaatcattttgtgctagacactatggctaaaaccaaataaagacaaggttcttcccttcatggtgtttacatactggtgagaatagctaaatagtcctgtgaaactttcccttattatagtatcaaatactgattgtacctttctttgaacatttgtaatatttagcctctcccagtttcgtatctgcatgtatttggtcttataggcattttgttttatgacattttatctgttctttttatttgattaaagtcccttttgaagcaataactatatatttgttcattcaaccaattcatatgttgattttatatggtaacaaaagtaacagctgctcaatgttggaaacttgaaaaacataaagaaaataaaaatatgtccacagttctaccagcaggccagaactgtgctggctgagcacagaataatggtgtgtgttttgattattgttgtttttactattttctttcctatatatataatatgtttttaaaaataaatttggcatagaacaatgacttgtaagagtacaatttttgaattgtaaatgatatgttaaggtttggatgtgaatcacgaaactctaagcacaattcatgtttcaattgctatggtaaagttttcatttcatgaagatactgaatttttaaaatactaaaaaacctgattaaataaacactagctaataactaaaaaaaaagttggttaaaataaaaaagtaagttgggcttattctacatatagttttatttcttactgtttgatcacttatcaagcagtttcccatgttaacattcttagttttaaaacgttattttaaaatgattacatacaacttgtatttatacacactccaatttatttacctgttcacttttgtagagtatattttaaaatgtcaagatttgttagccatcgtaagaagtgctgccatgaacatttcttattccatatttttattattttattgctacagccgccttcatggggaattagtgggttaaacgctataagtatttttcaagtctttgatacatacagtagaccctgatatttaaaaaggctatatcaacagagaaattatggtaacttttttagtggttactatgttatatcctgttaggtagctaatgttatttccacttttatatacaaggaatcagaagcccacattggttaaataacttgccaaaggtcgtgcagttgatacatgattgggccaagatttaaaccaaggctctagaacctgctcatgagattctcctcaatccctatttcatacatggtagataatagagaaaagtaaagtcatgatgaaaagttgaataattctcattgccctttctgtaaacccttctgtgactggtcacttaagatgattctgaagaaagactctccattggctcatcttttaataagtctttaccataactgcctaggccgttcatccttaagggcttaaattttaattttgtgcacaatatatcctcctacttttctcccctgggcagaaggtggagcttgccctccacaaatacctctcctactgatctcttcccagctataacagtggtataacatactcaaattcattgacattctccctcccccagaagagttttgtgcatatgcatctgaaatgagagccccttctgaccactttccccacccctctcaccagcccctgcactgtagctgtctttcaggcttacacttaaatggctgtgtctttacctagtattgtccctagctttcatctctcccttagtgatactcagaaacttcccttcattaattcttaatcttttttttccactttggggagataatatcacagcctcaattccctctttttagaaaattaaactggttagtacatacggaatgtgaggtcccccatccattttgtaccactcccaatttgtaacatactcactttaccttctcctcacatttcctcagtagccaaatgacatcattgcctgtttgccagccctatagcttgcgcaattgaaatttatttctctgcaaagtcacaaactgttatgcattgtggtttttccaggtggcatttgaatagctgaactttaagctcctgagtgatagggatctgctcttgccaaattactttccagaatggttttaccaattatactcctatcagtagtgtataagagtgcctgtgagacagacttaatttttctttcctatctactacagtgactatggaattgatgctcaattgattgccagttggttggctgatttggtcttagtctctaatgattttcttttacaaatgtaatcattccatcatctcatccccttgtgatgatagcagctacggaacagaagtaatttttgaaaatgtattctttctaattaacattataaatgaaccacccagacacttagctaaatctttattataaagatttgtttttaaatagcagtaattcttgaggattttagagaaacaccttcagtgtgatatgtgacacataggcttctttcattttaacaaaccagattctcattttatgcaacttgaacttatttacctccatagtctgtccaggtccacccacactttgtgcctttagcagcttctgctggcctttaaccaaaagggcagtctatgatggtacttgctaccctgttgaaatgggaaccttaaatcccttgcttttcattaattaaagacagtcaaaggcaaatgttataaaagaaacaggcttttgctaaatttaatttttaacttttttattttaatgaatctgttataaatgtcagatgcttactaacttgtagagaatgtaagtaccatttacaagcaagttctattctggttaatggaattgtgtttttgacagtaataaaataagacttcaagaaattctgttaaggaatttgtatcatgctataattcaatcaaataatatttttcctgtatataggagaactggctggtttgctttcaaaatttcttacagtgtatatgacattaattgagtactgaaagagatatggaactttgagaggggcagtggtattaggagtgggacatgactgatgaattatttagtatattctgtgtttacaagccctccaaaagcttgctaaaggaggactggtccttctctgtccatattctcacaatttaattgatgtagtaaaatgtttctgtatgtggaagatagtcatggtggtgtctgtttatattagataggttgtttttcttgcaagtgctaaaaaacactatctgtcttaaacaataaaaacaatttttagctcacataacaagaagtttggaggttgattatctccaaagttaattaattcagccaaataatgacactagtaagggccagagtttgttccatttttctgtactgccatactctgcctatcaacttgccctctaatattagtgcccctcatactctcaagatggctgctgcagttccaggaatcacatgcagacactgcaatgcccactagaaagagagtatgaactattcatgtgtatctctttttactagcaatggaaactttctaaggagtcccacagcaccaccctgaaaacacctcttatttatcattggttgaaattgtgttatatgtatatgcctacaccagtacattggcaagtggtatacggacataaacgtagagttagtccagtcactcacacaaccacctctccctgccctgcgtctggccaaaacacattgctacctagaaaagttggagggtggaaaatatgtaaataaactcatgatgttttggggggaaggaagaaacagtttctatttcacaacctcatgagtttgtcctcaggatcagttgatacaaaagatttgtaagaaactggtgtatttgttaaatgtgatatattacttatctagggaaacgaatgttttgtatagttctacaaatgaaagttgttgactgttcataggcattttagagctggagggacattagtgatcttttaggtcagtagttctcaaactgtggtctgtggacccctacggttcctgaaatcctattagagaacatgaggaatattttaacagtaatattatcttagtctgtttgggctgccataacaaaatacctcaggctgggtggcatataaacaacaaattatatctcattgttctgaaagctgagaagcctaagatcaaggcagatcaaacctaagattcagtgtctggtgagggccctctttctggttcacagatgttatggtctctctgtgacctcacatggtgaaaggggaaaggcgtttttttctctggagcgtcttttacaagggcactaatctcattcatgagggcttctccccgtgacataatcatctcccaaaggccccacctcctaatgccatcaccttgaagattataattttaaaacatatgaatttttttggaggggacataaacatgtatcatagcaaatacgaagaatgtttacttttctcactatgttgacatttgcactgatggtgagtaaaattactggtgcagtgtaccacattttcttagtagttgtattcgtcatactctcaggggggagaaagccagttttacctcagagggtcctcaatgtagcattaatttatattaattgaattttgacccttgagtgtatgtctttttaatattacatatgacaaaattggaagtatacacaaagcacttatgtacgctgaagtaagatagttgtttctaggaaaagcacttgtgcaattgtttgagttacgagctgaaccagttgatttttgcatggaacgcttttttgtttgttttagatacagggtcttgctgtgttgccccagctggtcttgaactcctggcctcaagaggtcctcctgcttcagccccccaaagagctgggattacaggcatgagccaccaagcccagccaaaattcatttttacttgaaaaacaactgagacaaactgtggttatttatacttgggtatttggcgggcattttcttgaaaatgagtagaattagcctaccacttcagggaaaactactggcagtatttgtggccaatgaaaaatttgagcttttcaagtaagaatgagaattttggaaaacttgaacctgacaccaagagtgtgacagcttcccaaatcttagacttttctaatgaagctggtaattatattaatgtgtattttttatattgtacaataaattgtgttaacatttggaagctctgcataggtcagtgaactaatgttttccaaatgactaatacacagtgttacaaaatcatgcatagggaaaagatcccttcaaagggcaagatagatcgagtttaatgtaattgaataaaaaaagctagtttttttatttttattttttatttttattttattattattatactttaagttttagggtacatgtgcacaatgtgcaggttagttacatacatgtgccatgctggtgtgctgcacccattaactcatcatttagcattaggtatatctcctaatgctatccctccccactccccccacccctcaacagtccccagagtgtgatgttccccttcctgtgtccatgtgttctcattgttcaattcccacctatgagtgagaacatgcggtgtttgattttttgtctttgcgatagtttactgagaatgatgatttccaatttcatccatgtccctacaaaggacaggaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgagtcaaatggtatttctagttctagaaccctgaggaatcgccacactgtcttctacaatggttgaactagtttacagtcccaccaacagtgtaaaagtgttcgtatttctccacatcctctccagcacctgctgttttctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgccgtgcagaaactctttagtttaattagatcccatttgtcaattttggcttttgttgccattgcttttggtgttttagacatgaagtccttgccaatgcctaggttttcttctagggtttttatggttttaggtctaacatttaagtctttaatccatcttgaattaatttttgtataaggtgtaaggaagggatccagtttcagctttctacatatagccagccagttttcccagcaccatttattaaatagggaatgctttccccattgcttgtttttctcaggtttgtgaaagatcagatagttgtagatttgtggcgttatttctgagggctctgttgtgttccattgatctatatctctgttttggtaccagtaccatgctgttttggtgactgtagccttgtagtatagtttgaagtcaggtagcatgatgcctccagctttgttcttttggcttaggattgacttggcgatgctggctcttttttggttccatatgaactttaaagtagttttttccaattctgtgaagaaagtcattggtagcttgatggggatggcattgaatctataaattgccttgggcagtatggccattttcacgatattgattcttcctacccatgagcatgacatgttcttccatttgtttgtatcctcttttatttcattgagcagtggtttgtagttctccttgaagaggtccttcacatcccttgtaagttggattcccaggtattttattctctttgaagcaattgtgaatgggagttccctcatgatttggctctctgtttgtctgttattggtgcataagaatgcttatgatttttgtacattgattttgtatcctgagactttgctgaagttgcttatcagcttaaggagattttgggctgagatgatggggttttctagatatacaatcatgtcatctgcaaacatggacagtttgacttcgtcttttcgtaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcctgaagggttgttgaattttgtcaaaggccttttctgcatctattgaggtaattatgtggtttttgtcattggttctgtttgtatgctggattacatttattgatttgcgtatattgaaccagccctgcatcccagggatgaaacccacttgatcatggtggataagcttaaaaaaagctagttgataaagtttcagattctacattacaactaaccttatcttaaaaggctattagaatgcacacttttccagctatataactattggaaaccagattttcttcatatattttaagtaaagcaatgtattccaacagaagaaatgcagaagcagataggaggattcagcttttgtcaaagcaaagaaatctacaaaaaaagtaaaataatctctcttcccactatttttttttgttttggaaaatataagtaattttcataaaaattcataatatatgttaacatttaatgggtttattgccacttgaaaatgaataaataattttaaatattactcagttttaatttttatatggtatatgttgatagatgtaatccagatgatggggtcttcaatactttttaagagagtaaaaaggtcttgaaaacaagaagtttgaaaactactgctataccgaggccaactccatcttttacatgaaagtgattaatgaaagatgataactagttatttagttgcagaggcagagatggaagctgtattttctgaatcttattctcgtcctctctccagtatactacattggtttagggattggtaaattgataatatgatgtggtaattttgttcatcgtggtagatacagttaaaataccaaacagaaaatgtagatactagattgtactcgtcttgcctaccattttcaatccaattgccaagtcagaaacattcttgctacacaaaccacagcagaagagacacacacaaaaaatagctaaagttgcagttacttttaggtactaaattggaaaattcatgaaaccagagttcttatcttacatatctttgtattcaccacagtgcatggactggtttcttctatatagttatctctcaggaaatagttgttgaatgaatgttgaatttggggaaggagtagatttatccggataacactaagaggcaaaacttagaatcaatgggttaagttacaggaaccctggatagcaataattttcttttttcttttcttttctgttttttgtttgttggtttgttttgtttttgttttgttttttgttttgaaggaatcttgctcttgtcgcccaggctggagtgcaatggcatgatctcagctcactgcaacctccccctcccaagttcaagtgattctcctgcctcagcctcctgagtagctgggattacaggcgcccgccaccacacccagctaattttttatttttagtagaggcagtgtttcaccacgttggccaggctggtctcaaactcctgacctcaggtgatccaccctcctcggcctcccaaagtgctgggattacagtcgtgagccaccatgcccagccagcaataattttctaacagttaattatttgctacttagtaatggaaatgtctcattagtaataggaatgttcctttactaaaaatgctcaaatagaaggtggatgctgctctgtctgccaacatacccatgaggtccctttggactctaagattctgttttttctggtaattagaaggaaaatactttcttactgagctcaagtctacttctatgattttatcgagacaaggtctcctgctgcctaggctggtctcaaactcctggactcaagggatcctccaacctcagcctcccaaagtgctgagattacaggtgtgagccaccacgcctggcctacttctatgattttaaagcaaattttaggtataattgacatacaataaaatgcatatatttgaagtgtacaatttgagttgtgacatatgtatacacctgcgaaaccatcacaacattcaagataatgaacatgtaaattgctccaaaagatttttattcctctttgtaatccctcccttcctacccccatcctccatccccaaataaccactgatctgctttctgtacagtagaaagtttcattttctagatttttatataaatgcaattatatgatatgtatacattctttgctctgacttatttcacttagcataattattttgagattcatccatgtcatggtgtgtgtccatagtttattattttattgcacagtagaattccattgtattgatacaccacactgttgatggacatttgggttgttttttgtttgtggctattaaagttgctatgggcattttcttgcactttaaaagtactaaattgagctataatttccataaagtgatacacagtgatcttaggtgaacagctcaattattacttaactcaattataacttaacaaagtgtataccaatcatatatactttggtaactaccaaccaagtgaagatgtagaacgtttccattaccttggaaaggtccctcatgcccgtcccatttcaatgtcttttgtgtcttgtctgaataagccacaaggttgtgaagatacatgttttcttccataatctgtatagcttcagattttgtatttatgtccatttttcttatatagatacccagttgttccagtattgtgtatttaaaagaaaaattcctttttttttcattgaattaccttgaggactttattgaaaatcaatggaatgtgtatatgcaggtgtaggttgaaactcactagtctgttctattcacctgtttgtgcatccttatgccagtatcacactgtattgattactgtggcattactttggtagcataagtcctttacatttcttcttattcaggattgtgttagcttttgtgttggctatttattccatataaattttacattaatcttgccaaattttgcttaaaaaccttttgaggttttgataggaattgtaacaattgtgtagatcaatttaggaacaactgaaatcttaaaattattatttttttcaatccatgaacaccatatacctctccattaatttaggtattctttaattagcttcatcatagaggtcatgcacatcatttgttaaatttcttcctatatgaataattctattctaaatggtatcatttttaaaattttatttttagttacttgttgctaagatgtagagatgtgattcatttatatattgatctgtttatccaaagataaaatgctaattaattttcttatggtatgatttacatactgtaaaattcacccactttatgcacagttctattatttttgacagatgtatacagtaatataaatatagtctctaatcaagatatagaacagcatttctaaatttattcattagttctagtagtcgtgtccatttctttggattttgtatgtatacaatcatatcatctgaaaataaagagggtcatagtttttcctttccattacctatgtctttttgtcctggctatcttattgcactggctaggacctccagtacaaatataatggaagtagtaaagaatgactttttttttgctgtcttttaaggaagatactcaatattttgctattatatcagctgtaggttttccataaactttacagatcgaggtggtcctttttcatttctatttgctgaaaatcttttttaaagtaatgaatgttaaatttcatcaaaaaataatttgtatctctttaaacaatcatattgtcaggagctcagccgagctgctaggtgtcagacaccaagccaaaatcaaaataatagtcaagcctttaatcacttagtgtgattatataaacaagaagctaaaccggagaaagtgctgaggactgtcctcacttcccagttacatttttccccatggtagattggaccagcacaggcttcgggggtctgtgttttctcactgacaagggagccccaaacaaaaggctctggcagtgttagggacccaggggtttgggggaggaagaaggaaaaggctaggtgtggaaaaatacctagtactgagtcagagtggaaagaagtgtcttcaacgtttgctcccacttcctctgctgtgaatatttgtaaacaagtctttgggtagacaaatgctttcattttccttggataaatatcaaggaatggaattgctgggttgtagcattagtctatttttagctttacaagaaactgccaaattgttttcctaagtggttgtaccattgtactttccactgaagtatgaaagttgtagttgttcctcgtcagaactgtgcataaaatgggtgaattttacagtatgttaatcataccgtaagaaaaataattagcattttatctttggataaacagatcaatatataaatgaatcacatctctacatcttagcaagtaattaaaaataaaatttttacctgcatttgatattgtcactctttttaattttagtcattttgatatcttagtattggtatgttcttgtcattttcttatagtcaccttttgtttatattgagtaaaattcgctatctttggtgtactgctctatgagttttgataaaagcatacaacctttaactactgccgtaatcaagactcagaatacttccataacctcaaaatgtttcctcatattgctatgtaattaacctctctacttacccacagtttctggcaatcactcatctattttctgttcctataattttaccttttttataaatgtcttatagattgactcatccagtatgtaaaattttgagtctagctttttcctcttagcataatacatttgagatccatccatgttatatgcatcagtagtccatttcttttttatttgttttcttataattgagtaggaagagctttttgtgcattctgcatataatatattcatttcatacatacatgccatgcggatatgctctgccatttggtggcttgcgtttttgttttcttacctataattttcagagaataaaagttgaattttgatatagtccattttatcacctttttatggttatagctttctgtcccctttataagaaatctttgacttccccaaggtcaccaagattttctttcatatttgcttctaaatgattttatagtttttgcttttgatccatttacttatttttgtgtggtgtttggtaagagttctggttcagtttttatcccatgtgtttagttccagcaccatttgttgaacagactatcccttccccattaaattaccttgatacttttgttttgtaggtctgttttgtattctagtctgtttcaccaatctctatgtctatccttatgccaataccacaatgtcttcactactgtacttttatgataaggtctgaaatcaggtaatgtaagttctccaaatttgttcttttcatattttggggtctcctcttcgcccccgcctccttctttgaatttctatataaattttacagttaccttggcaatttgtacaagtaaaactcctggagttttgaatgggattgtatttaatctataggtcatttttgggaaaaatgatgtcttaacagtattcagtgttctgataagtgaacatggtgtatctttccgtttattaagatcatctttggccgggtgcggtggctcacgcctgtaatccgagcactttgagaggccgaggcgggtggatcacgaggtcaggagatagagaccatcctggctaacacggtgaaaccccacctctactaaaaatacaaaaaattagttgggcgtggtggcgggcgcctgtagtcccagctactggggaggctgaggcaggagaatggcgtgaacccgggaggcggagcttgcagtgagcccagatcgcgccactgcactccagcctgggtgacagcgagactccgtctcaaaaaaaaaaaaaaatcatctttaatttctctcagcaatgttttcagtgtgcaggtcttatatgtactttattgaactcatcccctaagtattcatgtatttgaattgtactataaatggtatcgtgttttattttctttcaattgtttgttgttggtatatagaaatacaactgatttttttttctattgacctgtacactgtggtcttgctaaattgattatttttagtagctctttcatggattatttataattaactacatacatgattatgtcttctgtgaattaagatagatttgcttctttctttctagtcttcacactcctttttttccccttattgtactaattagggcctgtaggataacgtttaatgtaagtattaagaccccagttctttgctgccttttcccaatgtttgaaaacatatgcttcacacattttgtacagtttcctagttgtttgtagcaagagggcaagtctagtagcaatcattccaacaaaatctgctttcagttttttgatatttataaataacaatgatgtgaacatttttgaacgtatttgcacttcagattatttcctttgaacagagttctaaaactatatattgtaatctatatacatatatctgtatctatctctctgcctgcatatttaaacctacagtataagagctacctcaagagcagtgactatatttcaaatttatataccttgcatcatctagcagacagcctttcattggattaatggaaagtaaaatctttatgattaattttctcatacccagagtatctatttaactatagcatagagatatttctaatcttgcctgtgaagtctaaaaagactgtgatcattaccatagttttaatttactattactttattttgcttcattttaactgtcttatttctctttgataatgttgtaggaaacaagaaatatgtaggtcttaactttggccactgttaaaaattttttttaaaaaaatataatttggtttattttgagaaagggaagacatttttcctaactttcctacattttgtgttaactttgtaggatgttgtttgagcaatgaccctgtaggacgtggccttacacattttgagttcatttgagttaatttagtttcaggaaggcttctgaaataggaagcatttattcaagctttagtattccttctgaatagttttgctagctagctataaacaggccaatttgccctagctctaagtttatgttaattttcattactttgtttcaaaataaaagggccaattcccgttacattttgatttaaaaaattaagctatacatttttcttagatgtgggtatgttaaagcttttcaatgtctggcaaaattaatcaccctaggccgtggatttccttgcccccaactccctccaccccctaaagatacttgataatatgttggaaggagagaaataatagcttttttcttccagttcttatggtcaggtgagttcctagggtttttgtttgtttgtttgttttgagacagagtttcgctcttgttgcccaggctggagtgaaatggtgcggtcttggcacactgcaacctctgcctcccggattcaagcaattctcctgcctcagcctcctgagtagatgggattacagatgcctgccaccacgcctggcaaatttttttttttttttttttttttttttttttagtagagatgcgatttcaccatgttggccaggctggtctcgaactcctgacctcaagtaatccgcctgcctcggcctcccaaagtgctgggattataggagtgagccaccacgtttggctgagttcctagggtttaaatgttttaaaatatttttattcatagtatactcaagttataggaatttggttaatagtgaataaattcattcttagcaccagcctctctcaattctatttgcttgcttatcttttacagcctatttagacatatcatttttctccacagttgcagtaaagacttctttctgttatagcgcaagcttattagaccttatcacagccttcatgccttcatttgtgtatactatataatgggaaaaaaaagactaatgttgtaaattaacaagtgagatcaaactgaaaaaggtcacctttcttagaggctgaaaaagagattcattttctggggcctggatttgtttttctgactaattttactgccacttttgaatttgcagattgacaacctttatactaaaaatatttatctgtatcctagtagatttccaaatccatattctcagttttctctactccatgatatgcagatatggaaaaggaggcattttttttcccctcagatggttaatgttataatttgaaattggtaatatgctaataaacaaaggtaggttcaaaatcagatctttctgatttccatgaggcattgtaaatattatattacttaggatttgttttaaaatcaggttccaatttaagttggaaaaaactgaaaatgtttagaggtaacagtgattaaattatttcagattattatatttttcttagttttccctacatgtctacttcttcatctgttgttttactttatggtacttaaacattctataaagttttttgtttttttttgagttggagtttcgctcttgtcatccaggctggatggcatgatctcggctcactggaacctcacctcccgggttcaagccgttctcctgcctcagcctcccaagtagctgggattacaggcatgcgccactacccccggctaattttttgtatctttagtagagacaggttttcaccatgttggctaggctggtctcgaactcctgaactcaggtgatccgcctgccttggcctccaaaagtgctgggattacaggagtgggccaccacacccagcctctataaagatttgtagtgcgtttaaacattaatagaatgaaaaagtattataaaaggcaagaatatagacataggttctcattaaatcacaattaatggaaatgtatactcatagcaaaattaattatgctctttttgggtagaatattctggagcctaaagtttcatctccttttcataccactgtccttaaaaatgcaacattagcttaaacatgaatttgtttatattaacataaaacttctctataataaatgtttattcaaaattgaaggaggaaaaaagatttagagtaagatacatactaatattaaatactagtgctgagattatgagtcattttttcttatatgtattttctgttacctacagagaaatagtaatagtaaatgcctattactattacaataaaatgattttaaaatatttaatattagtttaacatatatttcaacagttttttgatttaaataatttaacaacatattttacagtcatagggttattttattttatttttgtttgtttcttttttcagacaggatctcactctatcacccaggctggagtgcagtggtatgatcatggctcactgcagccttaaccttcagggctgaatcaatccttccacttcagcctcctatgtagctgggattacaagtgcacgaccccatgccccgctaatttttgcagagacagggtctcactatgtttcccaggctggtctctactactgggcttaagtgatccactggccttggcctcccaaagtgctgggattacaggcctgagccattgcgtcccttcctatcctccctctcttgtaataaatgttttaggtagtttttaaagttttcttttacttggctttcttaaaggagaacttcagttgcttttttccagtaaaaaattccagagactgccagaagaagcctaatgccagtaataattctgtcattgaacataatggagaggagtcatcttaatttgtatgcactcttttttatatcaagtgtaacacatattcttcttgtccttccctccaagtgggttacaaacagcttttctctttcactttaccaacattaaaaagagtgattttaagaatgctggatccacctttttccacttatatttggaatgaaatgtgtaatttatgtatgaaacctttaattttaatttaaggtctcgtgaaagcaccaaaactctttagataaattgacacggagttgctttaagatacaaattccttcttagtaaaaaaaaggaagaattttaaaactttatgttttaattgtttctagttgaattcagaatattaaagctttgttatatatgtggtaactctctaataaatacttcaagaaagtatctcagtatttaattaattatgagtactataatttattctaaagccttaataaaatcaaatttctattagtttatgcttttctcaatgttcattgaaaatattgagtcatattacctattactgccccaatccccagcccagcttgtaactttcctgaggaggaaaattgagtaaacctcagtgattatttgacagttgactccatagctaagctggaagacagggtgttgtgggagggagataacgcttttagggttttactgaagaaaggatgtagattttctgattctgttttgaagatgatataggtggatgctgctgggagaaatgacagtggcatcccattaggcctgtcgtgcccatccccttttaggattctgcatatctcttagtttttcctttgtcaggtaacaaaggtgtaacatgggagatatattccacttctccacattgttagcttagtgtagtactctatccagcaaattattggaaagagcaggatttggaagttagactagattttattgcttgggtagagagagaatgctcaagagagcttatcctggacaccagaggatgagcaattggaaagatggactgctttatcatttttgtgttattttgcaatagatagggcagattcccctctttttattgcagtacaaaatccctttaatagctagctctaacgttactatggcactatagtgtaatggtttagtttagagtatgggcatggatgtcagactcgacttgtatcgagactcttccacctaccaattgggctaacattattagtctaaagtgtcttaatgcctggcgtagagtaagtgttcaataaataattttccacaggatctatagtgtcctcttccaatataatttagttcaatcttaagcctaatagtttgttttccttcctgatcccctttcttcatctctagcattttaccataggagggaaagatgtcttagaaacacttttttagtttatttctagaggtattggctagacttcatgtcagttatatgcatataccaatattttatatattaaaaacaaatataatccctagaatagcattgtctgattagagataaaatggtctcaaaagaggacaggaaaatagggaagtgggagtagtagtaaagagaaatgtaaaccaatgtgtaaacaagaaagcaggtttatctgcaactatagggaagaactgttcaaattaccttgcacatttttatttcttaggaggcttcttaagattttaaattaagttattaaactatttattgggttgaattaaatatttagataaatgcagtatatagatatgtctgtctgtatgcatatatgttaaatacacctaagtttcttatactttaactaattttgggattccttctcacccaaaagaaatttaaataaatactttggatatttctgtaaatacagcatgccatttagcaaatttaagggaacaagtgaataacttagctatgccaacaatgttttgcctccgcattccttggcgcaaacagggacctcagtgaagcgttcctcatgggagttgcctggggaaatcttactgaagaagtctaggtcccaattcaggctcctttcccttctactttctaaaatatcaactttattgaggtatagtttacatacaataaaatgtactagttttaagtgtacaatttaatgattgacaaatgtgcacacccacaacattttcaatattgagcagtttcatcaccccaaaaagttccgtttgtttttcttcccagtaaatctttccctatccctgtaccctgaaagccactgacctgctgtcactatgaatatttgtgtacaagtcattttgtacacataattttcatttctcttgggtgagtgcaaaggaatagaattgctgggctgcataaatatgtaatgtattgaaccttacaagaaacaaatatgtttgcaaaataataggaatattttacattctcaccagcagtttataagacttttttaattatagctatcctggtgggtatgaagtggtatcttgttgttttaatttgctttttctgatgttgagcatattttcatgtggttattggccattcaaatatcttcttttgtgatgcatattctcaaatctttgcccatttttttcaaaagttggattacttgccttcttataattgtaagagttctttatttgtcatgtttacataaatatacacacacgtatattatacacacacctagtatttttcccattctgtgggtcgtattttctttttcttaatggtatattttaattagcagaattcaaaaattttatgaagcgcagcttatcatttttttctttgatctttattgccctttgcattataaggaagaatcctttaactattaatacactaaagttttaaattttgcctgctttcttctagatatttggtgcttttaacttttgataaacttagtgttattttggtgtgcagtgtgagttaagggtcctggtttaatttttaaaaaaattatcaaggtgaaatttacataacataaaattagtcatttaaaagtgaacaatttagtgacatttcgtatattcatcatgttatgtgaccacttctacctagtactaaaaatttggtttctctcactccaccttgtccctggaaaccatcaatctgcattctgtctctgtggatttacctattctggatatttcatataaatgaaataatacattatgtgacattttgtgtttgacttatttcacttagtattttcaaagttcaacttcattgtacatcatccctttttatggctgaataattttgcattgtatggatataccacattttgcttattcgttcatccattgttggacatctgggctattaccactttttatctattgtgatgagtgctgctatgaacatgtatatatatatgtatttgtttgagtacttgtttttaatatttaagggtgtatccttaggtgtggtattatgggccatatggtaattctatatttacgttttaaggaaccaccagactattttccttggcggtttaaacattttacttcgccaccagcaaggtatcagcatttcaagttctccacaatcttatcaacacttgttatttttgttttgtttattttaagttttaattttttaattatggccatcctagtttgttatggagtggttcttcattgtggttttgatttgcattttccgaatgcctgatgatactaagcatttttcaagtgcttgttggcaatttgtatatcttctttggagaaatatctattcaagtcctttgaccatcagtatttttttttttagacttaaggtcttgctctgttgcccaggctggagtgcagtggtgtaatcatgcctcactgcagcctttaactcctgggctcaagtgatcttcccatctcagcctcctgagtagctgggcctgcaggcaggtggcaccacatggccaaggtggctttttttttttcttttagaaatggggtcttgctatgttgcccaggttggtctttcttgcctctgcctcccaagcagctgggattccagccctattttcaagttgggccgtttatctttttgttgttgaattgtaagagttatttatacattctgaatactagacaaatacataatttgcaagtattttctcctattctgtaggttgtttttttcacttttgtgataatgtgctttaatgcagaaacattttaaaatttcatgaaatccaatttgttttttttcctttcttgcttatgcttttggcgtcatatctaagaatccattgccaaatccaaagccatgaagagttatctctatgttttattatacaagttgtgtggttttagctcttatgtttaggttgttgattcattttgaaatagtttttgtaaatggcatagaggtccaactttattcttttaaatgtggatatacagttgtcccagctgttattttctcattgactagtctaggcacccttatcaaaaatcaatttaccattgatgtatgggcttatttctagactctccgttctatctcaatggctatgtttatctttatgccagtaccacactgttttgcttactgcagctatgtagtaaggtttgaaatcagaaagtgtgtgtcttccagctttcttttactttttccagattgttttggttcttagggccccttgcaattccatatgaatttgaagattgactttactattactctttctgcataaaaggctgttcaatagggatttcattgaatctgtagattgctttgggtagtattgccatcttaataatattaagtcttccaatccaggaacacaagatgccattcattcatttaggttttctttaatttctttcctcattgttttctagttttctgtgtacatgttttttacctccttggccaaatttattcctaggtgtgttttattcttttggatgttattgtaaatggaattattttcttaatttcctttgtagattgttcatttgggctctatagaaataaaactaattttgtgttttgattttgtaccctagaactttgctgaatttattagctttagtagtttatttgtggattctttaaggctttctgtatacaggttgagtatctcttatctgaaatgcctaggaccaaaagtgtttcagattttggagtttttcaggttttggaatgtttgcatatacataatgagatatcttggggatgggacccaggtttcaatatgaaattcgtttatgttttatatacatcttatacacatagcctcaaggtaattttatactatattttaaataattttatgcatgaaccaaagtttagactgcgtttttactgtgacccatcacatgaaatcaggtgtggaatttcccacttgtggcatcttgttggcggcactcataatgacttgaattttggagcattttggattttggattttcaggttaggaatgctcaacctgtatgaaaaaaatatatctgcaaagagagatagctttgtttcttcctttccaatttggttgtcttttatgtctttttctagcctaattacttagctaaaacttccagtactatgttgaatggaattggtgaaaccaagcatccttagtttgttcctgatcttataggaaaacagtttttcacctttgagcattcagttagatgtgggtttttcgtaagtgtttttttttttttttatcatgctgagactgctcctttacattcctggatttgagtgtatttattaggaaagggtgttggattttgtcagatttttttttttatcattgagatgatccaaatgttttttcctattggttctattaatgtggcatattgcatcagtgggttttcttgtattgaaccacattgcattcctgggataattctcatttggtcatggtttataattcttttagcatgctgttggatgtggtttgctagcatctgttgagggttttttttttgcctctatttttacagggactattaatctataattttattttctttagcatctttggctttcatatcagaataaaactatatttatagaatgagttaggtagtgctattctgctttttggaagagtgcgagagtaattggtgttgttttctttaaatttttggtagaattcactagtgaagctatctagctatggactttacttcgttgttaggtttttgattattgagtcaatgtctttacttgttatgaatcttttcagattttctattttttcttgagttagtttaggtaatttgtatgtttctagaaatttgcccatttcatctaggttgcctaatttactggtgtatgatttttcatagtattttctctctctctctcttttttttttttttttttgaaacgggatcttgctctgtcacctaggctagtctcaaactcctgagctcaaaggatcctccttcctcagtctcccgagtagctgggactacaggcacctgtcactgtgcctggctaattttttaatttttattttttgcagagatggggtcttgctttgttgcccaggctggtctcaaactcctgggctcaagtgatcctcctgcctcggtcttccaaagtgctgggattacagggatgagtcatcatgcctggctcatagtattttcttataattctttttatatctgtaaggttagtagtaatgtcttcattttcattttttatttcagttatttgtatcttctccctttattttttagtttagctaaagatttgtcaattttcttggtcttttcagagcactaacctttgttattttattttattttcaagttttctttttgctttaaagctataatagtaaacaacataatttgcacatatattcaggctcattttcaaattttattttcatttcaaagggcacatgtgcaggtttgttacatgggtaaattgtgtgtaactgaggtttgatgtatgaatgatcccattacccaggctacctcctctagtagtccccagtgtttattgcccctctctttgtgtctgtgtgtactcattgtttagctcccacttataagtgagaacacgtggtatccggttttctcttcctgcattatttcacttaggataatggcctccagctgcatccatattgctgcaaaagactcgatttcactcatttttatggctgtgtagtgttccatggtgtatatgtaccacatattctctatccaattcaccatcgatgggaatctaggttgattccatgtctttgctattgtgaatggtactgcagtgaacaaagacatatatgaaagtgcatgtttttggtataatgatttcttttttggggggtatatacccagtaatgggattgctgggccaagtggtagtcatgttttaagttctttgagaaatctccaaactgcttttcacagtggctgaactaacatacatttacaccaacggtgtacaagcattcccttttctctgcagtctcaccagcatctgttttttgttttgttttgctttttaataatagccattctgactggtctaagatggtatatcattgtggttttgatttgtatttctctaatgattagtgatgttgagcattttttcatatatttgttgcttgcatgtatgacatcttttgagaagtgtctgttcatgtcctttgcccatttttaaatggagttatttgtcttttgcttgttgaattaagttatttgtagattctggatactatacttttgttagatgcatagtctgttaatattttctcccattttgtaggttgtttgtttactgtgttgatagtttcttttgctgtgcagaagctctttagtttaatgaggtcccacttgtcaatttttgtttttgttgccattgcgtttggggatttagtcataaattatttcccaaggctaatgtccaggatggtggttcctaggttttcttctaggattcttatagtttgatgtgctacatttaagtctttaatccatcttgagttaattttcatatatggtgagaggtagggattgagtttcatttttcttcatatggctagtcagttatcacagcaccatttattgaatagagagtcattttcccattacttgttattgctgagtttgtcgaagatcagatggctgtaggtgaaaggctttatttctgggttctttaccctgttccattaatctatgtgtctgtttttgtaccagtaccatgctgttttggttgctgtatccttgtagtgtagtttgaagtcaggtaacgtgaggcctccagctttgttcttttggcttaggattgctttggctatttgggctcttttttggttccatatgaatgtataaatagtctttttctaattctgtgaaaaatgacattgatagtttgataggaatagttttgaatctgtagattgttttgggcagtatggccattttaacgatattgattcttctcatctgtaagcctggaatgtttttccatttgtttctatcatctatgatttacttctgcaatgttttgtagttcttcttgtagagatatttcacctccttggttaggtatattcctacatattttttggtgactattgataatgagattgctttcttgatttggctctcagcttgaaccttaccagtatatagaagtggcaatcatttttgtaccatgattttgtaacctgaaactttactgaactcgtttgtcagctctaggagccttttggtggagtcaatagggttttctaagtaaagaatcatagcatcagtgaagggagataatttgacttcttttacaatttggatgccttttatttgtttgtgctgcctgattgctctgcctaggacttcagtactatgtcgaaaaggagtggtgagaatgggcatttttatcttgctctggttcttaagtagaatactttcagcttttgcccttgcggtatgaacttggatgggggttaaagaaccaacttttggtttcattgattgtctcgattgtttttatattttctatattgcttatctccactctaatctttcataatttcctttcttttgctagctttgggtttagtttgctcttccttttctagtttcagaaggtataaatataggtcatttatttgagctctttctcatcttttaatgtaagcatcgactactataaattttcctcgttacaatttccttcactacatcccataatttttagtatgttgtatttttattttcattcttctcttaagtattttctaattagttttgtaatttcttctttgacctattggttgtttaagggctacattatttaatttgtacatatttgtgaaatttccagctttcttctttttattgatttgtagtttaattccattgtgattggagattacattttgtatgacttcagtttttgatattttttcagacttattttgtggccttacatatgttgtgtcttagagaatgttacatatgcacttgggaggaatgtgtattttactgttgtgtattctatatatgtctagaaataggcttatgatgttgttcaagacttctgtttccttattggtcttctgtgtagatgttcaatccattattgaaaattgattttcgaagtatccaacaatcattatagaactgtctatttcttttttaaattctgtcaagatttgcttcctatatttagaggctcagttacttggtgtgtatatgtttataattgttatatgttgacgaatttacacttttcaataaataatattgttgtcttttgtaacaggggtgacttaaagcctaatttgttggatattattataatcagccaccccagctctcttttggtcattattttcctgggatatctttttttctttcttgaaatttcagcccatttgcatctttgaatctaaggtgaacctcttgttgaaagaatcccttcagaatgctaatttcatttcctttgggaatatacctagtagtgggattgccagatcttatggtaataacacttttagttttttgaggaaccgccatactgttttccaaaatggctgtactaatttgcagtaccaccaacagtatataagggctcccttttctccacatcctcgctaacattcatcttttagctttttgataacagccagtctaacaggtgtggggtgttattgtggttttgatttgcatttctctggtgattaaagatgttggacatttttttgtgtatctgttgaccatttgtatgtcttcttttgctaaatgtctattcaagtctttagaacatacattcctcacatgtttgtggtgatgctggtttaaaccaattgcagtgctagtcatataaaagtatagtacatacaattatttatagtatgtaatataataagtcactatgttactggtttatgtgtttaccatactacactcttaccattattttgttatcactacttcataagtagaaggagtgtattccttcttctcataacacaaaaaagttaactgtaaaatagcctcagtcaggtacttcagaaggtatttgagaggaaagtattgttatcataggaggtgacagctccatgcatgttattgcccccaaagaccttccagtgggacaagatgtggaggtagaagacagtgatattgatgattctgaccctgtgtacgcctagactaatacgtgtgcttgtgtcttagtttttaacaaaaagttttaaaagttaaacaataaatacagtattttaacaatagaaaaaaggttatagaataaggatataaagttttatatatatatatatatgtatatatatatatatatatatttttttttttttgagatgaagtcttgctctccagtagcccaggctggagtgcagtggtgcaatctcggttcactgcaacctctgcctcccaagttcaagcgattctcctgcctcagcctcccaagtagctgggatcacaggcacctgccatcacgcctgggtaatttttgtatttttagtagagatgggattttaccatgttggccaggctggtctcaaactcctgacctcaagtgatctgcctgcctctgcctcccaaagtgctgggattacaggtgtgagccactgtgcgctgccaataaaatatttttgtacagctgtacaatatatctgtgttttcagctaagtgttattacaaaagtatcagaaagctaaaacaattctaaaaagtttataaagacagtcaaagtaagctaaggttaatttattattgaaggaagaaattttttatgaatttaatgtagcctaagtgtacagggtttacagagtctatagtaatatgcagcaatatcctagttcttcatgttcacatactacccactcaactggttcaaccagaacaacttcaagccttgcaatgtccattcatggtaagtgccctatacaggtgtaccatttttaatcttttatatcatttttaaaatcttttatatcatattttatatttcatatcatattttactgtaccttttctatatttagatatttctagatacatacttaccattgtgttacagttgcctacaatatttagtacagtaacatgctgtacagatttatagcctagaagcaatagattatactatgtagcgtaggaatatagtagactataccatttaggtttgtgcaggtacactctatgatgtttgcacaatgatgaaattgcctaacaatgcatttctcagaacatatccccattattaagtgatgcatgactgtaattgtttcctttgctttgtagatttttagtttgatgcaataccatttgtttatttttccttttattgcttgtgcttttggggtcatatacaagaaattgctgcccagaacaatgtcatggagctttccccctatgttttattctagtaattttatagtttcagatcttacatttaatccatttggggttgatttttctataagggatgagataagagttcattttctttcttctttatgtggatatccagttttctcaacgtcatttattaaagagactgtcctttctccaatttgtgtttttggtgcctttgtcaaaaatcaactgactgtagatgtatgggtttatttctgggctctctatcttattccattggttgatatgtctgtttttattccagtaccatgttgttttgattactgtagctttgttatatatattgacatctggtagtgtgacacctcctgctttgctccttttggtcaagatcgttttgactatttggggtcttttgtggttttatattaattttattattgttttttgtatttctgtgaagaatagcattttaattttgatagggatggcattgaatctgtggatcgctttgagtctttgtatacatgtttatggtatatttagttttttaggcctttaagaacttattttagcaatgttttatacatttcagtgtacctgttttattatttcttgtagtagtagtagtattagtagtagtattcgtagctttttgtagatttttcaagatttttaatatgcacaattatggtgtctttgaaaagagacagtcttacttctccctttcttccctatatgcttgttatttgttttccgtgccttgttaaactagctaggacctccaatataatattcaaaagaagcagtgagagcaaagcagtgagatcagacatcctcaacttgcttctattattagtgggaaggcattcagtctgttaccattaaatgtgatattatctcagtggttctcaatgagtgggggatcttcacccaccagaggacagttggcaatgtctggagacattctttgttgtcacaactgggggctgttattggttttttaatgagtagaagctcaccagagcccctcttccaggcctagagccccttcatgttttactaactctggcaccaaaactcaattgatcgcaaaaactgatgggaacgtatatgaaactacttatagtcttgatccaaccttaggatattcataagttttactgctaaatattaatttgttcaattacaaaatgttatgtaacttgtacagtatataaacctctctaaattctgattttcaaacagtatatagacataaggatttcaggatttcatttaagggtctatagagatgctgccaaacatcctacaattcacaggacacccactcacccagactctgcaacaagaaatcatctagcccaaaacgtccatagtgttgctgtggagaaactatgtactacctgtaggttttaagggatatcctttaccagattgaagaagctatctcttagtctgctaagagttttcatcagaaatggctatgaaatttatgtcagatggtttttcttctaattgtatacgcctttatactcatgtattctatgaatataaaaaataccttgatttatttattttaaatttttaattaaaaaagtttttgattttaatttttatgggtacatagtaggtatatttatgggatatgtgagatgttttgatacagacacacaatgcgtaataatgacatcatgtaaaatggggtatccgtcccctcaagcatttattctttgtgttacaaacaatccagttatactctcttagttattttatatgtacaattaaattattattgactatagtcatcctgttgtggtatcaaatactaggcattttctaactgttcttttttttttttttttttttttttacctattaaccatccccacctcctccctaccacaacctcactacccttcccagcctctggtaaccatccttctactctctatctccatgagttcaattgttttgatttttaggtccccaaaataagtgagaacatgcagtttgtctttctgtgcctgacttatttcacttaacataatgacttctagttccatccaccttgttgcaaatgacaagatctcattccttttatggctgaatagtactccattgtgtatatataccacattttctttatctattcatctgttgatggacacatggttgcttccaaatcttggctcttgtgaatagcgctacaaccaacatgggagtgaagatatctctttgatctacttatttcctttattttgtatattgcattagttggggttctcttagagggacagaacgaataggacaggaagcatacagcatgggagaaagatgtaggctgggaggctaggcccatctctcattttcatgtttttctgcctgctttatattcgctggcagctaattagattgtgcccaccagattaagggtggatctgccttccccagcccactgactcaaatgttaatctcttttggtgacaccctcagagacacgcctaggagcaatgctttgtatccttcagtcgaatcaagttgacaactcagttttaaccatcacaagtccaccccttgtcaacttgaacccatacacatctcctgggatcatacataatcttcaaataaagacaataataaggtcataattacgcctaacataatacagctatccttcatacaaccagaaacacaacaatccccaacccaaatactattacataaagttaacatacttaaatgctgatatgaagtcaataaatcgtacatcacatgataaaggagaaaggaaataaaatgaagatattagtacaagtgtgtacatgcacaaacatgtttttaacaaaagaaagaggaaaggccgggcgcggtggctcatgcctgtaatcccagcactttgggaggccgaggtgggtggatcacctgaggtcgggagttcgagaccagcctggccaacgtggagaaaaaccctgtctctactaaaaatataaaaatgagccgggtgtggtggtgcatgcctgtaaccccagctatttggaaagctgaggcaggagaatggcttgaacctgggaggcagaggttgcagtgagctgagatcgcgccactgcactccagcctgggcaacagagagagactttgtctcaaaaaaaaaaaaaaaaaaaagaagaaggagaaatactcatgacaattagtccccatttctgtagctggtcacatggttgtagctaatattgatgattaccttgttctactacctattctgtattccctttgccttcagcaagcagcttagcaggtcgtggttttttttcctggtggagtgacccaaaccttccttcctgaagggtctgggccatttgtagtcctatctggattgcattgttgtagtttcccattgaccttaatcacagagatggtaataccctaatggatctcctgtattccatgcatactctttcttacctccgttatggagtagtacactgaattcatcttgatagtatgggtcagtcaccccagccaacactgtaactcccttcttagcttgttgacttaaaggtaggaggggcccaaagtgtccaggtggcaatcttgacttacggtttaatggaattgttgttgtgtctcctggtggcagctttcctccctctggaactaagacctctaggccagtagaacgtaatgttgtgggaacaggaagcaaaaattttgctagtggatcactaggggtgatggtgagtgctgccacttccacttccaccccttgattcctggacctgtgaatcctggctatggagaaagagtaccatatattggatgctgattcagatcacacacagccttctggagaactttgcctcagctctgcaatgtattgtcacctagttggcattgtatttgtgacttcaaaaggccattccaccgttctatcaatccagctgcttcaggatgatggggaacatggaaagaccagtgaattccatgaccatgagcccactgccacactgctttagccaaaaagttagtgccttggtcaggggcaatgctgtgtggaataccatgatggtggataaggcatttcgtgagtccaaggatcgtagtcttggcagaagcattgcgtgcaggataggaaaacccatatctggagtaagtgtctgtttccagtgaggacaaacctctgccttttccatatggaagaggtccaatataatcaacctgccaccaggtagctggctggtcaccccgaggaatggtgccatatcgagtgctcatttttggtctctgctgctggcaaattgggcactcagcagaggctgtagccaggtcagcattgatgagtgcaagcccatgttgctgagcccatgcataacctccacccctgccaccatggccagggcccattggtgatgacaggggtggctggggaaagagactgagtggtgtccacagaatgggtcattctatccatttgattattaaaatcctcctctgttgaggtcacctgttggtgagcaatcacatgggatacaaatatcctcacagtttttgaccactcagagaggtccatccacatacctctttcccaaatttctttgtcaccaatttcccagtcatgctttttccaagtccctgaccatccagccaaagcattggctacagcccgtgaatcagtatacaatcgcacatctggccatttctccttccatgcaaagtgcacatccagatgcactgctcaaagttctgcccacttggaagatttcccttcactggtgtccttcagggatgtcctagaaagggaccgtagtgttgcagctgtccactttcgggtggtgcctgcatatcgtgcagaacgatctgtgagccaggccctggtcttctcttcctctgtcaactgatcataggaaactccccatgacaccatcattgcatgctggggaagagaagacagggtggcaggagtgaagaccatggtcatttgacccacttcctcacgtaacttacttgtaccttcaggacctgctcgagcccaatcacgtatataccacttccatttgatgatggattgctgctgtgcatgaccactttatggctagatgggtcagaaaagcacccagtttatgacaggcagtttaagttgcacagtggcttgatgacccatagtcaaatgttcagtttccgccaaagcccagtaacaggccaagagctgtctctcaaaaggagagtagttttttgcagaggatggcagggtcttggtccaaaatcctagaggcctctgccgttactcacctatgggggcctgccaaagggtccaaacagcatccctatctgccactgatagctcaagcacaattggatctgctggatcatatggcccaagtggtagagcagcttgcagggcagcctggacctgttgcagagccttctcgtgttccggaccccactcaaaactggcagcctttcgggtcactcgataaatgggcctgagtaactcacccaaatgaggaatgtgttggctccaaaatccaaataggcccactaggcgttgtgcctctttcttgattgtaggaggggccaaatgcagcaacttatccttcaccttggaaggaatatcttgacaggtcccacactactggacccctagaaattttactgaggtagaagttcctggaattttagtcggatttatttcctatcctctggcatgcaaatgtctcaccaataagtccaatgtgtttgctgtttcttgctcactgatccaatcagcataatgtcatcaacataatggaccaatgcaatatcttgcagaagtgaaaagcaatcaaggtctctctgaataagattatgacacaaagccagagagttgatatacccctgaggtaggacagtaaagctatattgctggctttgccagctgaaggcaaattgcttcgggtgggcctcatgcacaggaatggagaaaaaggcatttgccaagtcaatggctgcatactaggtaccaggagatgtgttaatttgctcaagcaatgaaacacacctggtacagcagatgcaattggagtaaccacttggttaagcttaccataatccactgtcattctccaagatccgtctgtcttctgcacaggccaaatgggagacttgaaagggggatgtggtaggaatcaccacccctgcatatttcaagtccttgatcttggcactaatctctgcaatctctccacggatacgatattgttgttgacttactatttttctaggtagaggctgctctaatggcttccatttggccttttccaccatagtagccctcaccttaccagtcagggatccaacgtgggggttctgccagctgccaagtatgtctatgccaattatgcattccagaactggggaaatgaccacaggatgagtctggggaccctctggaaccacagtaagttggacctgagctaaaactccattaattacctgactttcataagcccctactttaactggaggaccacaatgacattttgggtcccctggaatcaacatcagctcagagccagtgtccagtagtccccgaaatatctgaccatttccctctccccaatgcatagttaccatggtaaaaggtcagaggtctccttggggaaggatgggaaaaagattcactgcataaattgttggtaatgtagtggggtgcttcctcaaggggacccagcctccccttcattcaaggggttctgagtctgtaaactggctcaagtctggaaattgatggaggggttgcgattctctgtttttataattcaaattaggcttttgtctattcaacctagaagttttctctgtataatttaagtaggaatgaagtaggcttcctatcagtttcgcttctaggaacactgtgattgattagccaatgccagaactctacatgagtcagactatgctgattgctgcttcgcttttgctgtccattacggtaggtacacccaccttgcctttggcggttgagtaccaccacttggccgctgccacctcaggatccaattattcccatcgaatttaaattttgtagttgagtgactgcagttcccaccattagatctgacatacagagatgagcaattacagggctctttgaagatgcatgttctgccctcacaaatctatttcacaaggcattggtcaagggtatatcttctggaccctcccagctgggatgagtaggtctaaaatgactaatccactccaccatcccaatctccctaagcctttagatcccttcctctacataaaaccaagggagatcaggcatttccatcttgctcacagtgggccatcttttaatccatatttcagctaaccaagcatataaactgttagaaccatttttaactccccgagctgaaacactgaatgcagagtccctaagcagtgggcccaaatcaacaaattcagcctgatccaactctgtgttccttccaccattatcccatacccttaatatccattctcatgcctgttctccagattgctgttcttatataaatcacagaactaaaacagttcttttctagtgtagtgcacctcctcatgggtcacactctcaaactcacctctagtggccgctgggactttaatctaattataggtctagaagcaaatggaggtgttgggggtagcttctgaagagaatcaacattatcttgcctggcaattgcctcaggggaggccatcactgttgcttcaggcagtgtttatctccttagacaaaggtggaaaggctgatggcagcatgggtcagggaggggatgttgccactactggggatggggaagctattccttctggcaaaaaaggttcatcagagtttacaaactcagtgtccccagctttatcagggtctccccacacatccccattccaagttgcagggtcccattattttccaatcaatgccctcactttaacagtagccacctggagaggctgtgcatgcatctttcattgcaggccagtcactcacataagagcttgtgtatgtttttccacaattttagctctttctctacaagggcgaagactctcactcaggacaatcttagcagatttgaggctcagtatctccttctgaagccaggaggcagaatccctgagttccttattttctttcatcactttgtcctctgaacttaggagcaaccaactggcttcattatgttccttggttctccacataaggtcaaatgtattatgcatagagtcactaaattctttgccactcatgagtggtgaatcaagagtgtcaaatgcatttattttgcataattctctaaatagttcatgccaaagactatcattgttctccatactatttgaagtagagtccttagcattttggggtctaatcatattaagcagccaactccagaaacctccaaaagaactccatccttaatattctgttcctctagaaccactcctcgtaccagaatctgtattagtcaggattctcttaaagggacagaactaataggatatgtgtgtgtgtgtgtgtgtatgtgtgtgtgtgtgtgtgtgtgtgtatgtaaaggggagtttattacgtattaacgtacatgatcacaaggtcccacaatatgctgtctgcaacctgaggagcgaggagaaccagtctgaatcccaaaactgaagaatttggagtctgattttcaagggcaggaagcatccaggataggagaaaggtgtagactgggaagctaggccaatctctccttttcaggtttttctgcctgctttatattcgctggcagctgattagattgtgcccaccagattaagggtggatctaccactgactcaaatgttaatctcttttggcaataccctcacagacacacccaggatcaatgctttgtatccttcaatccaatcaagttgacactcagtattaaccatcaaagatgtctacctaggagtggaattgctagattatatggttgctctatcttgttttttgaggatcctccaaactgttttccatagtggttgtactaatttacattcccactgacaatgtacaagtgttcccttttctccacatcctttccagaatttgttattgcctgtcttcttgataaaagccattaactggggtaaggtgatatattattgtaggtttcatttgcatttctctgatgaacaatgtttagcactttttcatatatctgtttgccatttgtatgtcttcttttgggaaatgtctatttagatcttttgcctattttttattcagattattagactttatcttgttcagctgtttgagctccttatatattctggttattaatctcttgtcagatgggtaatttgcagttatttctttcagtctttgggttttctattcactttgctgatagtttttttgttttttgctgtgcagaagctttttaatttcaatatgtcaattgcattttcaactctagaatttctgcttgattcttttaaattatttcaatctctatgttaaatttatctgatagaattatgaattccttctctgtgtttgaattttttgagattcctcatcacatctattttgaattctctgtctgaatggtcacatatctccatttttctgggattggtctctggtgctttatttagtttggtgatgttttcctggatagtcatggtgcttgtagatgttcatctgtgtctgggcattgaatagttaggtagttattgttcacagtttgggcttgtttgtacctgtacttcttgggaaggctttccaggtattcaaaagcacctggctgttgtgatttaagccgtatctgcattagggaacatcccaagcccaatagtgctgtggttcttgcagactcgcagaggtaccaccttggcggtgttgcataagatccagaagaattctctggattaccaggcagagattcttgttctcttcccttatttgctcacaaacaaagggaatctctctgtggtgagccacctggggctggagatgtgttgacacaagcacccctgtggccaccacccctgggattgtgctgggtcagacctgaagctaggacagcactgtgtctcatccaaggctcaatgcaacgacttcttggctaccacctatgtttgtgcaaggccctagggctctatagttagcaggtggcgaatccaggcttgtgtccttcccttcagggcagcgggttcccccaggccccaagcaagtccagagatactgtcagggagctagggactggaattaaaaatctttgcactctacctggtgtgttctattttactctagcagatttgaccctcaatccatgaggcatagtctttcccactcttctctgcccttatcacaggcagaggagcctcacctcatggtcaccaccaccacaggcccacggggactactgccaggctaccatctatgttcacttaaggcccaagagctcttcattcaacttgtggtgaatgctgccaggcctgggcctcatgtttcagggcagtgggctccccattgtcccagggcaggtcccaaaatgctgtgcaaaagccaaggcctggaattgaggaccccaagagccctcttgttgttgtaccccactgtggcagagttggtacctaaagtgcaagccgaagtcccctttacttttccctctccttttcttaagcagaaggagactttcccaatagccaccacagctgggaatatattgagtcttacctgaagctagtgtatctcagtcttacccaaggcccatggtgtactacctgggtagctgggtattgctactggttatttagggctactggttatttagtctgcaggtgatggatcctgccaggacttggcccttctcttcaaaacagccagttcctttctggcctggggtgtgtctggaaatgtcacctggggattaggacatgtaatggagtcctcatgactctgactggagccctatcctactgtgtctgagctagtaccccagacacaggcaaaactcctctttactcttccctctcgtctcctcaagtggaaggaagggatctgtggtggacgagtgatctttgcagcctggggttgagggagcggtgacacaagcattcccttagctgcaccaactggtgtctcagtaagtcgtgtgcctccccacccccaaatccactgtctccaagcccagctcagcactgggacttgcagactttgtggcctagattttctttcaagtttatttaatgtcccagagcaatttagcctgcagtggtgagccttgctggaactcaagttctagtcacagggatgggtgatttcctctgactagggctggtttgaatgctcccactgtaggcgggtgtcagctgtgttcagccttgttttgctttctgctgtgacagggcagcattgaattcaatgcaacatctcactatcactgcagcctccttctcctaagcacatgtattctctctcagtccacatggctgctgccaatgggtggggaaggggtggtgtcagtgattcaagactcttttctaccctctccagtgcctccttcagtgatatgaagttaaaatcaggtactgtgagtgctcacctaatttttaggttttttttatgaagatggttttttgtgtagataattgttaaatttggtgttcagggcggggatgatcaatgcggccttttattctactatcttgctccacccccaattgattaagtttcaatttatttatttattcaaatagatttttgcggaacaggtggtgtttggttatatgaataagttctttagtggtaatttctgagattttggtgcacccatcacccgagcagtgtacactgtactcaatgtgcagtcttttatcccttacacccctcccaccctttcccatgagtccccaaagtccattgtatcattcttatgcctttgcgtcctcatagcttagctcccacttatgagtgagagcatacaatgtttgattttccattcctgagttacttcacttagaataatggtctccaactccatccaggttgctgccaaagccattatttcattcctttttatgactgagtagtattccatgctatttatataccatattttctttatccacccattgattcattgattgatgggtatttgggctggtttccatatttttgcaattgtgaattgtgctgctgtaaacacaagtgtgcaaggttttgttttgttttttctgtttgtttttgcttgtttgtttgtttgttttttgtataatgacttcttttcctctgggtagataaccagtagtgggattgctggaaagaatggtagatctacttttagttctttaagaaatctccacagtgttttccatagtggttgtaccagtttacattccccccagtagtgtagaagtgttcccttttcagctgggtgtggtggctcacgcctgtaatcccagcactttgggaggctgaggcaggtgatcaccggaggtcaggagttggagaccagcctgaccaacatggagaaaccccatctctactaaaaatacaaaattagctgggcgtggtggtgcatgcctgtaatcccaactactcaggaggctgaggcaagagaatcacttgaacccgggagatggaggttgcggtgagccgagattgtgccgttccacttcaacctgggcaataaaagcgaaactctgtctcaaaaaaaaaaaaaaaagaagaaaagaagaagtgttcccttttcagcacattcacaccaacatctattatttttttatttttttttaattatggccattcttggggagtgagatggtatcacatggtggttttgatttacatttccctgatcattagtgatgtttatcattttttcatatgtttgttggccatttgccaactgatatgttttcaaaggcaaaataattaaatgagattgtttattccacttaaacgaattcaaaaataatgacttacaaagtagtaatataattccaccgcccatgtgtccaaaatgttgatttatttatgccagaatgttgtttctctgaccaaatattgtcttttggagctggaggatctccaaaagggaaagctcttatagctaatcaagaagtttcagtggggaaacttataataccatgaactaagcatcagcctgattagctactgattttgtgactgaaataaaatggtacctttcgttcttaccctgccccaaggtgttttttagacaggggaaattaggtgtaataatttcctctgaaaggtgagttatgctacttttgattatttttctttttacttctttgtattttttcctcttacatttatttttgattaggtaacacattcatgtggttcagaatttgaaatttacaatagagtgtacaattaaaggtctcacattctttgtgcccacccccacagttcttcccagaggcaaccagtgtttttacttttataaatattttatgcatacacaagcacaggcacttgcaaacatgtgcacacattcttccccccagttgtttttacacatttttctgtactatgctttagagcatttcatatcagtgcataaggagctatggctacatggtattatttgtttgtatagagatgacataatttatttaacaagtcccctattgagggatgtttaatttgttgcctgtcttttgctattgcatttctgcagtaagtaatcttgtaatacatcatttcagatgtgtgctatctgtagggtgaatttctagaaatggagctgttgggttggatagtatggacccttgtcattttggtagatattgccagaatgtcctctatagaagttgtgcccaatttacactcctaccagcaatgtataactgtgttttcctaaccctcaccaacacattgtattatcaaacattatatctttatgaatatgatatgtaaaaaatactatgtttttaatatgcatttctgttctgaataaggttgagcaccttttcatatatttaagatcctgtgatatttataaaaataatttccttttttataatggctggaatgctgcaggattgataggcacaatgtcttttctccttaacttatacctgcaggtatattcttttacacagcagtatgagagtgattccaaagagcatatttaggttaaataaataatccaggaacactttgtgttttaaaatttcggtagcattttataattcactcattatacaactaacatattatagttgacaaacaaatgaaccaacatcccctagtaactttaaatgatttaaattactcaagaaatttaactcagtggttttgttacttcttaatatacaccatactttataattttttcatattccaagaaaaatagaattatcctttatttaggaagttaccagtgtgttagaatttgcacggagttatcttaaattatggtctgtttacatttgcaatatgtatttgaaattttcttccttaatacctaagccacattgcaggaaggtgagaagttcagtgtatatttaaatgtgttgactgattcataaatggccccggactcttttgcatcacacaacaaatttttgtcagatctttgtctatggcactgtagatcacctctattatagcagctatcaaagtctgtcatgtattgtcattatttatttatgtgtctgcttttgtcactagattatgaacttctagaggatacaatttgtattcccctctagcactggtctggagctttgcatatatttcagacttataaaatgtttgttgaactgaattgaatcacatttatatagaggttctgaggttgccttttaaaaaacgtttttccacgtattgtttgcttttttaaatgtaaagtcttattttaataccgcccaagtttgctttctgctaatattattgaatttgtattgagaataattattcaaaatactcctgtaataatatcagtgaagaggcagatttttattgtgcatatttcctagctgttcatagttttaaccatcagagtcctgctttaattttagcctcaggcaattctaaatatttagtgagcaaagtgggaatattagacactttagtgcgggatgttatttgtttcatctcactaagattcccaatttatataggccatttgaaatgtgcaattaaagttctggtcattgctaatattaaggaatttagaaggttctatagcagagtaaacagctttacaaatgatagtggtgttttttaatttaaatttttattgagatatttgtggattcatatgtagctctaagaaataatatagagagatcccttatacactttatgcatttctccccagtggtaacatcttgcagaacagttgcctactatcataaccaggatactaatagtaatataatctgccactctatattcagatttcaccagttttacttgtgttcatgtgtatgtgtgttctgtacaattttattacctatatatgttcatgtttccaccaccacagttaaaatactaaacagttccaacatcgcatatattcagaagtatgctatctgtagggtgaatttctacaaatggagctgttgggttggatgtttgtacctttgtcattttgatagatattgccagaatgtcctctatcgaagttctatcagatttacactcctaccagcaatgtataactgtgtttgttttcctaaccctcaccaacacattgcgttatcaaacattgcccttttataaccaccccctgacccctatcatcctaaatcattgcagccactaatctgttctccacttctaaattttgtcatttaaaaatgttatttatttagaataatgtagtataaccttttatgattagccttttttatcattatcaagtattatgtactttgcataattgtatgtgctatactttttaatgagtatttttatgtaaatatttaaaaatttatcttattttaggtttgggggtacatgtgaaggtttgttacacaggtaaacacgtgtcatgggggtttgttttacatattattacatcacccatgaattaagcttagtacccaatagttatcttttctgctcctcttcatccttccaccctctgttctcaagtagaccccagtgtctgttgattccttcttggtgttcgtaagttcttataatttagctcccacttataagtgagaacatacagtatttggttttctgttcctgcattagtttgctaaggatgatagcttccagctccatctgtgttctcacaaaagacatgatcttgttctttattatggctgcataatattacatggtatatatgtaccacattttctttatccagtctgtcacggatggggatttaggttgatttcatgtctttgctattgtgaacagtgctgcagtgaacattcatgtgtgcacatgtctttatggtagaatactcatgaaagtgtcttggagctatttggacaaggaattttaggatcttgggtactcaaattatgatatggaaggggaaacacaggctttcagtggttctttcccttttgccccacagactcttcctctctgaaactgacagcagctgaggaatggctagagtggggtctgctacattggagagcatctcttgtccatgtcaaagtgtgacgcttcatttattaattgtttgctatgatttaactactaaatgctattttaatttttttggcttgaaaataagtcttaagatgtcatcaagcttgatgccagcaaatatggcagagtagggaaccctcaaaatttatctttttttacaattgcactaaataaactggcaaatactctcagaatcaactttactggcattatggaaactaatcaaaagtttacagcaaccagacaaatgcttaataataaaaaaagttgaatctcagtaggagagatttgtggcattttagcttacccttgtcccaccccctgctctctagcttggcagtggctctgaagacaacagtctacatttcactgtactagtccactgagtacaggttcttagtacctgagggagtagaagtaaccttattcttaaataagtgtgtttgttggttttgatctgtgttgtggatctgagggaccagttcagaaggcttgcctttattttgcctaactcagaacttttccaaggttgaggcagctatgggggtggaggagagatttgtgaaaacatttacaggcaaatgtattagctgctacttcctaggggtagggataaaggttggtcaaacagtaaactagctaaaaagcttgggaaaaaagtctgggaaatgagatgctttggagaattagagctttgaaaagcttcaacatattcctggtaatttcgaaggccatgtgcccccaaggctatgtggatgctcagaaaagacctgagaacgccctaagctttcacctctggcttatcttcagggtctcaactagcaggaatttaaggctaatgcagaatagtaaacttcctggctgagtgttgaaggtgtgcacatctgcaaagactgggaatttattgttgttgttgttccaggcgttttaggaaatttctgtttcaaatcactagatgctcactacgataatgaaacagatttcagtggccacacaacaaagaatacagactttacaaaattagtttagaaaaagtcactaaacaaacaaacaactactataataagcatcaataacaaaccctggagagggaagagaatctgattttcagatttgctgcatcataatattcaaaatgtcctatcttcataaaaatatgaaccatgcaaattaaaaagaaagtattacacataggaaagaagaaattactataattccccaaagaatcccctggctgtagtatgggagagtcattaatctgctatttagctaattgaacaagtaaaatggacaaatcgaatattgagcactactagaggatccccatttactagtaaaacatgcttttatagagatggatagctgttccaaaaatgtctggccatttttattgcattataaccttaagttaaattttagttttcattttatcttgtgatatatgatatatggaagctaactcatttcctatgagcaaatgaattgatgagttttgctcaactgcagaaaatcattgagtcttttataggattttttggtctctgactttagataaaatggtatgtatgaactctttcccaaatagtacctggatctgctatgtttctctttctaccaagcagatagcctaattctcaatgcctggctgtctcacttgtgtcttgtgctggatatttttatttgctgaatattatgttaagtacagttgactatcattttcatctttataaggaaatcattgtatagctatattaaaaaatgagtagtttttatactgttttaactatagacccttagtggttataaagacttagcaaagggccaaagagtttttaaaatgatatatttataagcaagtatagagaggaattcaataagtgagtctggcattgtgcatctgttttagagatttcattcattagaaaatagagaacaccatggggaaagactctcaattttattaactaagtatggtccatgcatatgaagcgacttcagtagaataagttcaaaggaaaaatgaatgatgtcaaagagaaaagtaataattttacttcataagttgccaactcaggtagttgtcatttaggaaatatactgggacagcctaaaggtaagttaacttttttcttaattaagccttctttgaagaagttaagtttagtgagtaagatgcttcttttttataatggtttttatttacatatctcatgttggtgaatcatgtgttagtagaaatcataagggaatagatatgctgctatttaacttcagttctgttttttcaaaaaaataataaattaatggataatgtagcttctcacttatacaggggttacagggacctaattcttggatctacatagccatcaactgtagtaccatatttctcttgagggagctccccaaatgaatgggagagttaaccagcatttatatggcttaccttgtatctcaaatctaaaaagaaaaaaaaaaaaaaacggatgtagctaatggtatcttttaaatgttctttgacatttaatcaattttcactcttaatggttctgtatatcttattttgctcggaaagggtcaaagccatgcctgaaagaccttaaaataaaatgttaaattttgactatgctttggtaactttgtttattttgatattgcctgatgcacagaaaatgataaaaatttccataagaaaatagattgcaactatttaagtctacaatacttttccttgtttttataaattaaaatttaaatacaattttaagtctattttttgacctaaacaattgtaatactgagttctttgtgtatttcttaagaatttctttgcaggtccaaacagatctagcattattgagactgaataaaagatgcttctttcaggtggcccctaatttaattgtttgtaatgattattctagaaaaaagcaccactctgacacatggattttcttgtaggtcagcattttataaaaagtatcctaacgacaaatggatgataggaagagcaaaagaggaaaaaatatccgtaagaaaagatgtaatacaattagtacaaggggcaggaggtaacaggaatttggttcttctttctatatttttttactttgagttcctcaaatattttatatgcaagaaaatatttcaagttttaacacatatgtcataccattttcttagtttgtattccatcatgccataagcatttactttcagaaggacttttggttttataaattaaaggcctgattttttttttttcagtgcacttctaagttagataacgcagagggaggtttatgtggaaatgatcgtttttctaagtgaatgttcaaacactgagtcactcacaagttcttaaaatcctatatgttttaagatatattagaggcagattctatactgaagaaatagtgcaaattttgcgcagttaacataaaatttagcatttttcatcctcccattatcttcagccccatgattttgtgtctttggggatgaatacttagactttcacttgatgcattcaggctctgggttagaaaaagatgcttaaagactgagtcatgaatattggaaaagaatatagtgggaggaatcactctacatgatattatgacctactatatagctgtagttaattaaaacagttgcagtaatagagaaggaatagacacatagatcaatatgatagaagggagaattaagaaatagacctttacaatatgcccagctattttttgacaaaggagcaaaagcaatttaatagaggaagaataactttttttttcaacaaatgattctggaacaattgagcatccatagacaaaaatatgaaccttgacctaagcctcacaccttacaaaaaagttaactcagaatggatcatgggtttaaatataaaaagaaaacaataaaacgtttagaaaaaaataaaatcatcacctagagctagatgaagaattcttagacgtaataccaaaagcctagttcatgaaataatcaaaatttaaaaatgtttattctgtgaaagtccttgttaaacagagaatgaaaacactagctataaacggagaaaatatttgcaaaacacatatccagtagaagattattatttagaatatatatttttaaaactcccaaaactgatcagttcaataaaacccccccaaatcccattagaaaatggacaaaagatatgatcatacatttcatgtaagaggatatacatggaaggaacattattgggaaattggtgacaaagaaatttggagaagagatgtgtgaatagacctccctgaatgggcaaaaaacatgaagataattgtgtctcatcaaagggcaacctcagcagaggaggattttaatagccaagtggataggatgacccgttctatggatatcagtcagtctctttcccaaccactcctgtcagtgcccaatgggctcatgagcaaaatggccatgatggcagggatggaaattatgcatgggttcagcatcctggacttccactcaccaagaccaaactggctatagccattgctggatgtccaatctgccagtagcagagaccaacactggtagcaacaccagatgaggcaacattgcctggagtgatcagccaactctctggtgggaggttgattacatcggaccccttctaccatggaagaggcagcgttttgtctttaatggaacagacaatcgggatatggatttgccttccctgctttgcagtgcttctcccaaaactgtccatgaatggcttcattttgttttttcctctccagtttctcaggatgtagctttagattattgaattgagacatttcttctaatgtatgcatttaatgtaataaatttccctctaagaacattttagctacacaccactcatttttgacatgttatgttttcgttttcattttaatttactcaaaacagtttttttcaataattttactttgactcatatgttaatacttggaagtgtcttgtttcatttgcaaacatttgaggatcttctcaatatcattctcttttttgatttctagttcaactctattatgatcagataatgtactttgtatgattgctattttttaaatttataatttttttatgtcccagaatatgttctatcttggtgtgtgttctatatacatttgagaagaatgtgcattctggctggatggaatattctatatcaaattggttgatagtattattcatatccttactgatttcttcatattttttctgttaattactgagagagaactgatgaagtcacaaaatatagttgtgtgtttgcgtttttttccttttatttctgacaggttctgcctcatgttttgaagctctgttagttgtatacacattcaaatattatgtcatcttggataatcgatccctttattgttatgtatgtttcctctttctcttggattatatttcttattctatagtgtcaaaaattaatatcactattacaactttgttttttgatagtcgtttctttttgaaaaaagctttattgacttgtgattcaccaatttaaaatgtataaatcaatgtttattagcatattcacagagctgtacaatcatactcacagtctaaattttgagcattttaatcactccatagagaaatcccataccctttaccagtaactctcccgtaatcccccaaatcttggcaaccactaacctactctctgtttctatagatttgcctattctggacatttcgtagaaattgaattatacattacgtggtattttgtgattagtttctttcacttagcagaatgtttacaaggttcagccatgttgtaacatgaatcagtattagattcattttcatcactgaatcacattacattgtatggatataccacattttggttatcggtttataagttgatggacattcaagttgtttcctcatttggctattagaaataatgctgctatgaatatttgtgtaaaagtttttgtatagatatatgtttttttaatcttgggtatatacctagaagtagatttccacgtgatgtggtaactctatgtgtaaacatttggggacctaacatcctgttttctaaagtgactgcatcattttctattttcaccagagagcctggtggggttcctggagaaggctgttagagagtgtgagttcctctatgtttgtgggccccagaagtttcacattatcttattagcccacacctggcctttagcaattagttgaaatgtctaattgaatcttcctacctgcttgtattctgtattgcattctatattgtcattcaatattcaattttcttataagtaaggaaatgctctggacctatttctctctggaggttttgggctgattctttgctgtgatctctattatctctgataggtccaagaaaaattgttactctgaaacctgcttgacttttttcttattgcaagtttaggagtaacatctttctagctctctacatcttcaagctaaaaaatgtcatttaataatgagtttacctgttttttatatattatggataccagttctttattatatgtacatttcacaaaagttttcttccagtttgttgctggcttattctttttcttaatgattttttgatgagcaggtgttttacattttaatgaatctagtttatcattctttcttttattatttgtgctttctgctgcctaacaaatatttttctatgccaaggtcacaaagctgtttcctgttgttttttctagaaactttaaagtattttatatttaagaacatctttgatcttgaagtaattttttgaatggtgtgaattagaggttgacgtttctgttttaaaatatgggtatactgttgtttcatcaaaatttattggagagatttcctttcccagtgaacttttatgttaccattttcaaagatcatttgactttatttgtctgtgtctaattttggactctccattttgtttgtttgacctgttcattcattaataccacactgtcttggtattgtatagtgagtgttaaaataaggtagagtaaatattaaatataaatattaaaacttccttcctcttttcaatattattttggatagtttatgttctttccatttctgtataaattatataatcactttgtcaatttttacaacaatatctctgatgattttgatgggtgttgtagtgaatctatgggcaaattttgggaagattgttaactgaagaatatttcatctccagtatatgagtctagcatatatttccatttacttgataggtatatatttactttacattacatttaatatttctcagcaatgtttttatcattttcatagcataggttttgcacatctttcactaattttatctctaagtaatttatgactttggatgccattgtaaatggtattagtataaaatttttcattttataatgataactgatttactaacttcagttttataatcacttttatactgtgagtatacaaaatttacttgtttaaattttatggctttttaaagattacttagaagtttctacaattaataatcacattatcttcaaataagagatgattttgctcttcccttttcaattattttgcatttttccttatctaattgcggtggatgagctcaatggcaaatgctaaataaaagtgatgagataagatatttttgtctgtttcccaagcataaggaggaaaaacttcagtatttcactattaagtattatgcaatatgtatgtattttacatgcacatcatcagattgaagaagttccctctatttttagtttggtgacaatttttatcatgaatggatattgaattttgttcaatgatcatataattttacccctttaatttgttaatgagtaagttttatttgttgatttttattgttaagccaatcttgcattttggggattaaattctatttgagcaagatgtagtatccttttaatatgttgttgtattctatttagtaatattctattaaatatttttggatctgtgttcttgagagatatttgtgtataattacattttcttgtaattcatttatctggttttcatatcagtgtaatataggcctcctaaatgagtttgaatgtgcttcctcttccttcattttccaaaaatgcatttgtagtattggtatttttctcttaaatatttgattgaattaactaatgaagctgtcttggcctagatttttctttgtgcaacagtacaattttgtattgtgtttatttaattaacgttttatcatgggcacttttctatttcattaaatatttttcaaaaccaagatttttcagttacataatactcatttgaataaatatactgtaatatatgtaactagtcccctacataactgttactttttttctcaaacatacgtctgtgtgtatgtgtgtatttgtatacaaacatatgtatacgtttatatataatatgaagtatgcataatatagtatattgcatacatagtatacatacataataaatacatgtatgtataaaaatgtacatatgcatgcccacacacatagacccactaagagaggcagacagactgatggactctagaattagatatatcagtacattaacagagtttaactttggatgttgggagtttgggcactttttactttctttcacagttttcagtattcctattcttttcagaccaagagtgttactctataattagaaagtaaatacctgaactgttttcattcttgagaattaaaaaatggataatttcttaagctagcacaggcaggtagggaaattaccaaaatactgcgtggtaattaaaattatagcaatgttcatgtttgtgatccccaaccacccaagagcggaacattaaatgatgtcggaggaggtgcagtctttcaggctcccatgagaattgccaaatggggcacttatgctttttgggacgaggtccaggttttatttttttcttcttcaaaagtcttaaaataaatgaaaattgtcacagcaaaatgcattttccctttcatttagagcattgaaggctacgcaacgtcaggtgacactggaagaatttggcttgaatttttaaagttgcttgataggggaaagggagatgaaaattactttgaagaattatctagtcacatttggttaatgtgggcaatgatagaataaagtaaaaattttagacatgtaatccattgtgatggctccagtttttcaggacaattaagaaatagcctctattgctcaaagtctcaagaaatactggaaaaaaatgcatggatactttattgggtgcttgttaaattattaaataggtgacaacttaggggtgctggctaaactttttaacttcttgtttggccttgtacagtttataaattttagaagtaacactgagaggacagaaaatatctagaagactttttaaaggtgcatacatatatatacacacatgcatttcagaccaacgagtgagggatgagtatggcaggaggagtggggacagaggaccgaagaagaatgagaggatgttgggaggtggagagagagataagaaacaaaataattagagaaaaattaaaaggtgtatttattaggtatagggtgaaaaaatttgcctaattcctgaatttggatgatttcagagtgttcttatctggttctgtacccaaaataatttattcttagggattctgtgagggattaaatgacactagagacaaacgatgaggcaatgagaaaattatgaagaaattaaggagaagagcaatatcttcttatttgctataattcataatacatggatgtttgagaatcactattatctagtgtataaggctgacttgttcccattatttcctaatccataatgctgctccttttttaccccataatccttcccttaaaccacatgtgcatcatttctttcatctggaatggatgtcttgtgtttcaaaaatgttttaccttatcactcttattttcacttctgaactaaaggtacattgcttgtataaccccctttttgctgttttgataaggtactaaattgaataatgtacctttaggccagagagcagtatagggcaagttacttagtttgtgagagagcctaggcaaccgattgctgaacagctattatctccttgtgatttcatttcctttgctcattattaggcacactataagtattgtgatattttctttggaaaattttggtcctaatcagaaagccatctgctaacaattgtgctggaagtgaagcagcatgataaagttacctttagccatgatatagttgtgtcaatgacctttcagttacatattactattatataatttgtggggaacatttcatgtcttagtgctttttgtaatgtgggaatttggcagtttgaaaatgtatggaaagcactacagttattgactcttttttttggtcatccaagtttcattgggttcttcatgtttctttatttcccttagactatttgagaggtaggaaaccaagggagaaggaaatggactcttatggtggagcaaattgaagtatcacttctgcttttctttttttcttttaatccagatgtacagtaaacatagacaagagtatagactacagccaggttatagaacagataggtctcagtagtaggcagtatgttagctcagatatctgggtagtcaacatggttgagagtgtggtagctatcattcataggtgagttgagtgcaagagccagggtagctggtagcaggcaatatccagagatccaggtgaacattatagttctgacagtgggattggagttcatgttactatttttccacatcaggtatgctggaaggtaatagttttgttttgttttgttttgttttgttttgttttgtttttttggagatggagtttcgttcttgttgcccaggctgcagtgcaatggcgcaatctcggctcactgcaacctctgcctcccgggttcaagtgattctcctgcctcagcctcctgagtagctgggattacgggcatgcaccaccatgcccggctaattttgtatttttagtagagacggggtttttccatgttagtcaggctattctcgaactcccgacctcaggtgatctgcctgcctcggcctcccaaagtgctgggattacaggcatgagccaccgcgcccggctactggaaggtaatagttttttgtgtagtccgttgcctgaaatttaaaacattttttttcatttaaaaataaagacaggcttagaaaatcacacacacaatatatggtttaataaattattaccaagtaaatacctttgtaactaacacccaggtcaagaaataagaactatgctacccaccccaaaagctccttttgtggaccacatcctaatcccaacccagttgctccacagaaataaacattgtcttgactttctttggactttttatggttttatcacccaaattcgcgttcctaggtattactgttttattcttgttcatttagaaaactttgatatgttttttaaatatctcttaaatgtgtgggttttccctctatcccttacttttctttacaattaatatttcgaagaacctatgccatctgacttacagagcatctcaccttttggattcttctgactgcaaattcaaggtgcagtttaacatttttttctgccatttatattttctacatattggcagctggatccagtggcttgatcagacttagttttgatctctggcaagattataagtggtgtctgacagtcatatatggggaagataatgggtactcgtctttctttttgtgatagtagtagctattggtgattaatgacaatattagttaactcagtttgaaaagtagtgatattcttggccaatatcatactgaatggggaaaagttgaaagcattcctcgtaagaacttgaacaagataaggatgcccaccacattcaccacttgtcttcaacatagtacttgaagtcctagtcagagcaattaagcaagagaaagaaataaagagcatccaaattggaaaggaggaagccaaactatctctcttagtcaatgatataatcttatacctagaaaaccctaaaggctcctccaaaagccttctaggcttgataaatgaattcagtaaagtctcaggttacaaaatcaatgtatacaaatcagtagcaccactatgcaccaacaacaatgaagctgagaatcaaatcaagaactcagtcccttttacaacagctacaaaaagtaaaacacctaggaatatatttaaccaaagaggtgaaagatctctacaaggataatgacaaaacactgatgaaagaaatcatagatgacaaaaacaatggttcatggattggaagagtcaatgttgtgaaaatgaccatactgtccaaagcaatctacagattcaatgcaatacctatcaaaataccaatgtcagttttcacagaattagaaaaaacaatcccaaaattcatatggaaccaaaaaggagcctgcatagccaaagcaatcctaaaccaaaagaacaaatctggaggcatcacactacctgacttcaaattatactataaggctacagtaatccaaacagtatggactggtacaaaagtaggcacataacaaattgaaaagaatagagaactgagaaataaagccaaatacaaccaaccgatcttctatgaagcagacaaaaatatacaatggagaaggactccctattcaatatatggtgctgggaaaattggatatctgcatgtagaagaatgaaactggatccttaagtctcaccatatacaaaaattaactcaagatagattaaagacttaaatttaagacctgaaactatacaattttagaagaaaacataggaaaaactcttctggacattgacctaggcaaataatttatgactcagaccccaaaagcaaatgtaacaaaaacaaaaataaataaatgggacctatttaaattacaagcttctgcataggaaaaaaataatcaacagagtgaacagacaacctacagaatgggagaaaatatttgtaaactatgcatctgataaaagactaatagccacaatctacaaggaactgaaacaaatcagcaagaaaaaatcaaataatcccatcaaaatgtgggcaaatgacatgaatagacatttctgtcttcaaaagaaggcatgcaaatggccaagaaacatggaatcatgctcaatatcactaatcatcaatgtaaatgcaaattaaaaccacaatgaagtgccaccttaccccagctagaatagccagtattaaaaagtcaaagaacaatacatgttggcatggatgtagtgaaaagggaacacttctacactgctggtgagaatataaattagtacaacctctatggaaaacagtagggagatttctcaaagaactcaaagtagacctaccattcaatccagcaatcccactactgggtatctgtctaaaggaaaataagttattgtatgaaaaagacatgtgcatgcatatgtttattgcagcacaattcaaagatatggaaccaacctaagtgcccatcaaccaaggagtagataaagaaaatgtggtatatatgcatcatggaatgctactcaaccacaaaaaaggaatggaataatgtcttttgcagcaacttggatgaaactggaggccattattttaagtgatgtaattcaggaatggaaaataaaatactgtatattcccacttgtaagtgggagttaagctatgggtacagaaaagcatacagagttgtataatggactttggacactcagaagtgaggagtcggtgagggataaaaaaaaaaaactacatactcagtacagtgtacattatttgggtgttggagtacactaaaatcccagactttgccactatacaattcatccatgtaaccaaaaaccacttgtacccctaaagctattgaaataaaaaaaaaactcaaagaaaagtagtgatattctaatgtaattttttttcatgtgttagttggtgttatggactgaattgtgtccctcaaaattcatatgttgaatctcaaaccccaaggtaactgtatatggagtaagaaagtaattaaggttaaatgaggtcataaaggtggaactctaatcaatattagtgtccttataaaaagagacaccagagagttcactcactccctgccatgtaaagacgcagcaggaaagcaggcatctgcaagccaggaagagacccctcaccagaaatcacaccttgccagaaccttgatctcacagccttgagaagagtgaaagaaataattttctgttgtttaagccactcagtctacaatattttgttttggtaggctgagttgactaatacagttggaatacttttaaaaagagatagtttcccccatccattatttggttatcaagtgatactgtttatattgaagagactataaatgtttgaggctttctctgtatgtacttaccagttttcaagaaaatgaactggttccccatcatcctcttaaagtgagtaattcttttctctttacaatatcattatgaactcttgaacttaaacatatttgatgggtttcaatccatttcaaatattgttgtcactgaagcacatattgtgtcatagttgactaatgggagtgtccacaagttggctcctgagtcctttaacaagactctagtctttaaaagctttcttattacctagtatgacacaatgtttctggttcattttatacattccttgcctcaaatttagaatcaggcattctacatatgtcacttgtttctattaattcataatggtatctcaataccacagtcttggtggaaaagatacttattgttacttctttgataattgttttttttcccactagccttttattctatcatctatctatctatctatctatctatctatctatctatctatctacctacctgtctataagacagtgttctccaacatttttggcaccagggacaggttttgtggaagacaatttttccacatactcaggggatgaggtggatgattccaggatgaaactgttccacctcagatcatcatgcattggattctcataaggagagtgcaacttagattcctcccatgtgcagttcacaatagggttcacattgcactcctatgagaatctaatgtcaatgatgatctgacaggagacagagttcaggtggtaatatttgctcgcccaccactcacctcctgctgtgtggcctggttcctaatggtacgatttggttccatagactggtacctgtccatggcccgggggttggggactcctaagagataggtctgactctgtgcctaggctacactgcactggggcagtcatggctgactgcagccttgatctcctgggctcaagcaatcctcctgcctcagcctcctgagtagctgggattacaggtgcaagccaccacacctggtggtcattgtttatacatcttttcagtggagagagctaagaaatataaaaataaattcacatacaccctcccaagactgaaccaggaagaaatggattccctgaacaaaccaataacaagctccaaagttgaatcagtaataaatagcctaccaacaaaaaaaagcccaggaccaggtggattcacagccgaattctaccagatgtacaaagaagggatgacactgttcctactgaaactattccaaaaatttgaggaggagggactccttcccaactcattctatgaggccagcattatcctgataccaaaacctggcagaaacacaacaacaacaacaaaaaaaaaaaaaagaaaaaaaaaaaaagaaaacttcaggccaatgtccctgaacatcagtgcaaaaatcctcaacaatatagttgcacacaaaatctagcagcacaacaaaaagctaatccactgcaatcaagtaggcttcatccctgggatgcaaggttggttcaacatacacaaatcaagaaatgtgattcatcatgtaaacacaactaaagacaagtccacatgatgatctcaatagataatgcagaaaaggctttttataaaactcaacattccggccgggcatggtggctcacgcctgtagtctcagcactttgggaggcagaggtgggtggatcacaaggtcaggagatcaagaccatcctggctaacatggtgaaaccctgtctctactgaaaatacaaaacattagctgggcatggcagcatgcacctgtagtcccagctgctggggaggctgaggcaggagaatggcgtgaacctgggaggtagagcttgcagtgagcctagatcacaccactgcattccagcctgggcgacagagcgagactccatctcaaaataaacaaataaccaaaaactcaacattccttcatgttgaaaactttcaataaactaggtattgaaggaacatgcctcaaaataataagagctctctgtgacaaacccacagccaacctcatactgaatgggcaaaatctggaagcattctccttgaaaaccagcacaaggcaaggatgctctctctcgccacttctattcaacatagtactggaagtcctggccagagcagtcaggcaagagaaagaaataaagggcatccaaacaggaagagaggaagtcaaactattcctgtttgtagacgatatgattctatatctagaaaaccccagagtcttggcccagaagctccttcagctgataaacaactttggcaaagtttccagatacaaaatcaatgcagaaaatcactaccattcccatacaccaacaacagccacaccaagagccgaatcaggaaggcagtctcattcacaattgccacaaaaaggatgaaatacctgctaatacagctaaccagggaggagaaatatctctacaatgataattacaaaacacttctcaaagcagtcagagaagacacaaacaaatggaaaaacattccatgctcatggataggaaaaatcaatatcattaaaacggccacactgcccaatgcaatttacagattcagtgctattcctatcagactaccagtgacattcttcgcagaactagaaaaaactagttttaaattcatgtaggaccaaaaaaaaaaaaaaaaaaaaaaaagacaagaaagagcctgcatagccaaggtaatcctaagcaaaaagaacaaagctggaggcatcacatcacccaacttcaaactacactacagggctacagtaaccaaaacagcatggtactggtataaaaaacaggcacatagaccaatggaacataatagcccataaataaggcttcactctgcaaccatctgattttagacaaatatgacaaaagcaagcaatggggaaaagactttatattcaataaatggtgctgggataaccagctagccataagcagaagattgaaattggaccccttccttacatcacatacaaaaatcaactcaaaatgtattaaacaattaaatgtaaaactcaaaactgtaaaaaccctagaagacgatctaggcaataccaatctggacatgggcatgggcaaagatttcatgacaaagacaccaaaagcaattgcaacaaaagcaaaaattggcaatgcgatctaattaaacataagagattctgcacagcaaagagcaaaagaaactatcaacagactaaaaagacaacctacagaatgggagaaaatagcttgcagactatgcatctgacaatggtctaatatccagcatctatgttctcagttataagtgggagctaaatgatgagaacacatggacacatagagtggaacaacacacaatggggtctttcagagagtggagggtgggaagagggagaggatcaggaaaaataactaatgggtactaggcttaatatctgcgtaattaaataatttgtacaacaaacccccatggcacagttcacctatgtaagtaacctgaacttgtacccctgaactaaaaagttaaaacaaatttaaaaaacaaatttacaagagaaaaaccaacaacctcattaataagtggccaaaggacataaacagacacttttcaaagaagacaaaacatgcggccaacacacatgaaaaaatgctcaatgtcactgatcattagagaaatgcaaataaaaaccacagtgagataccatcttacaccagtcagaatggctgttttttaaaagtcaaaaataacagatgctgttgaagatgtggaggcaaaggagcacttatacactgttggtgggtctgtaaagtagttcaaccattgtggaaagcagtatggcaattcctcaaagagctaaaaacagaactaccattgcacccagcaatcccattactgggtatatacccagaggaatataaagcattctgccataaagaaacatgcacacaaatgttcattgtcacactagtcacaatagcaaagacatggaatcaacctaaatgcccatcagtgacagattacataaagaaaatgtggtacatttacaccatggaatactatgcaggcataaaaaagaatgatctcatgtattttgtgggaacagagatggagctggaggttattatccttagcaaactaatgccagaacagaataccaaatgctgcatgttcttacttgtaagtgggagctaaatgatgagaactcatgaacacagaaggaaataatagacactgtggcctatgtgagggtggaggctgggaggagggagaagagcagataaaataaatattggatactaggcttactacctgggtgatgaaataatctgtacaacaaacccccgtgacaagactttaccaatataacaagcctgcacatttaccccagcacctaaaataaaagttaaaataataataatttaaaaagtactttgtaatcttaaaaaattaacacacataaaaccttatgagtttatactgatacttgcaattcaaatgcagtgccatatatatagacttctggttaactttttttttcctgttccatcctttgtctttcccaccaagaattgtgctttttaaggccagaagggatgacagaattagaataccctgaaagtattcatttatcttatttcacaatagaaatacagcagcctcagaataacaatacgaatactaccaccatagtcggatgaatattaaataaaagcaggaaaggaattagaacagagagaaaaggggaggaaggaataatagataccattctattgaaggtttggtggctattggtagttttcctcattctcatattttgcctttgtgataccttgtctcccaaagttttatgaaacattcatgtgtttttggttttgctttagttcctctatttttactgtctatgtacttttcatacaactttttgtttattttttaaattttattttttaattgacaataattgcacatattcatggggtgcatagtgatgtttcaaaacatattatgtgtagtgatcagatttggtaactagcatatctatcatctcatacctttattatttcttcatgtggtgaatatacaatatcttccttctagctatttgaaactatatattattgttcaaaactacaaagaagtttaaagaatagtacaatgaacccttgtatacttttcacccagattcaccaatttttaatattgtgtcactacatttataaatatataattctttctttctacttaatattttaatatgagaaattttaagcataaagttgaaagagttttacagtggccactcctgtagctgctgcctggattttactgttaaattttgctatagttttatcagtgtcagtttatccattccattatctatatattaatacatattgatgcattcagaaataaattgcagaaagacattcatgatcatgcatcagaaaaattaatattgttaatatgactgtacttccccaaattgatctaagcattcagtgcagtcttccttaaagtctcagctggtttctttgcagaaatatgagaagctgacctaaaattcatatcgtatggaaatgtaagagatccggaatagtcaaaacagtcttgaaaaagaacaaagttggaagactcttccaagatttcaaaattcactagtaagttacagtaatcaagactgtttggtgctgacataaggatagacataaatcaatggagtagagttgaaagctcagaaaaaaactctcacctttatagtcaattgtttttcaacaaggatgccaagacagttggaggaaagaaaatattcttcaacaaatggtgctgggaaaactgaatatcaggtgcaaaagaataaagttggacctatattacctaccttatgccaaatttaattcaaaaaggattttttatatgcaatgtacaaaataggcaaatctatagagacagaaactagattggtggttgcctaggactgggtgggggatgtggttggaagaaaatttgaagtgactcattggtatggggtttctttttgggatgataaaaatgttctaaaattgattgtggtaatggttgcataactctgtgaatatactgaaaaccattgacctgtacggaagtcatagcccaataagctgttagagaaaaacaattgcagaaaccaatacactttctcctaaatggttcaacatttatattaataactagggttcaatattggtttatgcattttagttttgatataaaaattccataagatgaaatgcagaaatcttaagtgaacattcactgagttttgacaatacatacatctgtgtaatccattccccatcatgttatagaacattaacatcaccgttggaagttccctcctgtcatccttctagtgagttttctcctatgtaccacctaaggcatactttgatctgattgttttccagcacggaattatccacctgatttagtattttacataaaatgcataatttaataggtacttttttatgtaagactttcactcagtatgctattaatgagattaatccatattgttgcatttctttagtgactgagtcatattccattgtatgaatataccaatgaagatttatttttttttaattttttttattttttgaagttttaaagctgggcatccgggggagacatcacatgtcagtaggttccgtgatgccccacaagccgcaaaaccagcaagtttttattagggactttcaaaaggggagggagtgtacgaataggtgtgggtcacagagatcacgtacttcacaaggtaatagaatatcacaaggcaaatggaggcagagcaagatcacaggaccacaggacccgggcgaaattaaaattgctaatgaagtttcgggcaccattgtcattgataacatcttatcaggagacagggtttgagagcaaccggtctgaccaaaatttattaggcgagaatttcctcttcctaataagcctgggagcgctatgggagactggggtttatttcatccctacagtttcgaccatagaagacggccacacccaagggggccattttagagacccaccctcaggggtgcattcaccaatgaagatttattatcataatgatacttaggctcagtttagtttctgtatattgtgaataaaggtgcagtgaatatttttaagcaggctttgtgtgaacctatgttttaatttcttttggattaatagctgggagtggaattgttgagtcatagggaaggtgtatgcttagtttcatttaaaattgcctcagttcaggagaatggcgtgaacccaggaggcggagcttgcagtgagccgagatcgtgccaccgcactccagcctgggcgacagagcaagactctgtctcaaaaaaaaaaattgcctcagttttctcaaaatggttatatcattttatattcccatcaatcaagtatgacagttccagttgttctataattactccaatatttgatgtcagtcttttaaattttaaccattctagtggttttattgtagtatctcaatgtgcttttaatttgcatttccctgatgactagtgatgtcgagcccttttcatgtgcttattggacatttgtgtattttcttttgtgaggagtctgttaaaatcttgtgcctatatgtcaattgggttgtttgtatttttattgttgagctgtagtaattccttttatatcttggataccagttttttgtcagatgtatgtattgtgaatatcttctttcagtctctggcttgcttattcatattaataattgtatattttgatgagttatttatccactttttgtggtttttcctgtctttgccctgtccaaaaaatcctgcttaatctcaagtcatgttttgttttttatatgtttgtttataaaggttttttcctctgtgttcctgtaaaagttttgtaggtttttatgttttatgtttctaatccatgaccttttatgttttaatcgatgatctttctcaaataatttttgcacttagtaatgaagtagggattcaggctcatttttttccaatagggatatccagtattccagtaccatttttggaatatgttttttccctattggattgctttggcacctttgttgaaaatcaagtacactatctctattctgtttcattgatttatttgctgattcttaagatgataccacaccgtcttaattactgtacctttataataagtctggaagtcaagtttgtggccaacccacatcccaagattatgcagaagatctaataaagaaaagcaagcttttaactaaattataatcaatgccttcatctttataatatgaataatgattcacttggagcattttcagcttgtttatctgaaccattaaagtcattttaaagtcagtttaaagtcattaccatttcctgggaaaattgctctaataatttgtataatttgaagcataatccttaggaatatttagacctagcattaggtaatgtttcctggaactcttggtcaaacttgggctttcaggaccactgcactagttttgcactgctcagctccagggaaccatttacactggcatagttgctagaaaggtaaataaaagcaagaaagaagttagaacagagtggaaagaagttagaacagagtggaaagatgaggaaagagataaaagaaatatttgtggtataacgtggtaggtcgtcatgtgtctggtatcttttagatagactagtaaggttagtttcaatcacttattttaattgtatcaaaaaagtaaagcagataaaagtagagctttctggctaaagtatatgtgtataagatcaccgcagatcatccccttcacacctcctcttttatcacccacagtccctaaagctgaaatccagcatatagtaaggttgttacattgcatattgcagtttggacatttataaattatggaggcaaaaaagtggtgtgcttttttgccaaagtggaaactatgtgtttataattctttgagcttttttgacactaaagcagttgtctcatgggtatagcatctccaatcaatttcgaccattgggaatcctgtgtataagatagatttatgtaagaacattatatatattgaggttgctaacatgtgtctagttaaaaatgtaatgaataaactacaattttatatatacacttacatagttttttatttctccatttgttccagtttctttccatgttctgttaactaatagatgctcaaaaagttaattatcagcatgattgcctcaatcagaaactatgactttttcctaacttaggaagagagagaatagttgcttggataatagttttctactgttgtggttagtcctgaggcctccatcttggcaggaataatttatgctaataagaaataggttgatgataaatatcaagtataacctcatgtcaacaagaggcgaagcagcaaattgccaggttgttgctatttttattaagatcaaagctcattggttgacgatatgcatataagacatatcctggactctttctgcctgtaaagaattctgcacctccatcttccagacctgtttattaaatctctttctcacccatgcttccactgatttctgtaagatggagctaattaaaggacagttttttttttgtcatgacaagagcataaagtgacagtagattttgagtagtatataaatggaagctgctttggaaataattgctatatttgagtgacgagtattgagaaaacactactagctttaatatttgaggaagtcatatgttttctaaatattaatcactagcctgttgcatagaactggagcttttgaatttgggaaggtctgtggtggcagtggtacattttttcccaccattggtatctgattttatgtaatcagtgtttgataataaaaaacattattaagactgcatttttttttctgttggttacaaatgaaacagccagaactgtagcattccttgtttttgtgatcctactaaactatggttttcctgatttctgctcatgttggaaaataccatgggaactttcatgcagaacacttgccttactgaaaatggtagcagagcttcttctttgctgcctgtgaagtaaagatcatattagctctttctattgtgagttccagatgctttgatgatcagccagtaattgtgttagaaatgcacaggaaatggttgatccacttggtgtaaaggcaaaaaccaatttcttcttactgcctgtcagcaggcaacagggaggcctatggcatgttagtgcatttttacactggcatagagccctggagttagacttactgagtcttaaatgcacttcgaacacaggttttgactgcttcataggagacattccagacatatttatgctcagcacaactctgaagtttttattcttattatcatggtactgtggtctttttgtttgcttcttttatctgtgatgttagtacttttccaaggccaagttaaaacaaataactacagttaagttcaacttgtgttaatctgtttacatttatggaacagctttgctgcaatctggagaaagataatgaaacacaggatacgtctgtacatgcctggtagaatggaaagctgcagtactgtcaataggccatcaataaagatattcttaccataaaattaaggttcatcttatttcccagttttctttttacagtaaggctatatctgttgattaactcatttatctggaagtaaatcattctaaatgatactggacattttcataacatccagaaataaattctagcttaaaatctgatgattttattatgttactcatgttttttacttcaccattctcgaccactaatttttagttggaagtcttggataatttcttccagtgaaattagttagtaatggaaggaatgtggcatttgaaagcaaaagatggagttcaagtgttagcctacggtgctattctaatctaaatattcatttaagccttctaaacctcagtttctatatctgaaaacataggtaaatattcctgcatacatcagagcattattactgagaggaccagataagtatatgtcatattatttataaattgcaaagaaatatacaaatgttcatcatcatttttgttgtttgcaatgcttttaactcaagcttcttaacacatcaatcccatgtatataattccttatgtgccaggttagatataataatataacttgagaatgtatatttcattttatttttgaaaatatacgtatcttaagattttcttcccaaggtttcatattataaatgaataacaatcatgactgcagaagaaatttaattataagcactgtccatctctccccattcccaaagtaaaataactgctttcagtttgaataggtaaattaaatgtttctctgctccttctattatagcttttaagaaacagtattaaatgattccttgagttgatttcactttaagattattttaatccattactcatttgagtttgcatcattgaattttctttatcaaggacgtaagcaggttaaatgtgtattggggaaatgtcttaaatgtcagtactatggtctggctgccttgtgagtacctcatcattggaggtgttaataaggtgtgactggatggctagaaatattttaggtggatatcatacatcatgtagagctgaagactggaaaactgctaattctatgctgtgatccttacttatgtttattttccaatttagatgattaacagatacaaatagttatttccttcaaacattgcttgtttcacttcaaaactttgggaatgcatgctacggaaaaatctacttcagtagcatgtgaaaaaatacatcttatttgccttaccatcagttttctaagcattttttttctcttttgaatactcataatattttatgtttgtcttataccatttatctcattctatctaataaatactaacttgtttatttctcttattgtccttattgggttttaaagttcttctggggagatatttaacaatctccgtataccccacatgagctatacagagccaacactatataaaataaagttatcaaatttcatttattgtcattagtgcctaaaacttggggaaaagttgctattgaataaaatagcgtacacttggtttctttcttatctgccagtcacagaatctactcttagcaaatgtcattctgatttagagtaattttctaatatagaaatctcatttacccaaataccattaaaattatctaataaggtaacgatttttaaaaggtcccatttcactatttccaaatggtatccaaaagtacttgtaaataaaaaatttaccctaagtgagctgtaggcatagcttccccatccaaaacataaagttatagaggctaatctcacgaacttttctgtggatttttaaggttaaactactggtaaagaagcaattggtaatttgttcagactggatgccagaatagctccgttgtctgttagctgatgtctttgaatctttgggctcactttttatcaatgtgagtttatgagaagccttaaactctggcatacttcaaagtctggtaactttttttaggcctctcacctcctttctgcaacctttcttaactctcacattagggggaaaaaacatatgggatctcaaaaaaactaagtaagcatattttattgtttatcttaaaaaatgcatttttttaaatcaaggaaaatcattaactacatcagtatcgatgaattacatgttgtagtcatcatattttaatgagtcttctctaatatttttagttctgagtttgtagaaagtggcagatgctgttctggttaaaaggctttccaactgattaacgtgttcatccctaatttaattttttaagaaagacacttatgacagcgagaagaaaacgtttcatcttcataggaaatctggcaaaatatcttggcttttgctcaaaatttgaaagcaaatgggaatcagtttcaaatattggaaaagtcaagaaaacgattctagctctggctctgtcattggctctctatttcttcatgtataaaatgatggaaatagattaatttctaatacctctttcaactccactaacattcttttattgatagcatttgttagggagaaataacaagatttgtttatggattgtgataggatatcaataagggggtataacaaagatacctaaaattttcatccttggactagtaaagaatggtcagtccacaaaaacaaaataggggttttgtgttaagggtagccaggtcgaagataacttctgttttgaaatgttaaaggaatatcttctacaagtttatgagactcatgggagtggccattgcatggtaatatggcatagtattatattgtttacatacaatttaaaaagtacaggtagtactgaaaaacatctgttcctgtcctcatcccttttgactcctagatcagtttttccagggcaaaagttgcaaataatttttgctttatcaacattttttattaacttcatgctatgatagatgatgtactctttgtgctacttcccttatccctcttccaccatctcctcccaatgtgttactgtttttaattaaatcaataagcaatgtttacattattttgaatatgtacatattataaatatgttgcttattgtattgtcaggtaatactctatggttctatttctttttatcttttccctatagtttctaattacatttcttttattcctgtaatacatttcttatactatttgggtttttcttaatgctccatgatatccactttcctcactttttccctgagagactacactgggaaccaaattgtcagtggtctttttttattttctgattttgtttatggtacataaaaatagaattcactttaacatattggtttcatatccagcaactttgctaaaattcattaattctaatttctttgtagattcttttgaattttctctgtatgcaatcatatcacctgtgaataacatttttgtttcttttttttaaacaaactttttcttttctttcaataatggctaggccctaggttaaatccaactttatcacattttatttaatatttttgcatctgtattcattggtaagattggcctgtaatttttctttcagactcagttctgtttaggtttgatataatggttatgctaggtttatctctcctcttctgttttctggaagagtttggttaggtttaatgctttttgttctagcttaattacattatggttagagatcatgttctgtacaaattccatccttcgagatttgtttagacaagccttaaggtccagtatatggttagtttttataaatatcccggatgtgcctgatataaatgtgtgtctttcatttcatgaggcattgtattatatatgtccattagaacacgtttcttagtcatgttcaaatctttctacatttttacagtttattttctttacatgttcaatcagccattagaggtctgtttaaaatctccgactctgattgtggatttgtttatttcaatttgtttatttcaatttattttaatatcttccttgggaaccaaaccttttatcattctgaagtggccttgtttcagcttttgcaacacttgtgcctcaaaatctactttgactgaaattaatacagctatactagcttcttttggttattatttgtgtatgacttttaaaatttttaattccaacctttctgtgtaactgtatgtttttgatatctctgatgaatggctcaaatgttgaaatttgcccctgtttttgcagtctgaaggtatttgtctctagaatgtttctcaatgtacttacctaactttttagtaaccagattttcaaaaaatttaaagacgatataatgaacaccattgtatattcatctagattcaacacttgttagtattttgccatatttgtttgtctcttgctttccagggtatctatgtgtgtgcatgtgtttaatgattatgtaagtatatgtgtgtttatacacattttgctaagccatttaaaagtaagttgcagaaatcagacactttatatgcataaatacctgagcatgcatcatgcctcacctaaggaaacataaacatgacataattatcaaacataagaaaatcaacagcaatcttaaagtgttatttaatattcaagtcataaacaaatttccctaatggtcctaaaaagtctttcatagctgttcatgtactgcatttatttattctcttacaaatttgaatatctagaatgcgttggaggaaaattttccgtggatctttcatgtctctgtacatcctgagaagagaggcattgtcattgttctgaactctcttttcaaggatctgttataatgaataactcggaaaattgagatagtatctcactttggaggaaaggccaggtttgtctaccttctagtacaataaagatattaaaaatatctctgggcaaagataaagcaagcttactgcccactataaaatatatggattccctaaacacccagtttttcttctataacctattgcactgcatgtgaaggcatcaccttgtctgctttacatcaccttgtgggaattggggctcgcggaaacccagggtattactgtaaataataaattagttgttgtctctgattaagaagtcttgtagcgtttgctggtgtctataaaactatggcaaggctaacttgttaactttcaagcatagaaaagtcttagtcccttcacggttcttgacagaatggtcttcccactttttacttcattgcactgattttttttaacagcttcattgagatataatttacataccatacattttacccatttaaagttctcagtaattttagaatatttacagtagggcaagcatcaccaaaatcaattttagattttttatcaacccaaaaagaaacctcatgtctcttagctgtcacgttccatggcagcccagccccccagccctaggaaaccatcaatctacttgtcactataggtttgtctattctgaacatttcatagaagtaaaatcatgcaacgtgtggtattttttgtctggcttctttcacttagcataatgttttcaaggttcatccatgctgtagcataaatcggtacttcattcctctttattgccaaataatattatattgtatgcatatactacattttgtttttcagttcattttttcatggacatttaggttgttttatacttttttgactcttataaataatgatgctatgaacattcatgtacagatttttgcatagacatgtttctgttttatacctaagagtggaattgctggatcacgtttactttgtttaggaactgcccgacttttataaagtggttactccattttgcattcccactagcaatgtaggagagtttcagtttctccacatcctcaataatacctgttattgtctgtcttgattatagctatctagtgtgcgtgaagtggtatttcattgtggttttgattttcttttcatttccctgattattaacgatgttgagcatatatttatgtacaataagcccataaaaagatatatatatattttgaaaaatgtctattcaaatcttttgcccattataaattgtattatttgctttctagtacattataagaattctttatatattcttgatatgattctcctgtaaggtatatgattggcaaatacattttcccattctgtaggttgtcttttcactttcttggtagtgtcctttgaagctcaaacttttacaattttgataaaattgtttttaactttttttgttacttgtactgttgctataatatctaagaaggctttgactaaacaaaggtaaaaaaaaattactttttttttttttttgagacagagtcttgctctgtcacccatgctggagttcactggctcaatcttggctcactgcaacctccgcctcccgggttcaagtgattctcctgcctcagcctcctgagtagctggaattacaggtgcgcgtgccaccatgccctaatttttgtatttttagtagagatggggtttcaccatgttggccaggctggtcttgaactcctgacctcaggtgacctgccttcctcagcctcccaaagtgctgggattacaggcatgagccaccctccccggcccaagaatatttagctctgtgttttcttctaagagttttatagttttagttcttgtgtttaatctttgatctgttttaagttaatttctatgtatagtgtgtagaagaggtccaagtttattcatttgcatataggtatccagttgttccagcagtgtttgttgtaatactattccttccctcagtgaatgtccttggcacctttgtcaaaaatctattcaccatagatgtatgggtttatttttgtaatctcaattctgtcccattgatctacacgtctgtccttttgccagtaccacactggtttgattattgtaggtttgtagcaaattttgaaattggaaagtgtaaatccttcagctttgttctttaaatattattttggcctttggggttccttgcaattccctatgaatttcatgtcagttttatgatcagcttttccatttctgcaaagagggcggttggaatttttataaggattgccttgaaggtgcagaaaaatgtagggagcattatcatcttagcaatattaagtcttctgatccatgaacatgggataattttttatttagttaggttttctctaaattctgtcaacaatgatttgtagtttttcagagtaaaaatttttcatttcttaagtttattcctaagaattttatcattttcatgcagttgtaaatggattttttcacttaactttatgctagtctataggaatacaattgatttttatatagtgatcttgtaccatgtgaccttgctaaattcatttatttgctctaataggattttctgtttacaagactgtgtcttatgcaaagagatagggctttacttccttctttttgatatggatggtttgtgatgtgattatttcacattgcatgcctgtatcaaaacatctcatataccccataaatacataaacctactatgtacccacaaaaaattaaaaatgaaaaaatttgcatagggattgttaatttccttgtgtaattgccctacatagaacctgtaggattatgtggaaaagaaatgacagagtggacattcttgtcttgttcctggtcttatagggaaatgatttagtcttttaccattaagtatagcgttagctgtgggttttttgtagatgcccttatcaagttgaggaatttccctgttattctgatcttaatagtaatgtcctctcttttatttctgattttaatttgagtcttctcttttcttggtggtttgacaatttttttgagcttttctgagaaccagcttttgatcttgttgattttccctattcattttttattgttcatttcattaatttcagctcaaatctttattatttccttctttctacttgttttggggttacttcgctctctttttctgatgttttacattgaaatgttagtttatgatttggcatcttttttaatataggcagttactgctgcaaatttatctctaatcactgctttaaatgagtcccatatgttttggtattgtgtggttttattttcactcacctcaaaatatttctaataaaccttgtcatttgttctttgacctataggttaattaaaagtgaaatatttcttttctttatacttgttgatatcctgtttatttctgttattgatttctaattttattccattgtggttggaaaacatgctttgtgtaattgcaatacttttaagtttattgatgtttgttttatggcctagcatatgatctatcctggagaatgttctatgcattcttgagaaaaaggtatattctactgtaattgggcagagtgttgaatagatgtgtcttaaatgcagttggtttatagtgttgttcaagtcctctatttccttgttgatcttctgtctctcactgttccactgattattaaaagtggagtattgaagtccccaactatttttgaattgtctatttcttactttgattcagccagtttttgtttcatgtatcttggtgttctgttgttagatgtatctgtgtttataattgacatggcatcctgtagaattgacccttttatcattataaaattcctctctctatctctagactttttttgttttagaatatattttatctgttattagcacatctactctagcttccttaaggttgctgttagcatgactgtatttttcaatccttgtagtttcaacctttttgtatgttttaatctaatgtgttctgtagctgccattggatcttgatttttttatgaagtctgccaatctctgatttttgtttggcttgtttaatccatgcacattcaatgttattattgatatagttggatttttgtccgtaatttcactttttgttttctatgtatctcatggttttttgttgttgttcttatgttcctcctttactgccttctttttttttattaagtgaatattttctagtttaatattgcagtttctttaatgattttatttaatgtatttttatttgtttttcttaatggttgcttaccacgtaaattataacctattagagtttacttaagatttatagagttctctattcttactgtcttctcttactctaggcaaaattgctgatactgttccagagctgggagcgggaacactgttccccttcttttggagtaacacacctgctttattagcagggcactaagcaggaagaatagcctttgatcttcctggcttgcctctttcagcatcatcttctgttctatgagcaagttagagtgagggcaaccagatcaaatactcctgggctgctgtgcctggctggagtagagcttttgccttatgagttagggctgtgtggaggacaagagtctaagaactctcagctactctcacttggaacagagcttctataacaggacacacacggtaggggaagatcagaaatgctgatgacttgttccttcctgtgagatactgtagtgcttaactgggagctgggaggagaaggagccctggtttatggatgcacctaccttgggtgaagcctttgtgaagctgagcaagggaggtggagaaggaaggagcaggtcataatgccatagatacctgttgtacatatcaagatttaacacatattgttgaacgtttgttcattggctgtatgttcgtaggacaatatccagatacttgagtttttaaaacataaatttccccacttatcattgttttgctagggagatggtccacagaggtcctcacactgccattcacaaagtcatctctcccatggcatggcattgactttttccctttccttttcctctttctttcttcctttctttctttctctttctttcttctttccttctttctttctttctctcgctctcccttccttccttccctccctccttcctttcctccctccctccctccctccctcctttctttctttctttctttctttctttctttctttctttctttctttctttctttctttctttcttctttctttctttctttctttctttctttctttctttctttctttctttctttctttctttcttcctcctcctcctccttcttcttcttttcttttcttttcctttcctttcttctttttttttgacagggtcttgctctgttgcacatactggagtgcagtggaacaatcatggctcactgcagccttaatctcataggctcaagtgatcctccctcctcagtctcctgagtagctaagactacaggtgcatgtcaccatggctggttgatgtttaattttttttgtagagatagggatctcatcttgtgtcccaggctggatgtgaactcccaggctcaagtggtcctcccaccttggcctcccaaagtgctgggattacaggaatgagtcaccacacccagctggcattgactttttgaagagtccgtgctagttgttttttataatgtaccttattccaaatttgtcccatgttgtgtcgatttacacttaattacacttaatgtaattactgatatatttgttttatttgtcttgcattttaaggtatcactttctctgtctgcctctctttcgtcttcttttggatgtattaagtattgtgcccctcaattactttgggattaatactctatttatcttttttaaaggtttaccctagaagtgacaatttctaggttgtatatgtatcaaagtccaaagtaatcaatatccttaccagttttctatacaattacaaagaccttaagaatgctttaacttctttcaccctatctcacttacatcatattaccaatgtgtatttctttcaattctatattttaaatgccacagtatgaaagagatgcatgttgcctacccaccagcccaagctgaggctaccaaggcagccccactctttccagtggcagagtctcagcatggctgctaccacccctcacctgaacactccacctggatactgaatattaccctacccccacctaacagagctggtgcttgcactcaccattggggtcctgagcacaagccgcagagccgagcttctgctctgagagagaacacatagcctgaggtcctggggattatctaacccaatccaccaccgtgggccccagtcctcctgggggcctgaggttgggcctaaactcccaaccactaccacttcagctggtacctgcctgcaagcaccacatatgggcctggacatgggcctacccagcccattgcagctactatcaacgtcagtgcacactgctcaagacccagacaattgtccgtccactgctactgccatcacccacaccatgccagctgcccagggactgaagaacctgctcacccacctggtccactgctggcattatcagcatccaagcaagacacctggaggcctaagaataggcccactgacaacagccaacaccagtgccagtgtaaaatgctctagggcacaaagatatgcatgctcagcccactggtgccaccaccgcagccttaagactagcacacctgttgttccagtccccagcacaacttcaccacagccttcactaataaccataccctaacacaccaaggaaaccataaacaccactaatgctgtttacagccaaagaaatcacacagagactatagcactatgaacagaatcaaagtcaaagtaccatacacagccaatatcttagatacatcttcagaaaaatatccttccctatgaaagtaaattcaaaaataggaagaaatgattgttacaccagatgcacagttaccaacacaaggacacaagaaatatgaaaaagcaaggaaatatgacacttgcaaaggaacacaataattctacaacaatagatcttaatcaaaaagacacttttgaaattccagagaaagaattcaaaatattgattttaaagaagctgggtgagatataagataattccgaaaaacaatacaaagaaatcaaaacacagttaaggataagaatgaacaatattactaaagagataagtatttttaaaaagaaccaaatagattaggtggaataaagaacctcaaaacttgaagtcagttctttttaaataaaccagtcaggtaggaataaagaaataagaattttaaaaagaatgagcgaagctttgtgtcatttgggacaacataaattgatcaaatcttaaaaattattgttagccccaaggatgaagagacaaagaaaggattagaaaacctatttaaagaataggtgaaaacttcccaagtctagtgagagatttacataatcagatacaggaggctcagtgatccctaggtagatataatgcaaagaaatcttctccatgacacattatagtcagaaagtctaaagtcaaatataaagagcaaatcctgaaaacagtaagagaaaagtgtctagtcacttctaaatgaaaccctatcaaattaacagtggattgctcagcagaaccttacaggccagaagagaaagggaataaatatattcgaagtgctgaaagaaaaaaattgccagccaagaatactacatccctcaaaattatccttcatcaatgaagaagaaataaaaaatctttcacagataagcaaatgctgagggaattctttatgactagactgaccctacaagaaatgctcaagtgagtcctaaacctggaagcaaaaggacaatatttaagatcatgaaagaacatgaaagtataaaactcacagataaaccagtcaatcaaagaaggaaaagaaaggactgaagcggtaacactatagcaatctaccaaacctcaaaaacaattaaaaagagaaaaagaaataaacaaagaatatataaaacaaccagaaaaccattaacaaaattacagaaacagagcttcacatattaataataaccttgaatgtaaatggattatattttccacttaaaatatattaaatggctgaatgaatttttaaaaaaacatgatgcaactatatgccatgtataagaaactcaccctaacagtaaagacacatatagactgaaagtaaagggatggcaaaagatattccatacaaatgggaaatagtagtaagcaggaatagctatacctatatcagataaaagagagtttaagtcaagaacagttaaaaaaaaaaggcagagaaggtcattatgtaatgataaatggaacaatccagcaagaagatacgacaactccaaatatatatgcaccccatactgtagcttccagattcataaagcaaatattccaaagagagaaatagatgacaatacaatcaaagtgggggtttcaacactccactctcagcatttagacacatcatctagacagaaaatcaacaaagaaacattgggtataaatagggcttcagacccaataaacctaacagacatttacaaaacatcctacccaacaactgcaggttatacatcctgcagttatacatggaccattctccaggatagatcatgtgttaggtcacaatataagtctcaacaaattttaaaaattgaaataatatcagttttcttttcagaccactttggaataaaactagaaatcaatacaaagaggaagattggaaactctgaaaatacatggaaattaaataacatgctcctgagtggccactgggtcaatgaagaaattatgatggaaatttaaaaatttatttgacaaatgggatctaattaaactaaagagcttctgcacagcaaaagaaactaccatcagagtgaacaggcaacctacaaaatgggagaaaattttcgcaacctactcatctgacaaagggctaatatacagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattcgacccagccatcatcccattactaggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagctcatgtcctttgtggggacatggatgaaattggaaatcatcattctcagtaaactatctcaaggacaaaaaaccaagcaccacatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtacacatatgtaactaacctgcacattgtgcacatgtaccctaaaacttaaagtataataataatgaaataaataaataaaaaataaaataaataaataaataaaaatttattgaaatgaaaatgtaaacacaacatacatattcagcaaaaatagtgctatgagagaagtttatagcaataaatgcctacattaaaaacgtagaaaaataaaaatttaacaatctagcaatgcacctcaaggaactagaaaagcaagaacaaaccaaatcgaaagttagcagaagaaaaaaaatagcaaagatcagagcagaactaaacagagactacaaaagcaaacataagggcccaacaaaatgtaaaactgcttctttgaaaagatacacaaaatttgtaaactgctagctagtctaaccaagaaaagacccaaataaaatcagaaatgaaaaaaagacactacaattgatatcacaaaaatacacaagatcatcagagattattatggacaactatacactgacacactggaaatcctagaagaaatggataaattcctggaaacatactacttaccaagattgaatcaggaagaaatagaaaacctgaacagaccaataatgagtagtgagattgaatcagtaataaaaattctccctacgaagaaaagcccaggaccagatggatacacagccaaattctaacaatcgtacaagacagaaataataccaatcctcctgaaactattccagaaaatccaagggtaggaaattctccctaattcattcctcgaggacagcatcaccctgatatgaaaatcagacaaggattcaaccaaaaaagaaaactgctggcaaatatccctggtgaagattgattgaaaaacaatttaaaaaatactagcaaatccaattcaacagtacgtcaaaaatataatacacatgggtccattgggattgaaggcaaggaaggcacaacctttgcaaatcaataaatgtgatacattacatcaacagattgaaggacaaaacaatatgaccatctcaatagatgcagaaaaggcatttgataaaatttaacatcccttcgtgattgaaactctcaacaaactaggcatagaaggaatataccgtagcataataaaggccatatacttcaaatccactgcaaacatcatattaaatgaagaaaagctgaaatcctttcctctaaaaactggaacaagacaaggatgttgactttcaccactcctattcaacatagtactggaggtcctattaagagcaatcaagcaagtgaaaaataaaaaaggcatccaaatgggaaaagaagcagtcaaattgcccctctttaccgatatatctatctagagaagcttaaagaatgaattcagtgaagttgcaggatacaaaatcaatgtacaagaatcagtagcctttctacacaccgataatgatctaaccaggaaagaaagaaagaaagcaattccatttacatttggtaaaataagtaaaatacataggaataaatttaaccaaggaggattgattctacaaggaaacctacaaaacactgttgaaagaaatgcaggtgatagaaacaaatggaaaaatattttatactcatggatcagaagaattaatattgttaaagtcatcgtattgcccaaaggaatctatacattcaacataatcgctatcaaaatgccaatgcaattttttcacagaattagaaaacaaatcctaaaatgtatatgaaaccaaaaaagagcctgaatagccaatgcaaccctgacctaaaaacaaagctggaggcatcacattacctgacttcaaaatatattacaaggctgtagtaacccaaactgcattatattgttatgaaaatatagaccaatggaacagaatagagaacccagaaataaagccacatcttcatagccaattgatcttcaacaaagctgacaagagcttacactggggaaaggtaatcctcttcattaaatggtgctggaaaaattggatagccacatgtagaagaatgaaactggacccgtatttctcaccatatacaaaaattaactcaggatggattaaagacttaaatcttcttttgcacaggaaaagaaactatcaacagagtaaacagacaacctacagaatgggagaaaatattcgtgaactgtgcatccaacaaaggtctaatatccagaatctacaaggaacttaagcaattcaacaagctaaaattttatgtaaatataagacctgaaaatataaaactactagaagaaattccaggggaaaactctcctggacattggtctaggcaaagaatttgactaagacctcaaaagcacaggcaacaaaaacaaaaatagccaaatggggctatattaaataaaaagcttctgaacagcaaacgaagcaatcaacagagggaataaacaacttgttgaatgggagacaatttttgcaaagtatttatctgacaggggactaatattgagaatacaaaaggaactcaaacaacaggaaaaaacaaacaaaacaaaataaaactccaattaatcccgtttaaagtaagcaaaagacctgaatagacatttctcataaaaaagacatacaaatggtatatgtaaaatgctcaacatcgctaatcatcagagaaatgcagatgaaaaccacaatgagatatcatcttatcccagtcaaaatggctattaataaaaagacaaaaaacaacagatgttggcaaggataaaaaaaataagggaactcttatatgctgttgtgaacataatctagtacagccaccagaaaactgtatggatatttaaaagaaagagagaaagagaaagagagagagagaaagagaaagaaagaaagaaagaaactaaacatagcatcaccatacaacccagcaattccactactaggtatctatccaaaggtaaagaaatcaatatatcaaagaaatacctacacttgcctgtttattgcagcagtattcataatcacaaagatatgcaattaacctaagtgtgtatcaacaggtgaatggataaagaaaatgtggtacatatacagaatggaatactacttagccataaaaactagtgaaatcatgtcatttgcagcaacatggatggaactcgatgtcattctcttaagtgaaataagccagccacagattgacaaatattgcatgttctcacttgtatgtgggagctaaaaaattgaccatatggaggtagacagtggaaagacagagaacagagactgggaagggtaagtgtcaaggagggggaggatgaagagaactgggttcttagcatattaaagatgtcattccgtggtcttctggctttgattattgcttctgagaactaatctgtaaattaattttcactctcttgaaggcggtctgtcttgtcttttttgatgcttttaaggcctttcctttacttttatgttatgcagttatgttctgctgcacctagtttcaggttttatttttatgccattgaatctgtttggtttcttgaatcacaaatatctgtagatttttcttgagaaatcttagccgttgtctctttagtattgtctttattccctctctcacctcttctagaatcccaatttcctttatgttattcttcctcactctttcttccatgtctcttaatgattatttcacagtttccatgttttatctctatgccacattatatataatttctttttagctttactaagtcttttaactttatactgtctctcttcagctctatctagtctgttgtgaagcccatccattgagttttaaatttcaattactatagcttttacttctagaatttatattttatttcgattgagctatgtcattttcatacaattgctggctccctttattatttttaagttagaaaaattcttctataattgtaaagatagttactatatattttttatctgataattccaatgtgtgaaatatttagtgagtactttctgttgtcatatgtttcttttggcttttgcttatggttttttttcttgtatgcttaatggtttttaattaggaaatctcatcttcctttaaaaaaatgatacattagaattatttgaagtttactatgaaggcatgttttttctacgtagagtcagtatgtatttttgcccagcctctagaaggtcaatgcagtcagagtccactcaggtaatgctaatttggattgcaaatctggccagtttgtggtgagttttttaagggttttttttcctgtacttctctgctaagcaccaagagatcttttcttccacctccctgggtgtgggattgtgaggtacatttatgcgtggtacacccttatagtaaaagaaattataaaacaaaacccaaaaattatccaagtttggcatatgtcctccgggaaaaagtagtttcattgatcagttcattttttggttttccctagattttgatttgataaatcctactgtgcttccctttgatgcttttaggaagaagtttttacttttttccaagcattttttttttaagtaagcatttcagtctggatacctaactggccacattattggaatatttcttatttctctctgccattattttgtagtatgtgtctccttggaacacctgaatcaaaattacttagagatgtttattaaaatttcagattctgctattcaacttcagcttactggaagaatctttacgatgggttgctggtatgtaaatttttgtgaggttctttaggtgaccctaattcatacagaatttgtttttatttgtacttttaagtctaatatctgctgttttaattgtagcagcatgagatctaaatttattattttttatatttattctagcaccatatgttgaaaaattcattgttttcacatctatttgacgtcaacttttatcatatagtagttgtgtgtgtgtgtgtgtgtgtgcacgtgcttgcatgtgtaaatctgtttctggccttcctatttttgttaactgaataccatactattttaattattgtagtgttgtgatgtgttttactgtgtgataatacaaaactttccttactcatttattactttctcccacaataaaaatttaaaatattactgtagtttcatcattttcttgcttctttcatcttcagtgatttcgaaaaattagtttttttcatatgaacttagccttttagactgaggtacttaatgttcattttacttctttgccccaatcaattttgtattttaatcatgcttagcatggcaatttttcctctaggtagctttctgtctatccttccaagttgaagtccaggtattcactttctccacagagcctttgtcaatactttcaggctcaagggaactgtttttcttaactttgatagcaattattgactataccactcatttttacctggcaaatcctacagaatcacagagagtgaaatctggaagctacctaaggagatcatattgtctatgtatgccattttacaaatgagaaaacagccaaagagtatggaaatgatttgtccatggtcaaatgtttcaacttctgaagtaaaattatgatataccgctgtatcattattccattgtattttgatattcttttcatatgtcctgaaaatacccagttacttaaaaaataaaatacctagttacttaaaaaaacaaaaaacctagactggaagttccttaaaggtagcacctgcatgtacttttgtacaactcatagaactattattgtgcttgtgtttattagacacctaatcaatattaatagatgttggtaaaaaaacaaattgttccattaaccagatgtcaaactggggctatctccttgtgggcgccactgttataactgtatagaaagtggcatctagtggttggtgtgcgtattacaattgcctgttttgttttaacctatgagtaccagagtcattctcataacctaggtggaataaatagactataaattaaaattttaaattgaatttaaacacatttatctataattcacaactgttttaatctgtgctctctctaaagtaaagctacatgttaataaaaaattgcaaaaaattatacaaaattacttgtaaaatgacatgcgagagtatttaaggttttgcttgtttataaattatattaggagttaggggctatcgttggatactgagaagtcaaaatgcaattataaagaaaggtcacatagaaacttgttcatatcaatgaaatcctgtcaggttattgctttgcattatttttaggagcttaatttgtatttaaaagaagaagatctctcaataaaggctgaagatggaaagctacactgtcttctactcgcaacaacaaaaacccatgcacatatattcacatataaagttcagacatgcatttcagtgtcaaatgttaattattcttacattaacagccatttggggttatcactactctttacctctccattaatgcatgagtgttgacaatatgcacaatttaattcagggactacgactgttgacagttactgtcttgtgaacttgtgaatcagtatcttcttgtgaaacggtatcttctaaattttataaaatccatagtctggaacttaaaatttatgtttgcagaaaaatattatatatttttaattaacctctgtttcctgcacattgtaatataattttttgtagatgggttcatccttcccattagagagcaatgatgtactttgtacttctacttgcacctaacataacatagtggctgtcacataacaggtgatcaataagtatttcttgaattagttacacatgttggagggagctgtgtgttactcatcttagaagtctagtgcctaacaatttttctgtcctctagtaatattcaattcatatttgatgaatgagtaagtctgaataagcctatttaatctgtagtgtagttagcgtaaaatactaaaatcagtatataacccccaaacatctatgaataataaataatagcggcatagcagactttctgtttgacgtgtcaggagcacagctttcactggagcagcctcttgtagtgtgagtgagagattactgcaacatcaagccattgtagtttgctcttataatcaggaaaagaggtttcagtatgaaggtgacttttagttgcagctgagtgagttaggagttctgaccagaaggataaggtcagtactttcaaaagggttgaggagggtactttggtagtgactagagtaaaggaaatcatggaatgttgagcagcaggctaaggtattttatatcaaaggccctcaagattgatgggcattatttggtatttatgtcacatgaaggtttcagtaactcagtctggtatctatctgatgaaaagaatgccacctccttgtaagtaaacactgagctatccatgtatattaaactaacttgtttttctaagcagttcattttctaagagtaaaggatagtactgaatggcagaagtcacatactgtattcttttcctctataggttttctattttggaggaggatatttttctggcttgaggacctcaattcctaatatgattgaatgcctgtttagaacatctagactgtgggagcagcatttatggtaaagctgttagagactgagctattattagtgatgaaggagtaggagcaaagaaaagaaagaaaggtggtaaaagatagtgttatatattttatgctccatgattgctcatgaatggagagaaacaagtgacttgaagtggtaggcattgttgtctagttgccaaggtcattgctaatacagagtgagaggtaattttttacaagcaatgttagaagaaaaaaaggagagttcctgagagtttggacatgtggcaaatcatattacagggaagttgtatgaatttcttttccatttttaacatattttagattgtgcatactgtcaacactcatgcattaatgaagaggtaaagggtagtgataaccccaaatggctgttaatgtaagaataattaactttgaaatgtatgtctgtactttatatgtgaatatatgtgcatgggtttttgttgttgtaagtagaagatggtgtagctttccatctttagcctttattgagagatatctcatttttaatgtcttgtaaaatgatatttttcactttaaaattataaaaattatgtttgctcattttgaaaagttaagacagaagtgtatataataaaaggtgcaagcttcctgagaggtaactgttatttgcaatttcgtatatcttttcagatatttttctggtatctatctttcaagtttggattgttgatttcagttgagctgtaagtcagagtctgatttttgggttcatatttaatgattttttccctctttctcttccttataggcttgctatgggtgttctccaggatcaaagtgtgactgcagtggcataaaaggggaaaaggtgaggtcttagattggcatttgaaaatttagtaaagccagtaaactaatggttttaataaatatttttttaaaaacagagcttctatctcagtacttaagtaagtgaaatgaatcctattgcattgcttattttagagagcttataaggattagattatatcttaaggtcagcaaagattttctgtaaaaggccatatagcaaacattttaggatttatgggacacatcagtttctgtcacatattcttatttatataaatagaactttaaaagtgactaaaaaatattcttagctcttggatcatagaacatgagcctcttgggatctggatcaggacctctttcccgtaacatatttctggcgaccacagaagggactatagtgcagaaaccctagcttaatggctacctttgggtaagtgttggggtcctttaatatctgcatttggcctgagagctataatctgccaaactctgattggtcttgttgaaggcactgacttacttaataggcaaagacaggggaaaaacacttaagaaggaaactaaacatttatcaagctactaatctctgccagataccaggcaatatcatgtatttttatctagtctatgcagtttaataatagatgaaagtctttttttttgttttttcgtttttgagacacggtcttgctctgtcacccaggctggagtgcagtgtcacaatcaaggctcactgcaacctccgcctcctgggttcaagcagttctcgtgcctcagcctgccaagtagctgggattgtaggcatgcaccaccatgcctggcttatttttgtatttttagtagagatggggtttcgccttgttggctaggctggtctcgaactcctggcctcaagtgatctgcccaccttggcaggggattccaggagtgagccaccatgcccagctgaatgtttatttctatcttactttttccacagcagcatctcctattgtacagatattatgattacaaagtaagtattggtgaagattatatagcataagcctaatcactatcagtgaatgacattaatattatcaaatataaaagggatagtaaattatagcctaaagagagttatactaggagatgggatcatactcttgtctccactctttggggctcagtatttttgaatgaatgagtgaatgctgctaattatatatgaagcagtttaggacagtatgtctagggcataatctacttagaggtatagaaggtacgttagcatattagacattcttaaaagttctggagcaaagaaacctatttgtttgttttgtaatgctacatttccaagccccatttgaccatgttatagactttccccttaacagagcagctattaatattaattggatagtcttctgcagaacacttatttgagtaacattagtttgatgggagtagtttcgcagtaagggtgctttctgtagtggagaaaataccaagagggattaacttcatataatagtagagtgatgtttatcagattaacttttgagataagaatggaatactctggacaaaatataacagctacttgatagtacaagagaataaccaaaggaaaaagaggagaggcatctgcacttgaaagaaaggaaatacactgggcatatttgcatttatatggcttttcccctgagtacagcccttagtctgcatggcaaaggaaggctaaaacccagacaaaaacccatggtcttactggcttgagtcagcagagttgaggatgccagaatggctgaaaagtgaagagggatatactggaatgtagggaaacacattggaaagagctcaaaaaattgcttatagattccatccaaattcttgcttgaatcctgaagtttataactatagaggaaggttcatacaacccagcaaaaaggaacagctggaagtctgcaataactgagcatagatttaaccgttgtccgttgaaaggagaatggagttttaagttcaagttcagctgagttaactatactatttcttaaaatagaagtttaatcaatactcttcagaggaagttaagagaatccagaatctctccatattacctacaatatccagtatgcaattaaaaattaccaagtaaaagtgatctacagtcaataaaaagaccaatcaatgaaaaccaaccctgaactaacacagatgttggaatttgtagactatgatttaaagcagaaaatagaaaaggaaaatctcctcatgatgcgtgaccaaataaggaatcacaacagagtaatggaaactgtattttatttaatttttttttattgttatactttaagttctagggtacatgtgcacaacgtgcaggtttgttacatatgtatacatgtgccatgttggtgtgctgcacccattagctcgtcatttacattaggtatatctcctaatgctatccttccccccacccccaccccacaacaggccctggtgtgtgatgtcccccttcctgtgtccaagtgttctcattgttcaattcccacctatgaatgagaacatgcagtgtttggtttcttgtccttgtgatagtttgctgagaatgatggtttccagcttcatccatgtccctacaaaggacatgaactcatccttttttatggctgcatagtattccatggtgcgtatgtgccacattttcttaatccagcctatcattgttggacatttgggttggttccaagtctttgctattgtgaatagtgccgcaataaatatacatgtgcatgtgtctttatagcagcatgatttataatcctttgggtatatacccagtaatgggatggctgggtcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatatgtttgagttcattgtagattctggatattagccctttgtcagataataggttgcaaaaattttctcccattttgtaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctagcatttaagtctttcatctgccttgaataaatttttgtataaggtgtaaggaagggatccagtttcagctttctacatatggctaggcagttttcctagcaccatttattaaatagggaatcctttccccattgcttgtttttctcaggtttgtgaaagatcagaaagttgtagatgtgtggtattatttctgagggctctgctgtgttccatttgtctatatctctgttttggtaccagtaccatgctgttttggtgactgtagccttgtagtatagtttgaagtcaggtagtatgatgcctccagctttgttcttttggcttaggactgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttgcatttgtttgtatcctcttttatttcgttgagcagtggtttgtaattctcctcgaagaggtccttcacatcccttgtaagttggattcctaggtgtttcattctctttgaagcaattgtgaatgggagttcactcatgatttggctctctgtttgtctgttactggtgtataagaaggcttgtgatttttgcacattgattttgcatcctgagactttgctgaagttgcttatcagcttaaggagattttaggctgagacgatggggttttctagatatacaatcatgtcatctgcaaacagggacaatttgacttccttttttcctaattgaatactctttatttctttctcctgcctgattgccctggccagaacttccaacactatgttgaataggagtggtgagagagggcatctctgtcttgtgccagttttcaaagggagtgcttccagtttttgcccattcagtatgatgttggctgtgggtttgtcatagatagctcttattattttgagatatgtcccatcaatacctaatttattaagagcttttagcctgaagggctgttgaattttgtcaaaggccttttctgcatctattgagataatcatgtggtttttgtctttggttctgtttatatgctggattacatttattgattggcgtatgttgaaccagccttgcatcccagggatgaagcccacttgatcgtggtggataaggtttttgatgtgctcttggattcagtttgccagtattttattgagaatttttgcatcgatgttcatcagggatattggtctaaaattctcttttttgttgtgtctctgccaggctttggtatcaggatgctgctggcctcataaaatgagttagggaggattcccttttttttttattgattggaatagtttcagaaggaatggtagcagctcctccttgtacctctggtagaattcggctgtgaatccatctggtcctggactttttttggtttgtaagctattaattattgcctcaatttcagagcctgttattggtctattcagagattcaacttcttcctggtttagtcttgggagagtgtatgtgttgaggagtttatccatttcttctagattttctagtttatttgcgtagaggtgtttacaatattttctgatggtagtttgtatttctgtgggatcggtggtgatatctcctttatcattttttattgcatctatttgattcttctctcttttcttctttattagtcttgctagcagtctatcagttttattgatcttttcaaaaaaccagctcctggattcattgattatttgaaggatttttgtgtctctatctctttcagttctgccctgatcttagttatttcttgccttctgctagcttttgaatgtgtttgctcttgcttctctagttcttttaattgtgatgttagggtgtcaattttagatctttcctgctttctcttgtgggcatttagtgctgtaagtttccctctatacactgctttaaatatgtcccagagattctggtatgttgtgtctttgttctcgttggtttcaaagaacatctttatttctgccttcatttccttatgtacccagtaggcattcaggagccggtcgttcagtttcatgtagttgagcagttttcagtgagtttcttaatcctgagttctagtttgattgcactgtggtctgagagacagtttgttataatttctgttcttttacatttgctgaggagtgctttacttccaatgatgtggtcaattttggagtaagtgcggtgtggtgctgagaagaatgtatattcttttgatttggggtggagagttctgtagatgtctattaggtctgcttggtgcagagctgagttcaattcctggatatccttgttaactttctgtcttgttgatttgtttaatgttgacagtggggtgttaaagtctcccattattattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcctttttttgttttccatttgcttggaagatcttcctccatcccattattttgagcctatgtgtgtctctgcacatgagatgggtctcctgaatacagcaccctggtgggtcttcactctttatccaatttgccagtctgggtcttttaattggaacattcagcccatttacattcaatgttaatattgttatgtgtgaatttgatcctgtcattatgatgttagctggttattttgctcgttagttgatgcagtttcttcctagcatcaatggtctttacaatttggcatgattttgcagtggctggtactggttgttcctttccatgtttagtgcttccttcaggagctcttgtaaggcaggcctggtggtgacaaaatctctcagcatttgcttgtctgtaaaggattttatttcttcttcacttatgaagtttagtttggctggatatgaaattctgggttgaaaattcttttctttaagaatgttgaatattggcccccactctcttctggcttgtagagtttctgccaagagatccactgttagtctgatgggcttccctttgtgggtaacccgacctttctctctggctgcccttagctttttttccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtgttttccaacttggttccattctccccatcactttcaggtacaccaatcagatgtagatttggtcttttcacatagtcccatatttcttggaggctttgttcgtttctttttattcttttttctctaaacttctcttctcacttcatttcattcatttgatcttcaatcactgataccctttcttccagttgatcgaattggctactgaaacttgtgcattcatcacgtagttctcgtgccatggttttcagccccatcaggtcctttaaggacttctctgcattggttattctagttagccattcgtctaatcttttttcaaggtttttaacttgtttgcattgggttcgaacttcctcctttagctcaaagaagtttgatcatctgtagccttcttctctcaactcttcaaagtcattctccttccagctttgttctgttgctggtgaggagctgcgttcctttggaggaggagaggcactctgacttttagaattttcagtttttctgctctgttttttccccatctttgtggttttatctacctttggtctttgatgatggtgacatacagatggggtttcggtgtggatgtcctttctgtttgttagttttccttctaacagtcaggaccctcagctgcaggtctgttggagtttgccggaggtccactccagaccctgtttgcatgggtatcagcagcagaggctgcacaagagtgaatattggtgaacagcaaatgttactgcctgatcgttcctctggaagtttcatctcagaggggtacccggccgtgtgaggtgtcagtctgcccctactgggggttgcgtcccagttaggctactcaggggtcagggacccacttgaggaggcagtctgtccgttctcagatctcaagctccatgctgggagaaccgctaatctcttccaagctgtcagatagggacatgtaagtctgcagaggtttctgctgccttttgttcagctatgccctgcccccagaggtggagtctacagaggcaggcaggcctctttgaggtgcggtgggctccacccagtttgagcttccaggctgctttgtttacctactcaggcctcagcaatggcagacgcccctcccccagccttgctgccaccttgcagttcgatctcagactgctgtgctagcaatgagcgaggctccgtgggtttaggaccctccgagccaggcacgggatataatctcctggtgtaccatgtgctaagaccatcagaaaagtgcagtattagggtgggagtgacccgattttccaggtgccgtttgtcccctcttcccttggctaggaaagggaattccctgaccccttgcacttcccgggtgaggcgatgcctcaccctgctttggctcacgctcggtgcgctgcacccattgtcctgcacccactgtctgacaatccccagtgaggtgaacctggcacctcagttggaaatgcagaaattacctgtcttctgcatcgctcacgctgggagctgtagactggggctgttcctattcagccatcttggaaccacccattttggaaactgtattttaaaaaggaaaatttatatttgaaaagcagaatataagaaaaaacaattgaccttatgggcttaacaatagaatggagatgtcagaagaaatagtcagtaatcttaaagataaatcagaagaaacaactgaatctgaagagcactgaagagaaaatgaaaaaaagaaaaaacagaataggaccccagtgacctctgtgacagtgtcaaatggtctaatacaaatataaatggagtcctctaaggacaggagagaaagaacagggaagcaaaaagaagaataaattatggggcactaagaatggcaagaattctccacacttggtgaaaagtataaatttacagatataagaagtccagcaaacctcaagcaaagtaaaaacgaagaaaactatacctaggcccatcataatgaaactactgaaaaaatagagattgaaagaaaatcttgaaaaaagctagagaaaaatttacaccgtgtatagtggaacaattatacgaatgatgacagacttctcatcaaaaagattggataatgtacagcaatgtgaaaacatcgttagagagctaaaaaaaaatttgcaagcacaattattatatacagttaaaatatacttcaaaaataaaggcagatttaagacattttctcataataaaaatagggaattattcatgaagaggcttgcattaaaataaatataaagaaatttcttcaggctaaggggaaatctcactagatggatgtgtgaatttataggaaggaatggaaagtaatagaaatggtgtaaatgcgggtaaatataagaggattatatctcttttcctctatttatttaacagaaagcactgtttcaagtgtaacaacagagattcaaaatacatgaagccaaaactgagagaattaaagggagaaatagacaaatccacaatcatggttgtgattctaacactcctatttcagttgttccactcttaacaacttaggctttattgacataaaaagagcccaacatcaaacaactacagaatataatttttttcaagagccaaggaattttcaccagtgtagactatgtgataggtcacaaaatgagaccctctaaataccaaaagattaaaaatatcagtatattctcttattacaatggaatgagtaagaaataaataataatatttgtagaaaattcctactatttggaatttagaaagcactgttctaaataactgctggaccaaggaataaatcaaggaaaattagaaaatgattttagttacatattgttgaaaactgaaaattttggaatggggttaaagcagggcataggtgggaaatagatttaaatgtctatgttagaaaagaagaaagatttaacattggtgacctatgtttctcactttagaagctagaaaaggacaagcaaattaaatttaagagaatgaaggaaataataaagacaaaagtaacaatatattaactacaaaaaaaatagaaaacacagtcaaaatttggtaattgatagcacaaaagatgataagaaaatagaaaacacaaattacccatatcaggaatgttcctacagccattaaaagatcaataagggactatcataaatcactttgtaacaataaatttgacagcttaggtgaaatggacaaattccttaagaaacatacattaccaaaaacaaaaacaaataaatgcgtgagtgaaagaaagaagcaaaatataaattagccctatatatactaaggaagttgaattatcaacccttccaacttagaattcctgttccagaagagtttactgatgaattctatgaaacatttttgcaagtgacagtgtcaatcttgcataaatttattcagaaaatagagggatattgaatgccctccaattaattttgtgaagcaagcaaagccctgataccaaaaccaagcaacgacaaaattacagaaacagaaaacgacagactagtatccctcatgagcatagatacagaaattattaaaattttagcaaatcaaatccaacaacatataaagtggatgattggttgtgaccaagtgggatctatgccaggaatccatgtttggtttaacatttgaaaatcaaaaattgtgactcactatattaaagaccaaaacaaaatttagagcataaatatataaacccccaataattatcttaatcgataacaaagaatgcatttaatgacattcaatatccatttctaataaaaattactcttagtaaactaggagtagaagagatttcctcaaccttaaagggcatatgccaaatccctaaagctaaaattgtactcaatggagaaagactgagttcctttctcctaacttcaggaacatctgctctcaccatttctattcaacattgccagtacagtaagacaagaaaaagaaaagaaaaagtatccgtattgaaaaggaagaaataattttttttgtttttttgatgatgacatgatttttcaatgtagaaaatgttatgacatatgctaaaatactcttaaaacttataagtgagtttagaaagatcacagaataaacaaaaccaacaaactaagatcagtaaataaaaatcggttgtatgagcaatggggaaataattccctgttcaataaatggtgctgtgataactgactagccatatgtagaagaatgaaatcagacccctgcctttcaccatatacaaaaattaactcaagatggattaaagacttacgtgtaagacctcaaactataaaaatcctagaagaaaacataggaaataccattctagacattggccttgggaaataatttatgactaagttcccaaaagcaatttcaacaaaaacaaaaattgacaagtgtgacctaattaaactaaagagcttctgtatagcaaaagaaactatcaacagagtaaaccagcagcctacagaatgtgcaaaaatatttgcaaactatgcatccaacaaagatctaatatccagaatctataaggaacttaaacaattcagcaagaaaataaataaataaataaataaccccattcaaaaatgggcaaaggacatgaacacatacgcctcaaaagaagacatacatatgggcaacaaatatgtgaaaaaattctcaatgtcactaatcatcagagaaatgcaaattaaagtcataatgagataccattgtctccgttaaaatggctattattaaaaagttagaatggctattattaaaaagttaaaaacagatgttggtgaggttgcagagaaaagagaattcttacacattgttggtgtaaatttaaattagttcacccactgtagaaatcagtttggagattctttaatcagttcagccactgtagaaagcagtttggagattttttaaagaacttaaaacagaattcccattcaacccagcaatctcagtactaggtgtatacgcaaagtaaaagcaatcattctactgaagagacacgtgcactcatatgttcatcacagcactattcacaatagcaaagatggaatcaacctagatgcccatcagtggtggactaaagaaaatgtgctacatatacaccatgaaatactatgcagccataaaaaagaatgaaatcatgtcctttgcagcagcatggatgcaactggaagccattatccttagctaattaacacaggaacagaaaaccaaataccacatgttctcactaataagtgggagctaaatattgagtacacatggaaataaatatggcagcaatagacactggggactactagtgggggaagatgttggggagactgttgaaaaactgcctatcagtacgacactcactacctgggtgatgggatcctttgtactccaaacctcagtgacatgcaatttacccatgtaacaaacctgcacctgtacccccgaacctaaaagtaggtaaaaaaaaaatgttatacaaatggaatcataaagtatgtaactttttaagactgacttttgtcactctgcataattcctttgagaagcatccaagttgctgcatgtatcaatagttatttcctttttattgcttagtattccatggtatggatccaccaaagtttgtttaaccattcacccattaaaagacatctgcttttgtttttcttttccaatttgggaatattatgaataaagttgttatgaacatttgaaaaaaaatcagtcatatgtccataatctaacaatgaaaagtagtaaattggaattataatagtgccatttaaaataacaacaaaaatttgagatacttaggaataaatcagacaaaaatgtgcaagtctcataccctgaaaactacaaaaaatattgcggtgagaaataaaagaagacctgaataaatggagatatatatcatattcatgaattggaagactcaatattgttaagttgacaattggccccaatttatctatagattcagtgcaactccaatcaaaattcttgtggttttctggggctacaaatttaacaagctgatcctaagagttagatggaaatacaaatacagcttttataaaaaacaatgttggaggatttacagtacacaattccaagacttagtataaaaccacagtaaacaagatagtgtgctattagccaaatgatagacatatagatgaatgggacataatagagactcacaggtaaatagtgaatctgttttttgacaaaaatgcaaaggtagtggagaaagtcttttcaataaatagtcctggaagggttgcatatgcgtatgcacaaaaatggctcacactttatataaaagttaactcaaaatgcatcatagacctagatgtaaaatctaaaccttaaagtctttaaggaggaaacaaaggggaaaatccttgtgactttgggttaggcagatatttcctagatctgatatcaaaaacacgatccaccaaagaaaatactgttaagttgtatttcctcaaaagtaataacttgttctcctctaaaagtattgttaaaagaataaaaagataatccacagtgcaggaaaaataatatttgcaaattacatatctgatagaagacttgtatccagaatatataaagaactctaaaaatttaataataaaacatacagctccacataaaatttaattataaacaaattggaagaatattttgacacttaaataaaagcagatatatagatggcaaatagatacacgaaaagatcctcaacattattaattagggaaatgcaagagaaaaccacaatgagatgccaccataaacctgttagaatatctaataaaaacttttagccaaagcaagtatagatgagaatgtggaagcaactggaacaattatagattattggtataagtggaaaatgatctacacagtttggcaatttcataaaatgttaaacacctattaaatgaccctgttgattcctaggcatttacccatgagacatcaaagcgtatgcctataaaaacttgtacttgaaaattcatagtagctttatttgtaatagccagaaactggaaacaactcaacttcccatcaacaggtaaatgaatcaacacattgcagtatacctctacaatggaatactactcaacaataaaaagtaatgaactattgatattcaccataacaagtttgaatctctaagtaattatgctgactgaaaagttagacaaaaagagtacattctttataattccatttatataaaattctagaaaatgcaaattaatctacagtgacagaaagcagatctctaatagcctggggtgggtaggagtagggagatggatataggcataaggaagatatgggcacaaagaagcttttgtaatggattggctatgctcattattttgattgtggtgatgatttctgtattagtccatctttgcactgctataaagaaatactcaagactgggtaatttataaacaatggaagtttaattgactcacagctccgcatggctgtgcgacctcaggaaacttacagtcatggcagaaggcttaggggaagcgggcaccttcttcacaaggcagcgggaaagagaagagtgaggagcaaagagggaagagccccttataaaaccatcagatcttgtgagaacccactcactatcaggagaacagtgtgggggaaactggccccatgatccagtcatctcacaccaggttcctccctcaacacttggggattatgtggtatacaactcgagatgagatttgggtgaggacccagagccaaatccgtttcactggtgtatatatgtgtcaaaacttttggccaggcatggtggctcacaactgtaatcccagcactttgagaggctgaggcaggtggatcgcttgagcccaggagtttgatatcaacctgggcaacatggtgaaaccctgtctctacaaaaaatataaaaattggctgggcatggtggcacacacttgtagttccagctactcagggaggctgagctggcaggatcacctgagcccaggaggtataggctgcagtgagctgtgtttgtgccacagcactccagcctgtgcaacaaggtgagatcctgtctcaaataaccaccccccaaaacaaacaaaaaaccccaaacttttaaaatagtatactctacgcatgtatgatttattctatgttaattatacttcagtaaaactgcttttaaaacatatgtttttaacatagaaataaaacatctagatttccctaaaagaaatgtgtccaagtgcatattaataaacaaagaaaacttgctagacccctgatgagatcaagttaaccagttgacaatgtaaaatctgtgacacaatcaaacattaactaaacaaagtgtgcctctgtcagtggcatcagcatttactgggcgctggttagaaatgctaaatctcaagctttgcagctgacctactcaatctaactctggtgtcagggccaggtaatgtgtgttttaataaggtctccaagtggttctaatgcaagctaaagttttatatctgacttagagtatctccattttgacagtcgccaaaggtctattttcttgttctaccaattgtaatacatcaaatatttctagttctacataactacaaaaacaaaataggtattatgcaaaaaagagaaccgaattgcctataattgcattacctaattaaattatcattttcatttattcattaagggtcttgccttctccacatgtttatataaatatgttcatataatgtctgcatttttacaatattataatctgaagtaattttaatctcaattattattacagcagtttgtcctattttgtatttttcctatcctcagaattctaatattttcctgtttaatttttcttccttgagaaactattcttaaaatgcttttttattttaaagtggcatgattatacaactgtcttattgtcattataaagtgcgcttcctgaagatggtaacacttttatggatgcctttaactcacaaactagtctacttctcagtacattagatttttattcttcttaataaatgatatataaaccactaaaagttatcctttgtataatttcccctagccctaaatcttacatgtttttaacttttgacaaaagtgtatgccatatattttatttaatccattaaggaagtttattcattgaatgagaatttactgagtatttgttctgttgggcactaagaatacaaagttgaagaagatataattgattaatgaagtagtaattcgaggggagttaaagttattacaaatttctggctggggtagttgggttgtgctatttcctggaatggagaagacagtagaacatgaattcagtgttgtttatatcaagtttgttcttaggaaaattacaaaatttttccttgtcctgattcttcatatataaaatggaaataataatgtctacctcatattatcattgagagtattaaataagataaaacatggaaagagtttagagtaattatttggtatatagaaaacactaaatacatgttagctattattattgtcattgagttttaggtgcctgtatgcattcaagtgaagatgtttcagacagttgcctatgagagcctagttttttagtaaaaagagttgatattttagattcccgggtaaagagagagaagatcaaaaaaggaatccagtgtaataccagtatttaaaggataggcagagagagagaaatattattgcacaaaggaaaatacgaatgatatttttatgcaaatatgggcaggcagcataaaccggttttttttaagtttgacctttagaaatagccattttctgtttgtgagtgttagcaaattacaggaaaatctacagtagttgtaaggattaaacgagtgcctaacaacaggcagcaaagagtaggcaacaacaaacgtcaaccttccctaccatatgtattaggaattaggtggaggatcccatccccaccacatcctcgctcaaggcttctataatttctacttagtaaccttagtacctttcaaaggctgtggtattgatctttgaattccttttgctactgtctggtagttgcccttctctcttctttactataatattgctcactctgctagataggaccatgatattatttgactgtagtgcaaggagatttcaggatatatcatttataggtatatggttttattaatatcaacaaaattaagctttttagcacctccacttaaaatttttagcttattcctctcttatctgtaggcgagatagcagttttgcttctgagaaaatatggctttcttcaagtattatcctccagttttggcagagatatgctgtaaataccagctgagatcccaaaatgtacctgttttcccctcatgaaaatctactgtaactagattttttttcctttgtgctttctttctgactgaaacttgtgatcagatttctactactagctctgccagtaataatttgagggaatctagctctaaaaattttaaaacttttaatttcttcctcttgttttatttcctcaaaaacaattgtgttgaggttgatgaatactaaattatcataatttaaacactaattaaaacaacaaggggatatatgtctagaaaataagaagtgtagtaatatgtcagtaataattattgtcaaaactacaggaatgttgccatctatcattaattgactaaaattagcttcattaactttgaaatgaaaagtggaaactgaccagtagtcttttcaaagtacttatatttattataggatgtttgttgaattattcagcataaaatcatctaagctttttagactaaacttagtacttacaaaacacacacacacacacactttcagagtagaaataaaagtgtgctgtaccttaacctctagagatatgtgtcttcaatggccccttagtcagccacctagtagatatggatgctttctctttctcacgtgctgtccaggctgtcactgtgggtaggatctgttaagagggttcccagaatgaggtctgaccagaggcagccttcgagccttagaaaagtggaggaactacttgtaaccctgtagttgggagcacgtgccatgaagctgtccttcggggttcttttatatatatatatattttgtactttaagttctagggtacatgtgcacaactgcaggtttgttacatatgtatacatgtgccatgttggtgtgctgcacccattaactcatcatttacattaggtatatctcctaatgctatccctcccccctccccccaccccacaacaggccccggtgtgtgatgttccccttcctgtgtccaagtgttctcattgttcaattcccacctatgagtgagaacatgcggtgtttggttttttaaagttggaaaccatcattctgagccttcggggttcttaaacttcatagtgatgaattatctttgtgtaactggatcccctagttttggagtttacacccttactaggattggctatatgcagattaactaaccctaatatgttaatccaaatagcattagtacacatgctggctctgcttccccacctttctgactgtacagatattcacatcaggcaaccctactgtaaaggtgctgataagatatgatgggtcctcactggtagataggcagtcttcctgtcctggtgatgataaaggctgcggttagaactgagacctgagtcacaattcaagtaattattctgagtaaaggaattaatggtggtattttctttatacttttgttttctacattgaatatgtattcatttttagtattaattttacaattagaaaaagtaataaaagttttgatgttttgaaggtttttttctggttaatttcaagtctgggagcttctctgatggtttccttttacccttccctgctccatacttatttaatgtaacccttacagatctggtttcctggatttattgctatcttccctattaaactcttgatgtcagtatgtttaaatctcatttcatctctgatatgctttttacttttacaagaaagaaagagattaccacatatgatataacttccagacggtttgtgttttctccccccacatcttaacaggttttcccatgttagtagatactgtgaatttacataattaaattaagttagttttgtctagatagtcatgtgatctttttgaatctcaaccatgcctgtgcttgaaaattcacaaatgaccttacctttcattctcatttaattgcagggagagagagggtttccaggtttggaaggacacccaggattgcctggatttccaggtccagaagggcctccggggcctcggggacaaaaggtatgtatcatgttgccaaccagtaatgccagatgaattaagtcatcttaaatgtgggactaggtgtcacatcaactaaaaagttactgaattatagcaagaaactaatatgtaaatgaaacaatggaatgacggggagtctgtactttattgtattttgttaaaaaactaaatattactgccatattcagatgcttttggaagatgctgttgattgtttgtagttattggctgccttcacaaaaattaagttctgtcaagagcttagctgagctggagagagctgaattaccagttgttagagtagctgattaagagaagaagccaaaatgaaagtaacagtcaaacctttactcacttactgcaatattataagcagaaagttaaactggagaaagtgctgactcccccactgttctatttgtccccatggtgcagcatcagcaaaggtcagatggatcagcacagatgttggaaatcatttgactgctgagggagctcagaacgaaaagctcctgcagttgtatggacccaggggcagggtgggagaaggagaagagctaggatggaaacgtactgaatcagagtgcagaaaaagtatttttatggtttctttctcctctcataagaaggtctccaccaaaagaggcctttaaatgcagaaatgcagttgagcacagccagccatggtagcctgaatctttgactgatacttcagagattgcagtgcattagctgtgcaccaagtttgctgtgtggagggtagctgtcccttatgaggcctaccaagaggactttggttggacccgaacagtcataggtgtttagacaagagccatattctcaattccataccttgatttttcaggacctgagtgagaaacataagctgccccatcatggacctgaatgggttggactttaaagggctctgtcaaaaaacaggataatatctgaggccacagtagattatggtcatgatcaatcatgttctaagcaggatgaacaggcctgcttggagaactgaatgtaagcatgagccccagctattgccaagccagtaatagatgtcccatagcccacttgatctacgttagagagccaggaggcttttttcttaagtcttatgatggattgttctactttgccagttttcattgatctaggtgcaatatgaggtgctggcaattccagagacccctcacagttggccagcaggcagctaagggctatatggttagctaacactatgtgggccaaggagttgaggctagtctgttttgtttccaaagctgaagtaatgtcattaatgacctcagcaagggtcaaagacaggttgcggacaaccttttctaattgagcgatgctcacagtgagaaaagttgtctggagtattcccatgagtagacagtaggtaatgccagctggcaattctcctgaataaccggagtctatctagttttggagttctcattttgttttatgtaatgttatatgcttaatgggagggactgttttgaatatttgagtatctcttatcaatgtcctattatgtatgttacattggtaggaatgttgaaagcctgatttttataaaagaaataataccccaagaagagtgcacacagttctgggaatgtaagagtcattggttaccatggagatcaaccagccagaagtccctcctggtgagcagagtacttgagtggaattgaaaaatttgtgtaaggtggaggcagaaatagagaaataaattgccaccaccatcgaggccaaaatggctccaatggcagatcatatgtcccttttcccagataattcaattgcttccatatgggacaggagtgagctgacatcccaggaggtattttcttcctgtggtatcagagtcaattgttgcaatctgtcagatccagtgtaataaagttagggtacatgaagtactaaaatggtccatgtttagagaaacgtccattcgtaatattcagcagcacagcaatcagatgtttatctgcagggttcagcgataggtgacatatccattagtttgtcaaaatcagaatcttgtgaactacccgggacaggcaatcaatgaatttagtaaggtggaagtcacaaggttagtctgtaggagaaagggaagagaggttagatccctaccttccagccccatggatcagccccatggatcagctcatggatctggaggtagtctcaacctatcagttgtggggactctgtcttttgactgccatgtgggcagtctgtcctataccatgagcaagaatagcatctcaatgtgcatattaagatatagaattggaagagataatagtgaacttaagactcagagaattttctgggtttttttttttaatgactcttttggcttagtgcctttttccatctgtattaggtagactgatgaattgatatatgaaagggctacttctcctcatttgcctggaaaggaaaactggcttaaaaccctttttcttaattttattattttatatgatggtggtacatcatgttgttacaatattaaggaaatcaaatggatactcaccaggtagtcttccagtaaagggagaaaattaatttaaatgcatgaatattttttaacacttaactataatcagagcttagatttggggagaatgttggtcatgatctctgggaaaataggattacatcaggtagttttgttagattcaagagcagaagggacctgtgctaaatttcccaagtagaactttagtacttagaaaacagcaggaccctgaatgtgtgcatacaattttggtggatgaactactcagctgaatttcctgtgtctaatggcacatcaagagcaagagcaacagaatgattcttgtgcacccaggagtagcacagaagtatcagagatatctgaaagagtcaagtggatggaattgagcagtaacttggcagcaatctatgcatactattggcatggaacaactcaatgaataccagcttggactacactgtcacactcctcaacatattggagctagttaagttctccaaaacttagacacgatcttgtgaaaatgaggtggcaactccaatggactgagattaaacttcagccatgttatagaaataggtgttttggaagagaaattaagttaagctacaggaaaagttacatttcttgtatctgagtttacttgggattagggactgagtttcttgcaccccatgcttgctgagagatggtagttttaataaagatttgtattaaattaaaataagttacctaaattagaattcctttgaaataatttagtattaactaggactattctacaataacatgatcatttataaaggtgtgcttgtatgcaggttaagtttagaaagcagtccaatctttttttgtgatttcatttcagttatctaaaaagagagaaggtaaactgctttctaaactttcaggattctgaatttgaagcattgtgtacttctgcatccagtatgactccatgtttccccaaatggctgaatttataccttttatgtgattgggtattctggtacatgtgtatgttaacatatatactaagtcaaaaaacttgtaggagtattctttaatatgcacactcgcaattttccaaaggttttttattctaaaaaatcaaatttagttaattttgataggcagtacgttcatgtcactcaagttaagagggtatacaatgaaagatctccttctcacctgtgtccattagtccctgagttacccacacacactttaaccacctttgtttgtaaaatagtagcacattaaacacactgtttgacctttgtttttaatttaatatacattgtagacatcctattatcaatatatacagaacctcctcattttgtataactgcattgtatttcattgtatatatgaaccataacttaacattgtatgtataaaccataaattattaagccagtcccctattgatgattatttaggtaggtttcaattttttgctattaaaagttcctttttcttggagcagaattaggttttttaattctatttttttaaagaaaatagttaacgaaaactcagtgaggtaagactaaattctcagcaatgcggttgtgactagaaatgggtacatatgttaacatacacacatgggtaggttcttttgcatggaactgacagctaggaaggaaagtttatggttctttttaaatcgttcttacgctctgccaatacaaagtgcattataaaacaaagcagaggtttgaaaacagcaaattcaagaacagcacatatttaggctcagagatgatgctcattataccagcatggcaagcagattaacataatatgggaactgcccagattttcagctcctattttgtttacgaataaattatttggggaatgactatatcaatattttatctttgttttcttgtatgattcataattaactgtacaggtatagagtttgattcatatgtcagcgatttccttctcaggaaataaaggcctttcttattttgggtcatacaatttacctcagtgctttcagtctcaataataaatgcttcttccttgggtgtataagtttttcactaactttcacagatgtttacagtagtttaaatctcctattttataattgaaaatgagttatttgaggacttttttgacggacaaaaacctaaaaatattgcatttttcagggtgatgatggaattccagggccaccaggaccaaaaggaatcagagtaagtagtattttctctatatcaaatactttgttggtggaaacagatagagaacaaatgaagtattatgagacaattggaaaagacccatattaaaagccaagaagataaatacagtcttcaaaaagttaaatttaagagttggtatatgtctataactagcacttctttagtattttgatagctattacatatatttttatatatatgtctatttaatataaaaggattttaaagtagcttatggttgagaattatgaaagtcctaaattctaaagtttgtcatttaattaaaaatctatatcatatagttggtttaaaccagaacttcctaaccagtgtgattatctcagcctaggtccagaaggctggttacctcaggctgtgtatcctcctagtgtaccatgtataaacattatcatttttttgtgtatctagaagagaataagtttagtttaaaccactgtattaaagaataactatttttggaatactgcatttcttcaaatctaacgtgcatgacttttcaagtcttgaggctctgaaaaataaggatgcatctcaaaattgaaatgtacatttagtataattttttctcaaaagcttttaagttgacatatgtcttacagtgtattttacaactgagaggaaactgtagtttaaaaaatagtactggcttttaaaaaatcacatttagctttctgaccctcagtttcttcatttgttaacttaagagagctaaagagaacaatctccaaggtcccttttagctctgaaatactgtgttcatagattgatgaagctctctaatttgaaaataaaatatatagttggtgacatagcatgtttacgtgtgtgacaaagataaccatttgatcatcagaaatttagtagatgcataattttacaaacattaaaaacattctgtttgctatatacttcttaacatcatgtagcttgccttatgtgcatcttgtgactgatacggatagggtactggagaagcagggaagaaacttaaaacccttagtttatttcagcagacataattctttatttttctgttaaaaattgatatcaatatactattaaagctctttataataataaaaataatttttaatatccctatagttaacattaactatattctatattctaagcactattgagactaaaaagaattggctattttctcagtttccattgcaggtgtttgagattgcttggatactccatgtccctcaactagaactccaagagtgcttgggaataggtggcctgatagtttctgcatcctcaggtgtcagctcacaggcaattcttgacacgcagaattttgaagacattattgtggaaactgataaatgtatacaaatgtacagagcatatagtataatgaacccccatgaacccatcacccagcttcaaaaatgaacaacattttgatagttttgtttaacatataccttaccactttattttttgaagtattttaaagtaaatccctcacatcattcattctaccaatgaaaacttcagcatgtccctctaacaaccacgtaacaactaaaccatcatcatacctttaaacattaggaatagtttttcagtactctgacgttcagtccacattgagttttcctcagttgtctgaaagatgtccttttacaatggtttattcaatttacaacccaagcaagttccacgtattgctttgggttgctgtttattaagcttgttttactatgccatcagaaaaactgggtcattgtactgcattccacattctgaatttggctgatttgtttcctcatgatgtcatttaaattgttcctctgtcccccatatttcttgcaaatttcacgttgccttggaagaggcactaaagaactttctgggggtacagaactgtacgcttaagattagtatattttgctgtgcataaatcatactgcaataacattaaagaaaataggaaaaagtatactttataggtagtgttgtgaacttaactattgaataacattatgcagcatgaatatcaggctattcttcttttttttttttttttttgatgttaggtttgatcagtagtctcagataacattagcctgattctgccatcaaaaatttccctgtcaactttgactaatgatttggcacccatggatggtcattattttgctcagacttgcaagatgctgatttttaaaattctattaatcattcatttattagctggaattctaataggacaatgagttgctacaccagaaacttcaagtggtcatcaaggaaaattcttcaactttttttttttttcattatatgcacatggaatttgtgtgtttcaatcaattttagtcatttttttgaaggccaatttgtcccatcttttgcctgtgaaagccttttaaagttgactcctgtcctgtgctcttttcagaaaactccattgatctttcataacttctccctttttgacacaacaagctctttcatgctcatccttggcatttcccctttagatctgaaatgggacatatctctgattccaggttctttttagtgaaaaatgtgatttagataccacagcctgaatgttagggttttttttttttctttctttcttttttggagacggagtctcgctctgtcgcccaggctggagagcagtggcgcgatcttggctcactgcaagctccgcctcccgggttcacgccattctcctgcctcagcctcccgagtagctggggctacaggcgtccaccacaacgcccggctaattttttgtgatttttattagagacggggtttcactgtgttaaccatgatggtctggatctcctgacctcgtgatccacccgcctcggcctcccaaagtgagcggtttttattgctactcgatttgtcactgtttcaatgtcttctcagtggaaatatgtatttttaagagaaaaattaacatgagttcatattattgcttccaattgcaatttaaaattaagaaaggttttgtatacttattatctcttcccctcatctctctctctattgaggtgaaaatgttcattcctaatatcataaatgtaatttcttatttgctttttcctacaatatgcctatttcctacaatatgctttaaaataacaatgtataacttaacaaaataaaaatttaaattttaatagtgatgataggataataggattcttgaaaaccattaattatttctttgttgagttttccccctttgaattgaccagttttgctaaagaattagagttaagataccatgtttgatgaaaggcacttgaagtaattcttttctctgtatggttttgtcaacaacttgaaacagacgtacactggatccaatttatttttcatttttaatgatttcctttttaccttttttaaaattttaaattatttaaaacatctacgtggttttataagacaaggtgtagtcagagatgcttctctttcattcttgccatttccctagtgttttaatcttcctctgagaggtaatcattagtttttacatagtaatcatagttttacattatgtgaatgtgccataatttatttagtcatgttcctattggtggtcatttgagttgtgtattagtctgttctcacactgcttataaagacatacccaagactaggtaatttataaaggaaagaggtttaatggagtcacagttccacatggctccggaggcctcacaatcatggcagaagatgaaggaagagcaaagggacatcatacatggcagcagacaagagaaaatgagagccaagcgaaaggggaaacaccttataaaaccatcagatttcgtgagacttactatcacaagaacagtatgggggaaaccacccccatgattcaattatctcccaccgggtccctcccacaacacgtgggaattatgggagctacaattcaagataagatttgggtgaggacacagcaaaaccatatcaagttgtttctaattttaactataactggttacatggttgtttctaaactttagctataataatgctgcaattgttaactttgtttctcatattttgtttcataatttctagggtatcttcaggacagattcttagaagtgaaatgctaggtcaaagggcaaatgcatgggtaattttgctagatattttcaaatttctctccatagagtttgaatcttcattagcagtatatgagaatactttttcaccatagtctcacctacagagaatattgtcaaacttgtatttttgccaatcatgacagagaaatttaagaattttgggggtgatcactattaatgtcttcagtggaaatatatttgccactcccccatcccctgctgaattaatttttcatcacaaacctgggagatccttatccattagaagagacatttcatccacgaatttgcctgctcctaataagtgcaatgaagacaatgctccctcaaattgaagtttcttttatagttttcaataaaagagacttttaaacacatgtaagagatttttctctaatgtttcaaagaacaatgagtagtaataaatagtgagacacaatttttccaaatctattctaaaataattttcataatatccttaggtaggatattattttatttttatgggttgtcatttagtttaaggattttatttcttcttatagggtcctcctggacttcctggatttccagggacaccaggtcttcctgtaagtagcatttcactttttactttgaaatctcttgaaaagtaatctaagacatattatacatgtgttatgtcgcttttcaaagggaatgccaggccacgatggggccccaggacctcaaggtattcccggatgcaatggaaccaaggtgagatccatccatttaatcttgggtagtatacttgacaataattaacttaaaaacctaaagaaatcaatatgaagaatgtagaagaagggatatagtgtcttcaggtcttggctattacataaagtatgctctgactataattttctatatattgaactatcaataatttcattaaacatgtataattagctgggatattgcattgggttaaagattacttaccaaacccttttttgactttagcataaagtaggatgagaattaaaacgaaattaggatatatatgtttcaaatattatatcaattgttgaaagtaatacttctgaatgtcattcatttgctttgccattattaaaaaactaggtacaatttatgttttcaaatatttcatgtttttaagattttttaacacgccgaataacttccttaagaaaaatcttaaaaaattatatgtaatacagcacatccgtttttactataaactgtcagtatgaaacctgaaacttcttcatcagcaaagatgatacatttaacaattttaaataaccctaactttagatatagcaaacatttttttttctgatccaatgtttcttctctttagtcaactgttggattgaatataaagtaatagataataagaaaaaatgaggaaaatttgctctgcttgtaagcttacaatattatagccaattcttattccctcccctttctccttttcctttaggttaatgcaatatattgttattctctgtattttcttttggtattttctgtttttcacataatattctgtaaaactattcataaaataccttaggtccttctttctttctttctttgtttttgtttgttttttgttttttgttttttgagacagagtcttgctctgttgcccatgctggagtgcaatgtcacgatctcggctcactgcaacctctgcctcccgggttcaagtgattctcctgcctcagcctcctgagcagctgggattacaggcacgcaccacaatgcccagctaattgttttgtatttttagtagagatggggtttcaccatgttggtcaggctggtctcgaattcctgacctcttgatccgcctgcctcagcctctcaaagtgctgggattacaggtgcgagccaccgcgcccggccagatctttctaactaatggcatatgtcagattttatatagggcatatttttaaaataacttgaacaactattttgcattacagtggccatattttgtgataattactgtactctatacttgaggcagtacagttcttttcatctccagtatttcttcaggtcaatgtaacccttgtcaataataataatttttaaaaaaaattttggattcatgaggactaatcgtgttcttcattttagctagggcaaccttaaagtgataagaccaatgtggagttggtttgcctgatacatttcatgttaaattggactaaatttttgtgcctcttctggttatttgtttatttttatttacttatttatttttgccagtgtgctttaagaaacaaacagaccactaaccaaagtttcaaatttgaagggccaatgtatctataatcagtacagtgtgctatatgattaaagggagcattgattaacttgtgtttcaggcttccaattatgtgagtaacaaattttaaacaaattaaattgatttattatgcatatttttaaagtctgaatgcttttcttatatttcttactatgtaagtaaaagaatgaactttaaagttggagccacaatgtataggtttttttctttttctgtcttttaaacttgatgtctaggccacttcctttctctcgggacctactttttccatgtgtaacaaggtggagagaagggtattggactcacaaagacacacaacagtagtaattttattctttcaaaccttctgatgaagttgtttctaggattaccgtggcatacaggtatttgaaaggaggttgctttggtgttcttctacagcaatttcagcttttgttttctaaaccaagtgtccatattagtactttacagtagtgagtgagaaaagctgggtgcctagaaaacataatgacctgcaattgctagaactattgctattattgtcctcttggtgatattaatggccttctttcttaccatcttttcccctttacaaaaataatttgaaatagtttacaataaaagaaaaatgcaacagagcagttaaaataagaatctatataacacatgggcaggaaatggggcagatcattaactattaaatgtgatgatagaatttatggcgtgatcgtctcaaaatgtctttgttggaagaaaagaactgaggtagataattttttttctttacttctaattgggatagatgaattgggataaaagttgaattgatatggatagttgatattgaagtaattggaaagtgaaggctaatgaactttttggcaatctggcatgtttcaaaatggcttttatagaaatcttttcaagaagtcatatcttgatggtatagttattctttgtttcttgttcctccatgctctttatttttaactccttctagggagaacgtggatttccaggcagtcccggttttcctggtttacagggtcctccagtaagttataaaatttgggattatgatgaacacaggaattaacaaaagaagcagaaatgtagtgagagagcccaatgcattcatgtggaacaaagtaatacattttaaagtaataaactagaggaaaatgtttcaaaaagaagttggtaatatagctttctcctgggcaaaagcaaggattttgtatgtatataaatgtcacctctaagtatcctaaggtatatcctattcagaaatgacgctacagcagtctactcattttatactctatttagaaagcattctgtaattggcgtgtttctctctcatacatataaaataatcccttttctttttaataatagggaccccctgggatcccaggtatgaaggtaagcatctcattctggggaacaaatgttttgaataaaatattaggaaagctggcaacttcaataggataatgactcaaacttctgtcttaaaatcgatgtttctagaagttgtgcaggtgtaaacttacaagctctccttaagtagtctcctgtgttcccatggctttaagtaccttgtatgtgctgatacacttgaaaatgtgtatatcagacttgagtttctttgctgacactttaagtcttcatcttcttacactttgatacagttaaccacttactctctgtagaattacttttttccctggcctctgtgacactatcctttcctgatttttcttctacacctctggttaatttgcagtcttctatgtaaggtcattattttatgtccatcaagcatcaggtcacagtctgtactccttccctgcaatgcccagaaatattactaatgcccatattattgattactatctagttactaaataccaaatgagacttttcttctgagttagctatgtgtattcatcagcctctctgacatctccacatgttccaagttaatccacccacaaaataaacccgctcctccctgtggctcctcatatctcaaatttgcatctttatatgttatgtacacttttacacgatctcaaaacctgggagttaatatttatatcttccattccttcacccaccacctcattcaattccatcactaaacactaagtgtgcctgtaaaaggcaccttaaattcatccacttttcttcattcccactgttaccacgttaatcataatgtctcatctggattactgcaataacctcttacgtagtctctagtctctttttttcaccactactccgcccttacctcccatcctgttttattctttacaaagcaaccaagaatgacattttaaaagtgttcattgataatttaatatgcttataaaccttcaagggctttctactgtgtatctaaggtaaagtccatagtttgtttgtaagaactgcatgctctggtccttgcctacattgacagccttatcttaaaccactaaacttatcccttagctcactgaccacatcagtctgcatttagttattgggatgtgccaaacgttttgcttttagggtcttttgtatatatggtttactttgcctaatattcttcctcctatctttgcctggatgactccttattatccttcaggtcttaacctgaatgttaccttcacagattgcccttctttgactacccaagctaattttctccactagtttttttttttcaattattgtaccatgttatttttcttcatagcccttaatattcacagcccttgatattgtcatcttatatttttacatattagggtctgtattttcccattatattgttagctttatgagaacagaggccttgtttatcttctccattactgattacccagaacctaccacaattgttggcaaatacttaatatttactacatattttttaatgagtaactgaaggtactacactcttaataaatctactgttcttcagtgtactctggccacttcctcattttcctttaaaaggtaaacttatcatttttattactgagatggcctaatcttttagtacatctctgttacaaattgaatcttcagatcatttttctggttttgctggttttcatgtataataactgtgtcttagaacttccattgatggcttcttttagggtgaaccaggtagtataattatgtcatcactgccaggaccaaagggtaatccaggatatccaggtcctcctggaatacaagtaagtatccagtgattttctttttttgctatattgattaaaccagaagattacaacaatccctcaacctttagtactctctgtttttgtcataaaaattatcatcagatgtttactagacattacatgtactttctacctgaaaataaaagcaatctggaccagggagaattttaacaacatcggcttcattcttttgcctttctatccagtgttttggggattggcagcagaaatagggttctatattcttattcttgtactgtggagagcagtagggtcttttgtacatttacaaaagacctaattaaaaataaaaattatggaagtcccattgaatatattaagatatatcatttgtaacactatcagttatgcataatatatgaacatattttgaaggctgaaggaatacagtttatgcatggtgaacatcaaatgtaatcttaagaaaaaaattttagcctacagaaaacatgcatagagagagcagtaacttttgagtatagattaggaggtcaatttcttagggtttatatttcatgataatcgaatcctttgccaaaaatgaaaaatcaaaacttcctggtagtttatcactaagatacaagattggggacttttttcattagctaccttgtcattccttacttgatatcacccatccatagtttttaaaattcactcaatcttgccctttatattttataaattgttatgaagtaatatttgaaaatacaacagaatacatgcaaaatatatgtatgttatgaagcataactataaagtgaacaacatttaagagctagaaaattacaaataattttgaatcaacctgtgtcccccttggtaatcaaatccttctgcattcccccaagacatagctaccatctgtgccttaaaaatagctttattatatatgcatatatttctaagcaatagaatatttagctttgctttataaaataatgtaatatttatgtagttttctgcaacttactttttctacttgatatgctaagattcatccatattattggatatggctttagttcactctgtttcactttcatataactttccatttgtggacatactaccatttggtgttttttgttttatgtggtgtttgttgttgttgttgttgttttgagatagcatcttgcactcttgcccagaccggagtgcagtggcatgatcatggctcactgcagtcttaacctcctgggcttaagcaatcctcccacctcagcttcctgagtagctgggaccataggtgcacatcaccacacctggctactttttgaaaattttcgtggagacaagttctcaccatgttgccaaggctggtctcaaacatctgagctcaagtgatcctcctgcttaggcctccaaaagtatgaggattacaggtgtaagcctctgtgcccagcctacaattttttcattacaaaaaaaaatccatgatttatatctaagtatagaattgctagattgtaggccaaattttcagtttttaacatgccaaattattccataacacttgtatcattctcttataatttatcccagttcctctcatttccctctgtctttaatcttatctattttaaaattagagaagctatcttgaaagtagtagcctttcccttctcattggtagcataaaagccctaactaaatgcatacctttatcactttgttttgtaaattttccttattatttgtcttatgtttatttaccactttaaaccacaagttttcttataattacttaatccttttatccctttgcattttaaaatttcacttataatattgctgaatgataaaattgtagagcagaattccaatgacgactgaagtttaaatgaagtctaaatttcatccatttagttctttgtaagatacaattagggggccgggcacagtggctcacgcctgtaatcctggcactttgggaggccaagtcatgagatcaagaccagcctggccaacatggtgaaaccccgtctctactaaaaatacgataattagccggacctggtggcaggtgcctgtaatctcagctactcaggaggctgaggcaggagaattgcttgaacccaggaggcggaggtcgcagtgagttgagatcatgccattgcactccagcctgggcgacacaagtgagactttgtgtaaaaaaagaaaaaatacaataaggggcttgtttttcttttttttcatcattttctttactcactttataacagggcctacctggtcccactggtataccagggccaattggtcccccaggaccaccaggtttgatggtaagctctcttctttaatttaatttccccccctttcctttctgacttctttcaggaatattaatattatttataatacttgaaaacataatgcattctcaacattcataatttataattttcttatgtaaaggtgactttacaatgatatggtgaataatatgcattctaagtaatggctccattttatagatggaaaaatgaggtatataaaaggaaagatttacaatgaaatattttgttggttgctcttgatgtatcagtgttgaagtcaattctggccatttcagaaagtcttttaaggcagttttctaatcacttgatgaaacatgtttcttcaaactgcaattgtttgtttaagaagagcaaaagcagggcttcataaaaaatattggctctcatttcctaggcgcctgggacaaaacagtagaattggtgaggggagtgatcactatgcaattggtcacaggtttttgtaccccaaaaacttctacagatcctgaatgtgcaaccggttctcttactttactagctctgtagtcactcttattttctatcctagtaaattctaagtatttttacttctgcaatacttagatttcattcaagtcatgttttggacttacagctttgctgttgccctcttaaaagggcaagaaaattgtatttcagtagaagtaatttctcatgtgccactctatctctcatctaccatatatttaagtgacagttttcattatacctttataggttgtacatttttgtttgtgacaattggtcctgcacttttgagtgaaggaaataatgtttgataactgctagaagaatctaccagaaaagattgtgatttctgctttcctgtaactttttgggggaagatgagaaaacccttttgtttgttttagttgtagacttcatgcaaagcatgaaactatggactttcgcactttttcctaattctgctgttggaacattggtgccccttgagtatattgttacaccttgaatttcctcaaccattgtggccacttaaccgattcactttacgtttctggatattccttgaattaacgctaattcaacaggtgaagccaaatcttagaaatgccaccaagaggccaggtgctgtggctcatgcctgtaatcccggcactttgggaggctaaggtgggtggatcacctgaggttgggagtttgagatcagcctgaccaatatggagaaaccccatctctactaaaaatacaaaaaattagccaggcatgatggcacatgcctgtaatcccagctactcgggaggctgagacaggaaaatcgcttgaacccaggaggcggaggttgtggtgagccgagatcgttccattgcactccagcctgggcaacaagagggaaactccttctcaaaaaaaaaaaaaaaaaaaagaaagaaagaaagaaagaaatgccaccaagatacaatatataaataaataggcccattgaggttaagaggcaacatacttgagcagaaaggtgcctatttaattttttaaaccttgaaacattctcagatacacaaagtcatattgtataaaaatcaaactggattttaaaaaataaacacatgctttttagaacttgagagttaattagagttaattgctttatggtacctaagtttacctataattctgatgtgaaaaatttgatgggtctgttgagattaacttttgaattgatttttgacaatggggctacctctctacctctgcccatcccagcttttttctcttgcccatttctattttgtcatcagaggtactcacattcatctagctcattttaatcaattaaaatgtgtgtctctgactaaaatgaaaacaaacaagaaaatactattttgatgggctttttcacaccttactctttctgaaactaaataacttttaaaattaacttattaatataacattttattttctcttttgtcttctcttcttagggccctcctggtccaccaggacttccaggacctaaggtaattttctttttctttatatcttttatttggtgtggattccttttcttactgtcagtgagatttttaaatggaaacttctctctccaggggaatatgggcttaaatttccagggacccaaaggtgaaaaagtgagtaaagaaagagagctggttattcagccctcagctttctctttttgtagtcatttgaactgtctttttctttctcttgcttcttgaagttatcttatcttacatgttatattactgtctgtggagattatgaagtatcaccactgtcttattttatcttgcaaacagggtgagcaaggtcttcagggcccacctgggccacctgggcagatcagtgaacagaaaagaccaattgatgtagagtttcagaaaggagatcaggtgagtaagtagggaggaagtcaatgaaaatcttgctatggatatgttaattagtttgatggtggtaatcacatcacaatgtatatgtatatcaaaacatcacattgtttacaccttagatatatacagtttttaatttgtcagttatacctcaataaagctgaaaaaaataaaatgataaaaagttaaaaataatatttctatgtaagtggaattccattaaaatgcattataagctgaaatgtggttatatataagggtatttttttttaaataacaaggatttgagattattaattttttttttttttttgagactaagtcttgctcttgtcacccaggctggagtgcaatggcatgatcttggctcactgcaacctccgcctcccaggttcaagcgattctcctgcctcagcttcccaagtagctgggattacaggtgcccaccaccacaccctgctaattattgtatttttagtagagacggggtttcaccatgttggccagactggtctcgaactcctgacctcgtgatctgcccgcctcggcctcccaaagtgttgggatttcaggcataagccaccatgcctggccaagatcattaaattttcaaaataactttatcaagatacagtctacatacatataatccacccatttaaagtgtacaattcaattttttttttagtgcattcacagggtagtgaaactatcagtgcaatctaactttagaaaattctgaggcttcctcaaaaaaatctccatacctatgttagttgtactccttatttctccccaaattgaccagccctaggtaatcactaatctacttcttggctctgtaaatttttctattctgaatatttcatataaatggaatcatacaatatgtggtcttctgtgtctggcttcttttacttagcatagtgttttcatgttaaatcactttgcagcacatatcagtgcttcattcctttttatggctgaataatatttcattgtgtaaatagtctacattttgtttatccatttattcatcagttgatgggcatttgggttatttccatttttggctatttgaagaatccattcatgtataaaattaggttatggtaagtcagaatgatgacagtgttccctacatttcactgatatgcaaggagaaagataatgttactctataaacctttgttgtgtttagaaataattatctgataccctgcttttgctagagtagatgagggaaattagatatatttttaaagcatactggcccacactttaacaaacagaatgtgtgcatttttgtttcacttaaatgtgaataagaaagttaagaataaaggaaaagttgtattgaaactctatcatcaatatgaatttggccatttaattatctcccaaaatatatgtatgccgtgtgaccccaaaatctctttgttttaggtattcttgctttttataaaatattttataagaataaaaaattgtcattattttcattttaagtgttgccttgttatttacctcaaatcttggcttgtatatagacaaaaaattaactgaaatgagcaaagatagctctagttaattttgcctagaagatttcaactttaagttagaaacaccctattatctttggttgtactacatgagtattcagttcagtttaatttttttagggggagatttatttttattttattttattatttaaaaaagtcaacctttattttagatacagggggtacatgtacaggtttgtcacataggtatattgtgtgatgctgaggtttggggtacagatcccatcagccaggtagtgaacatagtactcagaagttagttttacaagtattacctgcctccctctactcttagtagtccccagtgtctattgttgccatctttatgtccttgtgtccccaatgtttagttctcagttataagtgagaacatgtggtatttgattttttgttcatgcattaattcacttaggattatagcctccagctctaaccatgttgctccaacatagatgtagctgtggttcagtttattaaaaatgctcctagctagctctagtgcttagaatgaaaatgcatgttccagtattaacattgatttcctttcccctactactgcatagggacttcctggtgaccgagggcctcctggacctccagggatacgtggtcctccagtaagtacctaaagtgctttagcatcatttaatgtaaattggtattggtacacagtatcccatgaaccattgtgaaactatttttatgtgtacagggtcccccaggtggtgagaaaggtgagaagggtgagcaaggagagccaggcaaaagagtaagtgatgtaactgctaatattctttgcaaaaaaattctaaatgtgtgtgtgtgtgattttattctttcttcctacatcttccattgtttcaaaatatcactactgacattataatgttgatgtctaaaaagtctacttaatatagtccaagccaggaataaagcttgttatattctttaactttatgcttcctaactaacaaatgtatgttgttgccctatcatttctttgtatcctatagggtaaaccaggcaaagatggagaaaatggccaaccaggaattcctgtaagtagctaaggttctttccccctgcaaaactggagacatttatgtgttggtataacataaggtggcagagaagcagtatgacaaaaattgtggggtctggaaatagtttaaatgaattgaaattatccagtctttgtcttttgaatataattttcaatttttaaaaaattttgtgagtacatagtaggtgtatatatttatttatgaggtacatgagatgttttgatacatgtatgtaatgtgaaataaggacatcacagagaatggggtattcatcccctcaagcatttatcctttgcattacaaacaatccagttacaccaaatataaatttgaggttcctctattttttaaagtcagatttattgagatataatttacataaagtaaaaggaactatttttagtttacagttctgtgtttgacaaacacatacagttgtgtcaccaccaccataatcaagaacacttccatcaccttcaaaagttccctcatgctcttttttagttatcccctccctattcccctatcccaacccccttataacgactgatcttttgtcaatctctttaattttgcctattcccaaatgtcagatacattggatcatattgtatgtagcctttcgaatcaggatcctttcacataacataatacattgaattgtgtatcagttcatttttttattgctgagtagtatttgatagtttgaatataccatggtttgtttgtccatttacacattgaaggatattttggttatttctgtgttttggccattatgaataaaacttttatattcatataaaaatatttatatgaatataaatattcccatacagtttttttgtgtgtgtgtgaacatgttttttcagtaaaagttttgacaggtaattcttctacttactaccaaaaaggggcatgggaaataaaatatgtaagtccaagaacattatttcaagcagcttcagtatcaagagtatccgcagtaggcaagagtttttcaaagacagagagaatatttgatgaaatttgtaagttattctaagggaaaaggataattcttaacaagacaggttagaattactaaattcagataaattggtttcaggatattttactaaacaggcaatcctcaacttacaatctctagttcaaaaatattttatattataaaatatcaagaggtaaattcagggcctcagttcctggcttcttttggaacaattggtctttgtcttgattcaggcagctgtgatattcaacaattgcctcttagtgttttcaacaaattggggttgcggggtggggaggctgttctcttgttctctgtttgcactgggagaacccaagttgggtcaaataaaggcagccttgcaaatagccttcttttgaaccagcagacagatcaaataatgataattctctggatatggggctttgaaggagctccaaccctgttctttcctctccaattgctgctaggctgctggttttcaccttgattgtgaggagaggtggtgtgaatagagcaagttaaaatgccacaaagctctgagaggtggtgggaatagagcaagttaaaatgccataaatctctgagaggtggtaggaatagagcaagttaaaatgccacaaagctctgagttctcaccaagattcagcttttttttttttttttttctgagaaaacactccttgaattgctgcaagctttggttaagttctgaaagttaattctgactgaccatttttgccagtattctcattgcttctatggagaagacaatctttggagatttcctaacaccatcatttgtgctgatgtcaccctatcctctatgttttaaagggtttgcctggtgatcctggttaccctggtgaacccggaagggatggtgaaaaggtaagaattttaatactttgaagtgactggtttagtctagctaaaataatccttttcttctcccaggcttgagttataaatggaaaaagtctacataactagcttttatattcaaaatatgccttctttattcatcttttgctcatttttcttttataccacacttgctaaattttattccattgccataaatcacagtccatgttgcagaaatacattaagcattgtttaactttagcatttccactgtgaaaagtcattgcctttactttgagcatgtatcggcaaaacttctttttttccacaaagagaattcagcactattttagtgaggtcctcttactaaaaaggcttataactgtgaatgtagaacgtcgccactaaacatttccattctgtatgcaattattgtctgtaagtctgtggctaattctttgttgttttttcccccctactgggccaatgcagtctgactgaggtcatttatttagttacctatttttcaagtgactttgaaagattgtatgaagcatacaattaccagatttttagcagggcacaaaataaccagtcctccaatccctcttgtttttaattgcttcgtatcaaaaactgaaagctttttggtttttcaggcaaggaaggaaaggcgttacaaacttgaatgtacccagaaggcacatattttaatggtggtttatttttaaattaggtccaagttctagcatggcttaaaaggcacaattagaatagatggaggtaggaaatactccgataaaatgattttttgtcaaatagtatttgtatatagatggatggcttctatgaacaagtttagagtcagaatagaagtatgaaaaagaccatccttgtgtcttggccagtagtagagtaacacttgaatattgaatattgtggtttttttcatgctgttgtagctactaatcaaggataaaagttttatctgaacttgtctttcattagcttctaagagcaagctcatgaaagcaattcagatttactagctattattgatgatagttaagtccatcacatctaaaatgtctgtcactaatagaaatggcactacatttatgtccttgactagttttatgagaagaaacatggctaaatgtaaaaaaaaaaaaaaaaaaaaaagtaattttttcactgattctagtgctaccattttttttctattatcttctttatagagtatttgtagttggctagaaataggaatcttaaaaatcaaagaatattacaactagaaataccttaaaactctggtccaaaaatctttattctttctatataaaccagagaagttaattaacttggtgaagattacatagctagtaaatctgagacaccatcacaggttaggcttagctcagaattgtttcattacttcatgttgcatttctcatttgaggtattttatgattgatttctgggtctttttggaaagtttctcttatattcttgaggaaattgatgttttcatgtgaattttactaacctattttacaattgcattgaacagggccaaaaaggtgacactggcccacctggacctcctggacttgtaagttttttttttttagtcttcgtttatcaaatttattaatgcattatcatttttgtgccttaatcgcatactccctactttttcttgatagaacacaaaatttcaagtcattatcaatttctactggcttaaaagtctttacatctaaaatcttcagtaatgttgacctcaaggtctttgtattgttctgcctatgcattacttctgcatggtaaaggtctaaaattatggcattgggttgttttgcctcatgattgccagatcatttctcaagcaaccagcaggtggtgcaagtgttgcttacaaaggttcaatgaaaacaacaacaacaaaacaaaacttggggaagttggggtgggggtgggggattggtcctttcccctgcagagctcaggagaaagatagatttggtcttaataggttttctcaatttgtaattgtctgattcacacttctttctttcctgagtgtgtgctttctagggacttttaataacgcatgtaggaagctgctttatgaaagaataattgagggtggcggagctacagattttctgtcatgtttgtgttcactatgaaatttaagtcaaatatacttccagtcttattaggaataaaatatcattgctgaggtttaacatattggtttttctttggttgaaatttagtaagactcttgacttcaaactgcattgaagccgcaacagtgcgaatgttggaaaacttatgtgtccagacatgttagtaacattaacttaattcgtattatccataatgagtctcagttattaatacttaggactgtactaaatctaatgaggatatacttaaagaagatcttagatattttttattcactttcattttaaaatcagcttcagtcctctaggaaataatctctttataaaatgagaagataaaattttaataagtatcagaagaaatggaaattttgagagtacagtcctatttagcagcctagtttcccttttgaatcactattccaatcttaggtcccacaactttttgtcttcttttgtgtgaatatttcttatatccatccaatagagacaggatgaaatatcacactgctattaggtgttgatttgtacatcagactggcagtctcttaaatctgaagttcatttacctttataggtctataagaagaatttgttaatatttaatttatttaatattaagttttttaagaaaatacttaatgagttacaagaatacagagtaaaaagaaatgattagttagttgggtttaatcaataaagaacatgggttttatttttaaatttttttggtatatagtaggtatatatatttatgggggagttttcttttttaaaggaagaaataaatgtgggttaataaagagaaagattggggaaaggcattacacatgtttggaatgaaatatgcaaagacatagacaagaacgtgcaagttgaatgaaatggttagaatcagacagacttcactataataaaaatttattgtaagacgtagtaggagattaaataggtgagagaagtattggaagtgagaggtgacttacagttcaggattaaaagtagcagcacttatagtaaaaagtagtgagcaattttgagtccttaagcagaatagttaacacacacacacaaatggtttttgaggaagcatatcctaacaatagattggaattcaagggacaagatcagaggtgcttctattactctaagtgtgagttgataatatagctgtggcagcagaaatcaagggagcaaattggagagacgttttctgtaaagaattgtcaggcttaggagattggaatgaattgaatgtgaattataggagaagagacatcaaaaatacttttagttttatatgcttcgggctcaggaacatggtaatgttgttacttgtattggacattttctaatcagttggaggatgggagtgatacaaaatgtgactcataaactatgtgaaaatgatgacattgtaatcatatgtagctcccataatgttttcaggagaacaaggcttttcttctttgcatttctttattttttttttctttggtaataaaggtaattcctagacctgggactggtataactataggagaaaaaggaaacattgggttgcctgggttgcctggagaaaaaggagagcgaggatttcctggaatacagggtccacctggccttcctggacctccaggtaaatgagattgcatttatggccttgttcttatagcatccttactaatccatgtatactttttatcacattagttccatggtcagcatggaagtaggagacacaagtcctttttaattgacagatacttcccaactcttactataccttctctcaccatattactcacttgtactttaaaaaagcccaagtgaatagtgtcctttaatcctaagattcctatttctacattttattttttattgatacataattgtacatatttatgggatacatgtgatattttaatacatgagtccaatgtataatgattaaatcaaggtaactagaatatccattacctcaagtatttatcttttctttatgttgggaacattcaaaatcttctcttctagctgttttgaaatatacagtaagttgttgttaactgctgtgaatctactgtgctaccaaacactgaaacttattgcttctatctaactgtatgtttgtacccattaaccaacctttcttcatttcccccgacccttcccagcccctggtaaccatcattctactctccacctccatgagatcaactttttttttttaacctcctacgtaagaatgagaacatgcatttgtatttgcctttctgtgcctggtttatttcacttaacgtaatgtccttcaggctcatccatgttgctgcaaatgatagaactccgttcttttatggccaaataatattccattgtgtatttataccacatttcctttatctgttcatccactgatgaacattcaggttgatttcatatcttggctattgtgaatattgctacaataaacatggaagtgcagatatctctttgaattactaatttattttcttttgaatatatacccagacgtgagattgttggaacatatggtagttctatttttagttttttgaagaacctccatactttttttcataatggttgcattaatttacattcccaccaacagtgtgtgagagttccctcttctctgcatccttgcagcatctgttattttttgtctttttgatgatagccatattaactggggtatattttattattaataaattacaccaaacaattcttaatttagtaggcaaatcatcacacttttcatgctaatagggaaggatattctccccaagtaatgcctagttttgcaagatttcctgtataaaaatggcaagcagcgttatccacctaaaatttcagaaatacctaactagaaatccccatggtgattttgttatacaataaaatcttagagctcaatactgagttttatattattccctttgaaaacacacagtatagtggaacatttctaatttggccacaaattgagtactgcccttatctagaatgtttatttgaatgttctctgaaatagggtaataatagtgatttccgtaagatttctagatgcatgtggtacagtgcctggcacacatacatattcaataaattattattccttttccttcaaaaatacgtggctaatgaaatactaaaatgatgagatgagtgatattcagtgatctttcccaagagaaagaaaataaatataggttccattatgctctaaatgcaaacttcagattcctaaatgtgaacttcagattcctaacctcaagatagtgaattaaatacagactgtatctggaaaattgaaataaagaattatctcaggatgcagtaaaagagataaggagttgggaagtatgaatgaaaagttaagaggtatgaaagataaacctagaagctccaaaattatctcatgagggaggtcaaggaggagagaatgggacaagaggcagcatttgaaaaaaaataatggctgagaacttccatctattaaaaaacacatgcatcactatgaaaaagctcatgaagcactaagcaatagtaaaataatagtaatgcaaaggtccataactagacacattgtagggacatttcagaattcagggataaaaagaagctcttaaaaactatttgagaacaaaaggccaatcacctacaaagcagtgagtcagaggatgataatggagcacattttcaaagtgataaggacaaattactatgaattagggattctgtattacattaaactatcatcctaatgtgaagatgagatacataggaagtttaacaccttcagactgtctctgaaatagttactggaggttttactccaaaaagaaaaaagggaattctggataaaatgagaatagcggtaggatgcaagaaccaaagcttagaaaatatattagtaaagcatattaagtctaaatcagtactggttattttttaaaaaggtgttttaagtaacaacttggagctataattgtaaacattattaacgtgatgtgtagatgcagagagaataaggataagagtttttgtcttgttagggaaagataatataaatcttgttaactgtataaatttttagaaatgtatacatgtttaagtacataggttaaaatgttaatagtagccactagagaagaatagaaataaaatgtataacatacacaccaattgaagaaagaaaatgactaaaagtctcatatatagtataagttaagatgggggcaaaataaagacaaatctgggtaaatagaaaataaaatataaggtgacaagaagaaattaaaaataagtcagtaactccaacaaatttgaaaggactaaacactgattaaaagacagtgactaaaataaaattgaaattaaaaatacctatatatagtgcacagtagacatatctaaagcaaagtgacagatacaatctgaaaataatgcagtatatattgggcaaatgctatacataaaaaagctggtttagcaattctaatatagtatgaaatataattaaattcaaaacttgaaactataaaaattctagaagaaaatgcaggaaaaacttttctggacattgacctaggtaaagatttatgactaagacttcaaaagtaaatgtaaccaaaacaacaatagacaattgggacttaattaaactaaagagcttctgcacagcaaaagaaacaatcagtggagtaaatagcctacagaatgggtgaaaataattgtaaactgtgcatctggcaaaggactaatatccagaatctattaatataaggaacttagacaaatcaataagagaaaaaaataaccccattaaaaactgggcaaaagacatgaacagaacacttcttaaaataagacatatatgtggccaacaaacatgaaaaaatgcttaacatcactaatcagcaaataaatgcaaagtaaaaccacaatgagatactaacacattagaatggctattattaaaaagtcataaaataacagatttgggcaagaaataatttcagttattcagagaccatctgattatctaccagaaagctttaaaaaatccattgacaaattcccagaacttaaagagaatatgtgtgcaagatggccagatctgagtagcatacttaatttgccttcctcttcaccagcaaacgtacaagagaaaaaaatacacttcacaatagtaatagtattaaaattcacagtagaataaccccaacaatacatgtgtaagacttctttgcagaattttgtaaattattattaaataatataaaattactaaatagagaaataaatttaattattacttgatgtgaaaaaccaatataataaacagttgattctaccaaaaaataatctttaacttcaaattaatcccattcagaatcccaaccagtttttgaaaatgaaactgaaaaatttatttagaaaagtaaatttgtagatggttttaaaaatgaacaaagatgagcgtattttccttagcagttttgaaaacattataaagtcatagtaactaaaaagtgtgttaatggtgcatgaatcaccagtgtaacagaagaatgtccggaaacagagccatgtttatatggtaactttgaaatacctttttatcttgctaatgactttccggtatttttgagattataagaacagattgtcaaaggatggggttactagtaatttccaaaagtagtaaacctactttaaattattatttcctaccctcaaactgttacttacattctttgaaacttttcaacctttttttcagacttttgagtctcatagaaaaaaaataacataaccagaattatatgttaaaggaagatcttatcattatctaatgtctcaatgagaactaaagtaacatctctaagatgaaatcattttgatcacttttttgaatcttaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtaagctatatttttctcctattaagttctatttttgtttttgtttattttgtttataagtaactctagctaaaggttggcctcatttgttgcgtttctgatatctaagaaattctaccactgcttctgctttttgggttttggtagttcttggatgtttacatttgctcttcatatagtatttatcagcaatgttatattttccttttgcttataggtacttttatttcttcagagaataggtctttttctggcttgtcaggctttcttttgtttaatcttctggatatttcacaattagcttgctatcctttctttatcttactcaggtgatgagatatgtgaaccaggccctccaggccccccaggatctccaggtgataaaggactccaaggagaacaaggagtgaaaggtttgatctccaaacatattcattccttcattttcttcattctttcaaatcatcagcaaaatcccctgtatcctccatcacaccttagccactgactcccatggtcataccccaagaccatctcattaccaatagtgttatacttacatgaccttggtttcatgcatcccattttttggatcgctctcttctttctagcttactacctctagtaacctgactccagcaatactccaaccccactgagacctagcaactttgactaatgcttaactttttgatgtcctttcttccctcttaaccttgcttaagttccattatcaatcactgtaatcaattccattcataaatccatgattcctttgcccttctctcacttcattgcactcacttggaacaaaagcataatccaaattttcatgttttctgagcctacactttctcttctcttttcaagttttaacagttcctcccctattcttaccttgcttcctacttcactgaccaattaaagcaataacaagagaactttcactgattgctaccaccatatttacttacctacttgcacctgtgcccatatagtctcccttcttgcatattactgttactgctcctatctaaagccagttcttctatttatacaatagattccatttcctcttatttccccaaggattttttttccagcaatttttgcctctccgacatcaccaatttttccctctctattcagtcattccaaggagcatacaaatatgcttttttcacctatctaaaaaaatgtaatcctacattccctgccagctgtttctctatttttctattctcatttgcaacaaaacttcctaagaattttctcctcattacctctagatactctcctcttgttttctcttaaacatactccaatcaagatttcatcccctcttcccccaactccccactgcctaccactccacaaatgctggtcagtcaccagcagtctatatcctactaatccaaatgtcaggtctgtcctttttttgcttgctttttgccttctttaaacatttgcatcccttagctttcagtacatttcctgttttttttttttcattcctctgtggtgtacatatatgtgtgtgtgtgtgtgtatgtgtatccatgtaattaccatctaaaccaaaatatagaacattttcaggaccctggaagactcttgtgctccctactcagtatcccccaaaggtaatcactattttatcctctggcatatattaatttgcctaatcttgaactttgtgtacatggaattatactgtatgagctcttttgtgcctggtttctttagctaaatatatgtgagatatatctatgttcttgtttgttgcagtatttttccaccattctttgttttccactgcacattacctcaatattctaatgttgatggacatttggtctggagctattgtgaataaagctgtcataaatattcttgtacgtgtattttttttgtaggacataaacactaatttttattggggatatatctggaaattgaattgctgggttataggttaggtgtaggttttgtttcatagatattaccaaaccatgttccaaagtgattttcatttgcgtttgcctaatgacttgattatgaactatttccttacagtttttatattctcttttgtaaagtgcctgtctttatctttaatttgattattggatatatgtattaaaactatcttctgttttgttaacttttgtttaacaaaagttgctaattaaatgaaatcaaattaattaatttcctattttatcgttagtactttttatgcactgttttagaaatctttacttatctcagaggcctgatgatattcctctgtgttttcttctagacactttattgttttacctttcacgttttgatctttcttcaattaatttttgtgtatagtttggagtagggatcaaagttcatttttcccatatggatgtccagttgactcagtactatagaacaaaagatcatcaattaccccaatgaattgcattagcactttttgtagatcacatgaccatatgtgtgtaggtctgtttctgactgctctattctgttctgttgtttcattagtctctctttgcaccaatacgatactatcttaattactgtggctttattgtaagtgttggatattctaggttctttgcattattttgtgtgcatcttagaattatctatccaacttttaagtttaaaatgctccaaggttgagtccttgttcttcttttctatataaactcatttattcagtcttgtgactgttaataccacctaattgcccatgacttccaaatttatgcctcctatccagatataactcttttcctctagatttgtgtatccatttgcctagtcaacattttgaacttgacatcctgatcaaattgaagtcttgatttctgccacctcctccccatagttgctgcactcacatcttcagcttcttacttaaaaagcaggccactttagccttctagttgctcatgctgaaaaccttggagtcatccttgattcccctcttcttttgtatttcatatatgatccatgagaacatctcattggctctactttcagatatgtctataatctaaccggttctgatcattttcattgcagtcactttgaaatgagctaccaccatctctctcctagatcattgcaacagtagccacttaagtggttaccctgtttccatcattgcctttagaggctattaacatagcagctagagtcatcccttaaaaacttaagttataacatgttgcttttctttttaaaattttctactagattctcatttcactcacagtaaaaaccacagcctttatatttcttatatgcctatatgccattcgttataaactgtcaactttctgaccttgttcccctccctcattctgctctagcaatctggtctgcttgctgttccttgtatataccaaacatggctattctttctgcttgggatgttctacactcttatgcacatgtcatgtcctttaagttttatcatataacaacttctcaatcaagtctatcctgactaccctatttaaaattgcaaccccccacccttccctggcatactcaataccacttatgtagttctattttttcctataaaaataatatattttaaagcatattaaatatttaatgtatatttaatttttttagacagggtcttgctctgttgcccaatctggagtgcagtggtgcaatcacagctcactgcagcctcaatctcctaaggctcaagcaatcctcccactttagcctcctgggtagctggcaagtacaggcatgcaccaccatgcctggctaatgtttttattttttctgtagagatggggtttcgccatgttggccaggctggtcttgaactcctcatctcaagctatctgcctgcctcgggctcccaaagtgctgggattacaggcatgagctactgcagtctgcctatacttaatattctattaaaatatttcatatatacattttgataattcatttcctttattgattattatccctttcccctggtagagtgtgaggcatgtagacatgaatttttatccatgacttttcttttgctcaccaatgtaacacaagcatctggaacagttcttggcacacagtaagcactcagtaatttatttgtcataaattgattcaggatataggcttctccaatcacaccattaagtggaaatgctgtcccttagtgctaacatttttagaacctatctatagaaggtatatgtacccctttcagtaaaatttgtttgttattatgatttcactaggtgacaaaggtgacacttgcttcaactgcattggaactggtatttcagggcctccaggtcaacctggtttgccaggtctcccaggtcctccaggtaaattatgcctcagggtaaccttctaaatattttttggctagattttgttgagcttatacttttagaatgttaccagtttctcattttataactagtcactcatatctataaagaattaagtatgaaatgcctccatttgttatcaaattaattatgctcttgtttctaatacctgaagctaccaatatattctattaaagcattttgacaatataatttcaggaaatatatcttccccattttccatatggagaagaaaatcacttatacagagtcagacttctttcttccagaatactgggagaaaagttcataatgcctagcccctgagtgtagtttccagtggcagagattccagtcactggggatgtatcacatgttgttgttcaggaataggggttctattggagtttggcaatcaactgccagtattcctctctctctatatataacacatctatccccctttccagtcaaaactatatgtgatatctgtcagaccctcaactgtttcatttaactgccccttaggtatcccagtattctcttgaaattacactttatgtttgagtcagggctgagaatagacaccagatctcttacctttctgtctagtgagtctactaaggacaccaattcatttggaggttgggaatactttcaacaaatcttgtagacattattggacattaataatctagccttgtacctctagtctcatggttctcaaacttgagagtgcatcacctggagggcttattgaagcccagaatgctgagcctcactctcaaagtttctgattcagtagacctggatgaaggctcaagaattagcatttctaattagtagccaggtggtgatgatgccactcatccagggatccatttggagaaccactgctttagtaatgtttcctctagtctttgggctgcaaatgtttctcataaaccaaatttcagggaatgacaaaccaaagaaaggactggtaaggatctaggaaaactgcataagtcagaacaaagatattcaaaccttttcattatcttttttctccctttggcaatgggaacatcataggaacccaggaaacgttgtgcatagtatttggcagttgcaaggtctgagaaagtctgctttggagttgaaagtttcttaggatacaatattgtatgtaacatgaaatgttaaatttattttttaaaaaggatgattacctcattttgtgaacataaaaggaaaatacaaatgtgacttaaatgggattgaatggggttcttattttaaaaacttgactttctgacttgatgatttctgtatgagctttgtcaggagttcaagctcaaagcttacgttattgtgtgtgtgtgtgtttgtttgtgtgtgtgtgtgttaggatctcttggtttccctggacagaaaggggaaaaaggacaagctggtgcaactggtcccaaaggattaccagtaagttttgagtatattataaaacaaaaagaagtagaaggaaggcattttacacattgattttcaattattcatatatatacacacatatacaatttaatttttccattaagttgtactttgtttgattccttgactcttcctgactcacatgcctcacttgattcagccctttgtacattaaatgttattggatgggttgaaggggtaaactggagagaagaaaatgttagaaaaaaagaaactgattttctttttctctttcttctttttccactcttttttctttttttccttactcatttcagggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctgtgagttggtttgatatttttggttttgtgatgttaaattttcacttagaaatgttttctaagttaattcaaaggatgggactgatgctgagataaacacccaatcaatgcttaaaacaatgtgaccatacagtaatggcacattgttactgactacgtagggtttctgcactactcttttctttcacttgttttgtaaacttatttttcttaacccattaatattgaatactattttctatgaataggtgggcaggaggttaagatgtttatgagacagtataaggttccccatctcttaacccccacatatctttccttgggtttacttaaacctcatgactgggcatggtggctcacacctgtaatcccagcactttgcgaggctgaggtgggcggatcacctgaggtcaggagttcgagaccagcctggccaacatggtgaaaccctgtctctactaaaaacacaaaaattagccgggcatggtggtgggcgcctgtaatcccagctactcgggaggctgaggcaggagaatcacttgaacccgggaggcggaggttgcagtgagccgagattgcaccactgcactccaccctgggcaacaagagcaaaactccatcacaataaattaaataaataaataaataaataaacctcataaccagcagtttaacttgtttctatatatatagtaagcttagagaatagtacaagtagatagccatgttcaatgtgccacagaactgaaagatttaacataaatgaacaatcttattttgtacataacacacagcccaggatatttaggtaggaagtgatattttataatgttatctagactataacctttctgacttacactaaaatgtaagctgcataaagtcagagatttttgtgtatttttgttttctgttgtatcaccagcacttgacacatagtaggagcccaaaaatatttgttggaggaatgagtaagtggaatgatcacacataccatctcataataccactcacttatatagcttttaagaagaactatttatggctatatcctttccccagttgtattcagtaccaacctacagatagttgttgtatctatatgtttctgtattaaacttttccctttttagggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtaagtttactgtgttttgttttaaacttggtgcttaaaaacagaaatttattatgttttggctactcatggcttcctttcccgagaggtgtgtttccctggccgtttatatttgaactcttcagagcatcttagcaagggatcacaatggtttttataagggggtttctttttaaatcttttctaactgtttcattgttactgttaattttgctctttttaagtacatgatacataatgcaaagtttaataaatagttataacagaagcacacaggtagctaccacacacatcaaaaaatagaatgttaccagcatcctagaaacccctaaccttttctccctgtcatttcctaatcacaatccccttcctcctgtctgctgtcttgacttttacatagttttcttccattacccctctgttttatgacctctgtatgcatttttaaacagagtattttaattttgtttctttttgaacttcatgttaaaggaatcatagggtaagtgttttttatattaacttttcgtgtggctatagtgtattcatttttattgctatatagtatttcattgtatgtatgtttatgtgtgtgtgtgtgtgtgtgttacagttgattgatccattctatggttaatggttaattgggttatttacagttcaggtctattatgaataatgcttctgtttacagtcatatagatagatagctaggtagatagatagatccctatatctccttgtgttcatgtgctcacacttctctagggcaagagttggcacactacagaactacagtccatggaccacatccagcctaccacctgttataaataaaagttttatgtgaacacttccacaaccattcacttttgtctgtggttgtttttgcactacaactgaagagttgagtagttgctacagagactggatggtccacaaagcctaaagtatttactctggtcctttacacaaaaggcttaccaatacctgggctagggtatgtatttaagattagcattttcaaagcataggataagtgcatcttccacttgactggataattacaaactctatccagaccaattgtaccaatttttactaccacaagcagtgttgaatattttatgttgatttacatccttggaaacaatttgtattgtcggacttttacacttttgccaatctgttgagtgtgatattttgcatttctctgattaaagtttagcaccttttcatgtgtttattggtcatttgaatttgcttttgtgaaatgcctaatcaagtactttgaccaattttatattggattatttctttttttattgatttagaggagttctttatatattctgtgcattagttcttagttacctatgtattttgcgaaaagaaatctttacctactgtggcttgccatttttactctttgtttggtgtcttcaatgagcagaaaacaactttcacatcatcaaaattatcaatcttttctctcatggttagtgctttttgtgtcatgtttaggaaatcttttttttcttgagccaatttcaagttcatgtttccattaataagaagtagatatacttgaactttgcacatgtaaaacctaaatgtacctattagccaaaaaaatattttccttgtttactacagtttgatttttaatgctcttttggcctacattttaaaaatacttatataggtaacaccctgttttaggggtttccagagaaacagaaccaataaaaaggatggacagatgggtagattagatagatagatagatagatagatagatagatagatagatagatagatgagaggtgatttattatgggaattgacttacatgattatggaggctgagaaatcccacagtaggccacctgtaagttgaagaactagggaagccagtagcttggctcagtcctagtctgaatgcctgagaacctgagtggctgcttagtacaagtcccagagtctgaaagccagagaacctggagttgtgatgtccaagggtaggagaggatgggtgtaccagtttcaaaagagagagagcagagaattcacctttttttctgcctttttgttgtatccggtccctcagctgattggatggtacccacacacattgggtgagggtggatcatccttattcgtttcactgattcaaatgtcagtttctttcggaaacagcctcacagacatatctagaaataatgctttaccagcgatctcagtatctcttaatctagtcatgttgaaacctaaaattaaccattatacatcttgaatcatggaagtccttaaggctgtcatatcctttttctttttgaaattctatccttctgttttatatatttcttgaatatatagtggaagattgtttttcttgtgaatttttgttagtttacattttcaaaagattgctgataattttcttttttgtttttaattaaaaagagacctttagttgagtaaatacttctcatttaccattgatttactcttgctttcaggtcctaaaggggatccaggtcagactataacccagccggggaagcctggcttgcctggtaacccaggcagagatggtgatgtaggtcttccaggtatgtgaggaatttatttcaaagtaacttcaacaccgatggcttttttttttttttttttgacagagtttcgctctgtcacccatgctggagtacagtggcgtgatgttggcttgctgcagcaacctcctacttctgggttcaagcagttctccctgcctcagcctcccaagtagctgggattacaggcgcccaccaccacgcccagttaatttttgtatttttagtagagacggagtttctccacgttggccaggctggtctcgaactcctgacctcaggtgacccattgcctcagcctcccaaagtgctgggattacaagagtgagccactgcacctggccctgatggcttctttctttgaacgttttcctttcaataactgctgtttctccataggtgaccctggacttccagggcaaccaggcttgccagggatacctggtagcaaaggagaaccaggtatccctggaattgggcttcctggaccacctggtcccaaaggtatgttggaatgggtagcaggcagagtaggttagaagtttagcatgatgttattctctcataaaattcattcaacaaataaaatatattaattgcaccttttttctctgtgctataaagaatgtaaataaaaaatcacagtgtattttcactgtaagttcattatctttatctaaaacagtccagacaagaaaatatctacattttagatatgcaaaagtgatatataagcttaaaaatcacaggaattattgtgttttgtgttcaccatagtattttcagggtttagaacagttcctaacacatagtgtgcacttgatgtttattgagttaaaggattttttaaacagaaaacagacttattgcagatgtgtagccaagtaatgttttatgctaaataatattttcttgatttattgaaatttttagggcttatgcttcagttctgctttattcctcacagaatttattctcacaaatggcaagagcacacagtggtctgaggacagttcttaaatatatctttactcatttatacaaaatgctttcaaaagtatcaggtttgattttatgtgtgtatgtatctataatatctgcagttatttttagatcatttccaaaattatatggtaggccctttgtcatactacatccagatataagcagaagaaaagttcttgggcatttttgtgtgggattcattccttacaatttagttctatcttattatataatagccctcattttcttcagaaaagcatatgttccacatacattagctctatgtgaaaataaaaggaatgtaagatgattgagaggattgtaaggcttaatcctaagtagtagaatgtcattgtgcttttgacatcttactgttgtcactaagcatgagtagaatgtgggtttgggaatttgaatatctttcttaaagtgcctttcctttggtggttaaaaaatgacttatcattttacaggctttcctggaattccaggacctccaggagcacctgggacacctggaagaattggtctagaaggccctcctgggccacccggctttccaggaccaaaggtctgggacatttttctttattccttctcattttcttatctttcccaccttccttatttctagctctctattttgactcagatatcatcccaagccccaagtctttactataaatatacagataacttattatatttccattaaaaaaatatttaaccccaaatcatctttaatagtccaaggtcacatttggagcaaaaaaaaaaaaaaaaaaaacctaatttctgtacctacttttgaatgcccagttctttgattagagaatacaggcataccttggagatattgcaggtttagttccagaccaccacaataaagtgaatatcaaaataaagtgaatcacacaactttttttgtttcccactacatataaaggttatgtttacactatactgtagtctttaaagtgtgcgatagcattaggtctaaaaaaaaccatatgcataccttaattaaaaatactttattgctaaaaaattttagcaatcatctaagcttgcagcaagttataatctttatgctgggggagggttttgactcaatattgatggctgcccactgatcagggtgatggttgctgaaggttgggtggctgtggccatttttttaaataagacaacaatgaagtttgccacatcaattgactcttcctttcagaaaagatttctctgcagcatgtggtgctgtttgatggtattttacccacagtagaacctctttcaaaattggagtgagtcttctcagaccctgctgctgctttatcaactaagtttatataatattctaagtcctttagtgtcatttcaacactgttcccagcatcttcaccagggtagattccatctctagaaatcacttttgctcataagaagcaactgctcatctgttctacttttattataagattgcagcaattcattcacatcttcattctctacttataattgttgttctcttgctacttccaccatatttgcagttacttactccattgaagtcttgaaaccctcaaagtcatctgtgagagttagaattaacttcttccaaactcctgttaatattgatgttttgacctcttctaatgaatcctgaattttcttcatgacatctagaatgaaacccttttcagaaggtttccaatttgttttgccagatccataagaagaatcactatttatgacagctatacattacacaatgtgtttcttaaataataagacttgaaaattaaaagcactctttgatccatgggctgcagaatgggtattgtgttagcagccatgaaaagaacattcatctctttgtacatcaccatcagagctcttgggtgactaggtgcattgtaaatgagcagtaaaattttgaaaggaatcttttcttctgaggagtaggtctcaacagtgggcttaaaatagccagtacactatgctttaaatacatctgctgtcatccaggctttattgttccacttatagagcacaggcagagtagatataccataattcgtaaggccctagaatttttagaatggtacataagcattggtttcaacttaaagtcagcagctgcattagtccctaaaaatagagtcagcctgccttttgaagctttgaaaccagtaatttacttatcttctctagctatgaaagtcctatgagcattttattccaatagaaggctgtttcatcaacatggaaaatctgttgtttagtgtagtcactttcatcaatgatcttagctagaacttgctgcagcttctatatcaaaacttgctgcttcaccttgcacttttatgatgtggagacagcttcttcccttaaacctcacgaaccagcttctgctagcttccaacttttcttctgcagcttcttcacctctcagtcttcagataattgaagttagggccttgctctggattaggtttttgcttaagggaatgttatggctggtttgatcttctgtccagatcactcaaactttctccatatcagcaatagggctgttttactttcttctcattcgtgtgttcactggagtagcacttttaatttccttaaataacttttccttcacattcacaacttggctaactgtttagtgcaagagacctagccttcaacctaccttagcttttgacatgccttcctcactaagtttaattatttccagcttttgattttaagtgagagacatgtgactctttctttcacttgaacacttagaggccattgttgtgttattaattggcctaatttcaatattgttatgtctcaaggaatagaaagacctgtggagagggagagagatgcggggaaaatggctgatcagtggagcagtcagacatttacaacatttttttattaagttcaccatcttatacaggcacagtttatggtaccccaaaacaattatgtggtaacatcagtgatcacatatcaccataacagatataataataattaaaaagtttggaatattgtgacaattaccaaaatgtgacacagagacaaaaagtgagcacatgctataggaaaaattgcgctgatagacctgctcaatgtagggttgccacataccttcaatttgtaaaaagtgcagtgtctgcacagcacaacaaaatgatgcacaataaaataaggtatgcctgtacgatggtctgctccctctgtgcatctctatagagtcatcatcccatgtcatctctgttcatgcctgtgtgatgattggttgaaatggtgttgaatatcatttccagaccttgtatactgttgttctctgtcccaattccattacagatacataatgcaaatcactgcaattgacttagtaatactaataataaataatactgtgtttgagttacttttcattccttttattatttcttatctaatgttaagctttcctgagtcaaccttcagcaaagagctgctgtggcatgtaattatcgtgactatttttatatattttatctctgcgtcattgatttaaacctcctgtgttttgtaattattacttatttttcatgggaaaaacagttaacccgtgacaccagttctcatgagaaaaccacttctctattggttgattctctttattatgaacattttcaaatgaaaataaaagtaaaatgaataatacaatgagctttcacatatccatcacccagattcaaaattattatgattttataacatttgcttcatctagtcctttttactttgcttaaatattttacccaaatctcaacacagtatcatttcacttataaatgcatcagcactcatctctaaataaattgacattttatacaaaaaccacaatgttgttatcatacttagtaaaattaaaaataattgtttagtattatctaatactcagcctataatcatatttccctacaagggtagtctgttctttaatctcatgctctctcagttttttttttttatcctgaaaccagtccaaatcatctaatttgttttactaaaccctgtttccaatccttccatatgttttctccaacataccaattactttttatttaattatcttctcctctccccccatggaaggaaaagtattgtcttgtattttcggcattaaattctctgtggcaaacaataaggacagaaaagtcatgggagtttttgttgtgttttgtcatgtgtatgctcaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtatggaggctgtcactgcatctcaacttgcttttaacttttatagaaattgacacctttgggaaagtttatgggtgataagcccaattaactggaaaccctatgctgccattctgttactgctacacatttttttcaatccttcattgattatttttgtcttttatttcattgaatagataataaaatcatggcccggcacggtggctcactcctgtaatcccagcactttgggaggccaaggtgggcggatcacctgaggtctggaattcaagaccatcctggccaacatggcgaaaccccgtctctaccaaaaatagaaaaattagccgggcatggtggcacatgtttgtaatcccagctacttgggaggctgaggcaggagaatcacttgaacttgggaggtgaaggttgcagtaagccactccagcctgggtgacagagtgagactttgtctcaaaaaaaaaaaaaaaaacaatcatatatgttataaaagtaacactgagaagtcttccttccaacccatcttcatccactttgttcctctccatcctcctgcttaactattttttattctcctttcttccccccaccctccccccataccccaagacagagtcttgctctgtctcccaggctggagtgcaatggcgtgatcttggctcactgcaacctccacctcccaggttcaagcaactctcctgcctcagcctcctcaagtagctaggattacagatgcatgccaccaggcccagctaatttttgtatttttagtagagacagggtttcaccatgttggccaggctggtctcgaactcctaacttcgtgatccgcccgcctcggcctctcaaagtgttgggatccttctggtgtttcttatataaataccagccaagaatttgttttattttctctgttcttaaaggagaaggtattttcttttgactttatttgcactttatttttttactgaaatttgtatcctgaagatcactccatatcagtagatggagatcttaactttttgaaaataggtgcctagtgttaaattgcgtggatataccatagttcatcccagttgctagttgctagattggatttttgccaatcatttattacaaataatgccatagtgaataatctttcatgcatattatttcagatgtgttcaggtataatagtaaaataaagtgatgaaaaaggattttctgaattaaagggtaaatgcatctctggatattgtcagattcctctcaatttgcaccatttacactccacccacaatgtatgagtgtgtttccccacagccttgataagtgagtatgctgacaaactcttggatttttgctaacctgatgaagtaagtaggtttctaagtatatttttaaacattttattgttaaaaaattttaagtactgtgaaaaataatagtacagttaacagctgtatatctaccacccagattctacaatgaaccttttatctccctgccaacgttttgttttttaaaattttaaatataacaaagtagacagaactttattgggactactatatacccatcactgatattttactgtcaacattttactatatgttgacaaatactatatactatttgtcacatatctatccatccctgtctccatccattcatctatttttgatgcatatcaaaataaattacaacaacaatatacttctctctaaatacttcagcatgcataccataactaaaattccatagctgtatattacttttcttctgatatgtaattcacattaaatgagatacataaatcttaagggtacatttactggattttgacaaatgcatacacttgtataacacaaaatctttatcaagatattgttttagaaattttccttatgcccctttccagtcagtccctatcccatcatccacagtggcaactatactgttgattttttcatcataagttatttcgcctgttaactccttataaatggaactccttataaatggaaacatacggtatgtactttctttctgaggcttctttcactcaacataatgttttggagatccatccatgttgttgtgtttatcaatagttcttttctttcagtgaaatcattgagtattttattatgtgactgtatcatggatacctgggttgtgtcaagtttttggctactatgagtgaagctgttaaagacattttttacaattcttttttatggatatgtgatttcattttgcttcagtaaacaactaagagcagatttgttggatcataagtggatgcttagttgtactagaaactactagacctttttccaaaatggtgataccattttaaatttacaccaaagtggttcagaaatttgcattgttccacattttctcaaagtttggaatgttggtaggtgtgtggtagcatcatattgtgattttaatttacgtttccctgatgactaatgatgttgagttcttttttatgtacttgtgagctacttacatattcaaatattttgtctattttgaaagatggtttgtttctcactttattattaagttggaagtgttatttctatgtcctgcatactggccctttcctagatatatgtttattagcattttagccctggctggctgacctgttcatttccttactgtattttgatggataaaagttttaattttattgaagtttcatttatcaattttttcttatatgattataattttctgtgtcttgtctaagaaacatttgcctgccccaaagttgccaaggtattctatgttttattttataagctttatagttttagtttctatgtttaaaactattacacatgtcaaataatttttgttcagcatcatttgtttaaaataatcccctctctattggattactttgggatctgtgtcagatcaaataataatatatgtgttgatctacttctgtgctgtcaatcctgttttatttatttattttgctgtcattaagccagtaccacactgtttatattactgtagctttatagtaagactcgaagtcaggtaatgtaacccaccaactttattcttaaaaaaaaaaaaaacacatttctttggctatattaggtcctttgcctttactctcagagtggtttaaattgtatgtctcttactgtgagtgagattggccatccttttatgtgttaagggccatatttttttttcttgttaactgccaatatcctttacccacttctctgttgtttcttctactcccttgattttgagttatctaataatgagaaggaatagaattagtaaagctgacttgcattttttttcctttgatttggaaggaacccgacttccctcgtcaatgttttggctcctagtgagtaatctgaacagggccatgcttctggaacatgttggattgatttctattaaagcagtaagacagcccaatccaattttaaccaggctagattgtattctgccagcaaaagccccagactagctcaatacaaactcttcttagataagctcttaaaaaaatacctttctgtttttgactaaacaattcaggccagctgtaaactgtaacactcaaagttacaagttgtgtttcccaccagttatctcccctagctgtagacctgtagcaacaaaaattgcagataaagatatttgaaatatgtggcaaacagtcttcctgtggaagttacccacttactgtattttgtttgtatatattcttgagacacagtggtagtgaagaaatgcattgaaggctatttaaacatgaatttaacaggtatttgcctaatctttggaaggaaattaggatatggcattcccatatcctcacaggagtaattctcaattattaaaagccgagtacagttctttaggtgctagaaaaataagtgtttgggatattctgccatgtaactccttcattcttcaaacatttattatgttctatgccagctagtacctgaatcagtagaagctcaaatgcatagtttctgatcttgaagatctcaaggattgctctctactgtgagaaaatctaggtagcatcaccatgaaagtgattatctcaatgggaacttctatgaaaatgtatcactaatattttggatcagtagactacactcaaaactcagcaagcagatcacaataaaagttcacctaccaaacacacacaacacaccaatgaatgggtattagaactcagttactaaactgtaggaaaggttgatgcaacactttcaaaacaatgtagtgaccaataataaattaataaggctaatactcatcatgatatatctatatgaggaagaaaatgtgcttaaggttgaacgttagaatcagattatacaaaagagaaaaaaagatgattttggaagcattcagtttacctcatatattacttttgttcagggccttatctaaggtacctggagaggttttatatagatggtgacagttgaatttagacttaagggaaaggtgttccgggcagcaagaataacatccaaaggtattattgtgacaaatattgtgtgcttggaaatgttgaaagaaatacaaaagtatataatttatgctaacaacaaatctatatcaaacaaatatgacaaacaactgcatgcccatacatttgacaacttagattaaatggactaatttcttgaaagacataaattgttgaagctcactaaagaagaaataggcaatccaggaatctatttttttaaaaattgagttgtagttagaaacccaccaacaaagaaaactacaaatccagatggcatcactggtaaattctaacaaacatttaaagaagcagtaacaccaattctacacaatctcttcccaaaaacagaagtagagggatcactttccaaccattacatgaggccagcattattttgatatcaaagccaagcaaagacatatgagaaaagaaagctgtagaccaatatctctcatgaacatagacataaaaatcctcaagaaaatattggcaagtcaaatctagcaatatatgaaaaggataatacactacaatcaagtgaggcttatccttagaatacgggctggtttgacattttaaaatcaatgtaatttgccatatcaacagagtaaagaagaaaaactgtattataatctcagtaaatcctgaaaattatttgataagtttcaatattcattcctggaaaaatagtctcagaaaattaggaataaaagggaacttccttagcatgataaagacatttacaaaatcttgatccattatgtttagtggtgaaagactgaatacttttccccaaagttatgtaacacaaagatgttatttgttaccatatttgatggtatgaaaaggttcaatattgtattggaagtcctagccaatgttataagacaagcaaaataaatgaagggcatacagattggaaaggaagaaataaaactccctatattcatagatgacatggttttatacttagaaaaccctaataaatctacaaaaatttactagaactaaaaggtgaatttcgtaggatcataggacaaagcaaatatctaaaaataaattatgtttttatatactatcaatgaacaactagaaataaaaattaaacaaaaacagtataatttacaatagcatcaaatgacatgaagtgcttaggtatgcataggtccaacaaaaatgtgcaggctttgtatgtggaaaattacaaaacactgttgacagaaatcagatacctaaataaatggaatggtatattgtgttcatggatattgttaagatatcagttttctccaaatcaatccatagattgaaaatattctcaaggagaacacacaatttttcttctaaaatttatatggaaaaacaaatggcctagaatagccaaaacaattttgagaaagaagtacaaagttggacaattcatagtacttgatgttaagacttaaaataaagctacaatagttaaaatagtgtggtatgtgtgaaatacagactaatagatcattgtaacataatagagagtctagaaatacacccacatatttaatttttgacaaagttgctaaggcaatctcaacagaaaggtaagtcttttcaacaaatgttgctaaaatataaagcaattggacatccatatgcaaaaaaaaatataaacaaaccaacataacaaacctctacctgcacttcctaccttgcacaaaatttaactcccaatggatcacagacctaaatgtaaaacctaacattatcaaacttctggaacagaagcaggcaaactttttctgcaaagagctagagagtaaatattttagtctttatgggctacatatatggtctctgtcacatattcttttttaaacaaccctctaaaaatgtaaaaaccattcttagcatgtaggcagcacaaaaagaggcctataggccatatttagccatgggaagtactttgtcatcccttgttttagatgaagaagcataagagaaaactctgtgatcagatgttaggcaaaaacttgttagaataccaaaaagacaattcataaaagaaaaattggatatattggactttattaaaattaactgtattttcatatcatatatctgacaaaggacttataagcagaatatataatgaactctcaaaactcaataagaaaacaaacaaccaacttttaaaatatagttggaaaaatgagcaaacaatttgagtagataccttaccaaagaagacacccaaatgtctaataagcacatgtaaagatgctcagtataatttatcatctgggaaatgcaagttaaaaccacaatgggataccacttcataaatattagaattggccttttttcaaaaaggataactgacaataagtgctgctaaggatgcagagtaactcgaactctcatacattgctagttaatacacagaatggtgcagccactttgaaaaacagtttgacaattttcttatatagttaaacattgtctttgcacatgacacagcaattctactcccaagaaaaatgtgaagcttcacatagaaacccgtagaacagtgttcatagcagcttaattcataatcaccaataattgtaaacaccccaaatgtgcctcaaattgcaaaaagattaacaaaatgtacatattcatctgatagactaataaccagcagtaaaaagtaactactgatacacataacaacatgggtgaatctcaaatgcattgtattaagtgaaagaagacatattcaaaaggctacatactatatgattgcatttgtatgacattctgggaaagaaaaatctgtaagacataaaataaatcagtggttgccaggtaattgggatgtggggacgagttgactacagcgcacaggggcttttttgggtttatgaaaatgttctatgtcttgattttagtggtggttatatgactacatacctttgtcaaaactcatcaaagtgtacactaaaaagacagaattttagtacatgtaaaaattgtttaaagtgggagtgacagagggacagacagaagatggagagatggacagttaagtttctaatgtcaaagagatgttttactaatgaagggagaagcttgaacatgtttataagccatggccctgagttagtaaaaaggaaaatgttgaagttatctatcttaaaatataggtaacttgaaaatatattttaaacttatgaatatataactgtccacaatgagttacaagtagaaggaatatgtggtttgtaatcttttgtactttcttgtgaagttgatttaagtattgaagtagtgatcagcatatgttaaattataaggctgtaactattaatagattccctatcctttgctcttgatacttatgtgtacttttcttgctgaatgaatgcccagtttttcaagattcttgcttaatatgatatggttcccaaggactagtgactcaggtgttgcttttaatatttaaactgtatttatttcttaaaggtgatgttggaccaaatggacaacctggaccaatgggacctcctgggctgccaggaataggtgttcagggaccaccaggaccaccagggattcctgggccaataggtcaacctggtaagattagagtaaatgtgcattttgtagcactcataatatatacatttgttagctcatcaataaagtgaaacctacaaaacagtcttccagaagcagacttaaaaggcaatctatctatgtgtatgattttataaaagtggataagtacaagccacagcataaaagctactttaatccctgatatttcccttctgagttcatctaaaattgatgtatttccaataatacaattgcagtgtattattgatatgtaattgttgagttagacatggttttggaagcagaggcctagaaacttctagtgctgatcatttcagatctgagtagcggtacagcattcatagacctttgtggaacctcctaacatttcttagcacatgacaactagaattagggttcagcaaaactttctgtaaaagtgtattttaggcattcccattttctttttttttcagtgagttattttccctttttgcccctaaaatagcagtcattttgcaattcatcagcactccaaatctttacttttaatattttatattggatactcaaaaaggtcttttgtcaacacgtaacctaatgggtttgcctctatagataggaaatcatatggttcctctaaatttgtgtgaaagcatattgagtttctggattctgagctgtctggtgatgtgaattctcgttatgttaatctaggtaagtacagtaaaggccaccttggggccatcattatgttattgcaaaataccataataatttatgaaattaaaacaaatatgaaatatttaattgttccttaattcacatgaatacatctgaaggcttaaacacagagttcagatgtgcatacatttatctgaagcaatggctatatgtttcctgaccttaaatggcagtagatattttgttattattctaaaaatttagaaactcaggttaacaatataaaaagcttgtaaatgttattttcattatgtactatttacaattgattatatggcacattatacctttttatggtccctgacatgtcactactgatttaaaactaagaaaacttagagtgttgctttgaaccaggttgttacaaaatagctgctttatcacttatggaaaaaacattctgtccaactaacaaagcagagggatcttcaggaaaaagcacttatttttaggtttgacctgctgttttttttttgttgttgttgttgtttttgttttgttttgttttgagacagagtttcactcttgttgcccaggctggagtgcaatgctgcagtctcagctcactgcaacctcctgggctcaaacgattctcctgcctcagcctccggagtagccaggattacatgcatgcaccaccacgcccggctaatttttgtatttttagtagagacagggtttcaccatgttgaccaggctggtctcgaactcctgacctcaggtgattcgcccgcctcggcctcccagagtgctgggattacaagagtgagccactgcgcccggcccctgctgttttacagaggtggataaaatgaacttatcactcctatggtgttttgtcatttgtttcagttccaaaaagtgcatgagtctttagaagcattttgaattcttaagtcacagctgagtgcgaataaaaaaaggaacaccattaatatgaatctaaacaaaatacaaatatgttaacacgtgtcacgctttttcagatttacctgataccttgtaatgttttattaatctaatgttctctctttctttctccctctgttatatgatatatctgacaaaggacttataaccagatataaatataatatatagataaatatatagatataaatataatatagatatagagatattgatttataaagtataaataggatgggcaggaagaaaagtaataatgctgaattaaacttcatctatttcttttgtaaatatatgtatagccatagaattcaagatattaatatgattcaacaaataaatgaaattaacaggaactagcatgaaaatttattgaattcactcttaatatagaaatgttctcaaatcacagtacttttcattttactatgagatggaccacatttcatatttatacaaggcacagatactcactttctaagtaaattttacttacatcaccaaaatagaatattatcttagttcatttaaaaaacatcctgatttatgtccataaatctcaataataaggtaatcggaaagattcttatatcttgataaacctacttatgttgcatggctgaaactctatcaatgtttttgtaataagcttatttaatatacttgtatttcattttgcgataggaaaaatgcaaaatattctatactgttatctctctactgtagaatgtttacattatgctttttaggctttcctttgaactccagttttctattatttaattaagcttttactatttacctttctcttttctaaaccaggctatacagtttaacacggttataagataaggtcccattgaatatcagtttcccattccatagcagggaaataaaagaaaaattgccaaaggactagaaacaaaatatttttcatctcatgacctgctaacccaggcagaaatggaggttgttgattcttgttattttctttggccattacctgtacaattactgtcttactgaatttttttagagatcagttaaatatactctatttcatgttcacagatcatatcataaccagaaccaaacgtgttatagtgtgtgtccagtcttaggacaaagcatatggctaaatcagctaaagaggaaaaaaaaattcatcaccactaatgtgaatcaaaacaaacaaaacaacaacagcaaaaccctaggaattgtttatgaattattcatgtcattttcatagatgaaggagaaaatagttttctaacacttcaggaggctacaaaacccttgggtagggggagggtgtgtgtatgtgtgtgtatggaaagttctcacgaataatacatgtttttgaaattttcctttttttataaactggttccattcggctgccaataaatttagaacatcagtatatccctatatcacatctgtagacatatccatacaattcttgttattgtggggaaatttagcggaactttgggatttatattgacttcttcatcctggatcttaccaggatgtgtattcctgacagtattcatggaaaaaatctatgctatgggaggaagtatagtataatgtctgttattactactactaataataacgatgaagaaagaaatccttgcctagtgcatgcaagttgtttctccataatcatatgctaataatgattgatttatctatacccaacctgttgtagtataaaattaaattaatttttaaatttgaactaaactttaggagcttaaattccaaaaagattatttaaatcattaagtcagagataaacaattgaaaagctgacctttaccaaaaggtaatacttttgtgaatgtaaatattttattatgtcattattggcaaatacatttcatttatagaataagctatatgaacatctaagcaaatgcctaaaataagttttttcactcatttctaatatatgatagcagtgaatcgaggtctaataacttctatttgtagagttttatgttctaatttttaaatgcttagtttttttttccctaacctaatgaaactttttgcaacttacttctgcttgggtggcccaacttgctgctgaactgtaattccctgcctcttgaacatcaggtgtaccaggtactgtagttcttcctcaaaagccatatcttaaagtaaagctttaaacatggaaaacaaacatttctccagatttaagtctttggtttatttcccttattttatagaactgctctcttggagcacgtttcaaaagataaattatttatattgaaaacccaactattaaaaatctttgtgagctataatataacaatagatagtgatccatataaagctataatcatgttcactgttaggcatcatatcatctttcacaaatatgatataaaaatctctctctcctttttatagtcttttactgtaaaatggcagcattggaactatcgctactttgccaactgagtgtaattctctaatcttcaaagtggattttgtcagtttagggccatgctgaaatatgacataaaacagatcttaaaaccctagcatcttactctctacaaaaataatcaccactgagtcttcaacaataaatttagatcttattgttgaaaggagacttggaatgatcatctggctcaacccctagtttccaattggttatggcataatccccatttagcagatgaggatcaacattaagtgactcacgtaagtcgcacagctggtaggctttggagtgggaagttacatagtatttttagtgtaattcttttcccataaacatactcttttttaaccaccttgcttttgggggaaaatcagccttacagaaacttactaaggttaaatattttttgctgtgtcattttttttctgtaaaatcttggttggagaaacaaaagatgacaaaaaatactaatagtaacatattattaatgtattattaaaacaatgtgcaaaacaaaggtaaaatacaatttaagaagtccacttaagtgacttattcagtaatcaataattttgggagctcatagagatgtgtactaataatttataatacattagaacaatgcaaatgtaagtgtgttcaatagaccagtgtcaaataatctatcagtctgcaataggattaatacaaatgttgagaataagcatttagaaacttttatagcaatttgatagtgtaattgtatctgttgaatataataaccaaaaaggtaggcttttattttgcatctttggctttttattcagttttagtaattttcattgtattttataaaaaatattagtctgtgattaactaggaattaagaaaagattggccttttgccagaaataatttgagaagcactgtcttagagcaatctgcttgaaaatcctaaagcttgattgttcagttattttgtgtgcatgatgtcaaaagtatctctaactcactcttaggtctgttatctacagggttctatcacttgtttactagaaatataaccagatacatcttttaaaactgcttcagtacttattaatattgatattgtattaactaggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaatttgtttaaagttttctctgatttggattaaggaaattaaaactaatacgactctggtagataattcccatgttacacttttctagattgacgtgatcccttaaggatgagcattaaatatctatgactgcaggaagctcactttgctattttcactgcacatttttctctgtgagagttccagttatatattactgtataacaaacaaccccaaaacttaatgattttaaccaaccttttaattttgctgaagattttgcagctctagaattaagggatgacttgactggttcatttatctctaacccacgttgccccagctggagtgtttgggactgaaaggtctacttctaagatggcacttctctgacatctgggtgttcattagctcacatgtcatctcatcgtccatggtacctcttcgcatggcttaggctcctcacattatggtagtataaggctggttgctccccttccatggcagctggcttccaacagagagaatcccacaagagaaaagtgagtgtttcaggaactacaggtagaagcggcaagatttcttttctttcgctctctctctccctttttttctttctttttccctttctttctctttctttctcttttctttctttcttttctttctttctctcttctctctttctttctttccttttcttctttctttctttcctctctttctttctctctctccttccttccttctttttttttttttgagacagggtctcactctgtcacccagactggagtgcagtgggacatgatcacagcccactgcagcctcaaacccctgggctcaagccatcttcctgcctcagcctcctcccaagtagctgggactacaagcacataccaccacacacagctattttttttttctttttttctttgtagtgatggagtctcactatgttgcccaggctgctctcaaattcctgtcctcgagcaatcctcccacctcaacctcccaaagtgctaggattataggcatgagccactgtgactggcctgtaagacttcttttgatctaggcttgggagtcacacaatgtcatttagtcaagtgtgaggtacagaatcaaccctagttccaggtgagggttttatagtagattgtacatactgggacatatggttcactggggggccatctttagagattagctaccagactgagtctccttattcatgggtatcagcagtagtgggcactatggtcaaaaagtctaaaacttaacagtgccttacgtccaaccctcaatagttttctggttgacatcttaaaacttactttttatgttccctaagtcaaagaaaggcaaacattacttattgatattcttcaaaggtaccaaaggtgaaatgggtatgatgggacctccaggcccaccaggacctttgggaattcctggcaggagtggtgtacctggtcttaaaggtaataatcaaggtttgctgccagacgtatgtgagagggaaaattaaatatagctttatgtcagtacagaatatttttgttgactgttttaaaatgagcaatggttacttgtgtttctatgtaacatggcatttaaataggtcttgttttcaatttggttacgtgcttagtttggataccatgatacatggtaaatgcttagctcaaaataacaaaatataaggattaagcattaatttttttgtttgtcttttgagacggagtctcgctctgttgcccaggctggagtgcaatggtgcgatctcagctcactccaaattccatctcctgggttcacactattctcctgcctcagcctcccaagtagctgggagtacaggcgcctgccaccacgcccggctaatatttttttgtatttttaatagagaaggattttcaccatgttagcaaggatggtctcgatctcctgacctcgtgatctgcccacctcagcctcccaaagtgctgggattacaggcttgagccaccgtgcccgtctggattaagcattaatttttttatagtcggcctctatcgttgtcaaggaattccagatggagggattgttatctgagtataaaaatgtgtatgcactcaagtaattcatagagtacatccaaggtgcataaatgttttgagtggccagtggcctactcaactatgaaacatatcaataatctttatatgcattaatctttgatggataaaattgatatattgtgttttcacacacattgattttaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtgagtgaatgaatttatttatgaatatttttcctgatatatctgaagtttaatttttaaatagcatgaaaagtgacttataatacagaattcaccaacaaaggcacttaaatgcatcaaattttggtaacaaatattaattttcacttcattcatactgtttcaccagtcaacttttgtttgagtattttctttatagtttacctatcacgagctttacctaaccactagtgaggttttaaaatagacttaggcagtcaactactagctttctaaaaagtaatacaggaaaaggatatatagccacaattacttgaaaaacaaatttcagtgtttaggaaatttgctagtcctttcatttttttctccttgataccagataaggacgaatggtacattgctgtactgcagtgttttgatatccatatcatacttggctttcaaatacagttcaccgttattctactttggcagaataaacaagtattggactatgaacagccaagttcagcccgaggggaagtcactgaaagtagatctagggaacaattgtgtccatatagttattttattagaaacaaatacagcgtaaaatattacgtggggttttcaataaaaaaaaaaccttttttatagaagtataacatgttcataacaaaacatcataaaatatggataagcataaatcattatataaagcacttggcacccaatctatatagaatagcctttcaagcaatatggaatgttaaaactagctatatctgtgtatctgcagcttatagtaaagtttgtggctctttgtacgttctatccatcaatattgtcagttcatgtgtatgtgtatgtgtatgtgagtgtacacagatgttaacagtttccctatgagcaggatttggtgggatttttcctcaaaaaagaattaaaaatattaatgcagtgttgtatatagtcaagaaagaggcagggtcacctaattttttatggaatgactttcttggcttaccccttgcaaggcttcttttctgtttcaattatgcttcctgtataataggggcagtaaactatacttgacctctactataggcttattaaatatagtcagaatctaagagataacctagagattatctgtccttattccttatttcttcatttccattgtaagaaaatgaggcccaaaataggaaagtgatttcactactgagtgctctgaatttcttgatggtaggtaactaaaaagtgaaggattttcgtgtgagtccagtgctaatagctcatactatatcagaatatcaccagttcctctaattcacttatagtttaacacttgagtagcttgctttgccaaagttatttcatggatgaataatatcatcctaacttgcctcttctactcattcttggaaggtatacctggagtttcagggccaaaaggttatcagggtttgcctggagacccagggcaacctggactgagtggacaacctggattaccaggaccaccaggtaagtgtgataggccatttgtagcaattgcttagctgacactgaattctggataaataattatgtgtttgtcatgtttgaagatgctgtggatttgatcatggtaataagcttgggtagctactgaaatatggagctcactttcggcaaaaatattgccctttggctctagttttagcagtccagattttataggatattttgccttgattattcagtttcttctttttgtggcagcagggtatacacagaatcagaaatgtgatccaaataaggtgttgtgttttgttacatacattgcaaaatatataaatgagacaattatctcatgaaggcctgaagaattcatcttgtcctgcttttttttctttctgcctttagacaagtcagtcattaaaccatgtaaaacagatggctattgattctatttttttaaatttctaggcatgaaaatttcacaaattctcttggtagtcagttacagcattaatcactcttagagtcgacatttttttaaatcctactaaaactctttcttgtttcttcttcagccactttcttttagtttgtttcctaaggaaataaagagcagcagtccccattcttacaaagtcccttaagttcagttatttgcgctagactccatactacatggccttgatatagttgggaagagaaactcccttcctatctctccctcacatcttctgcattctcttttccaagttagaagtcattgtaaaggaaaaaaataaaataaaaaaagtttaaggcaatactgtggtcctaggaaaaaacccagatgacatcacagagctcaagcacctatgtgctaggaaaaatgtacaaacagagcagccatgcctgttcaggtcactgcccagtatctgtccaccacctctaatctctccctggcctaatgtactaaactatatcataacaggttaccaccttttctctttctgatctcatataatcacgctctacatgagaagcccatctctgaatcttttaaaaaacagacttattatattggatttatctgtgaaaatacattaagggtagttgtacacatacagcaaatagcacttcaggtgattggaattgttttagggaaagaaacaaggtgttctggtaactttttaatttttttttaaagttatattaggagacctctattactatggttatattgtaatatgttcccaaggagatgttttatgttgggttctatctgtggaccttaatcatatattcagatttaatccatctaatcccatgtttgcattttaatgactatccattcccatgaaaccagacaaccccaatattgctacattgtcttaattttaccaatttgacctttctaggtcccaaaggtaaccctggtctccctggacagccaggtcttataggacctcctggacttaaaggaaccatcggtgatatgggttttccaggtgagtgatgaaaatcttccaaatatttagtcccattaatgaaaggtggttcaatatctctttttttgtcagaaaagaggctggtgttgatagaatcagactgaaacgatatctgaggtaatcagtgggtagtgttctcttgttacacaaatatttaaaatgggaattaagggacaaaattgtagaaaccttaaaagttataattcacaaacatcttttctccagctatacccccttttatttaaacttcctttaaaagtaggcttttatataattgtgtttgtgaggctcattattatctaactcagagtttgcggagctttttaaaaatctttttgctttgtcatatgcatcttagataatccacaagtaaagcatattttgtaaaatattatatatcacatattttcaacagggcctcagggtgtggaagggcctcctggaccttctggagttcctggacaacctggctccccaggattacctggacagaaaggcgacaaaggtgatcctggtatttcaagcattggtcttccaggtcttcctggtccaaaggtaatctttggcatatagttttaggcacatacttgagcagatatgaaattttttaatactatgctcattcctaagttttcattaaacaaactatagaatgacatagtatattctggataagagatttattccttttcttttctcttagatgataagaagatatgttttagggtttgtggccagtccaaaataaaaagggaaaactttctggtttctttgtttttcttctatcttaatttctggatatacttcaataatctcaatgcctagatttttctggtcttgttagtccatccctttttagtgatggagttgttggcctttgtcctaatgttattattaactaatttgaaaagacttataaacaaagtgacagttaatgctaatgtagtagtattcttaactgcgtgtctgagatagtcctctgaatacagttttacaattccctctacttctctcttcaatgtgaaaactttggtggtgtttctcaagtaatcaaatttagaatttgtttcagaatcattggactcaacaggaatttatttgacaattgtttagttccatgtcaaaaagtagtaactccttaatcatgtagtcagaccacagacctaaaaagtattagaaaaggaattttggtactcagttttcatggaaatagtgaaagttcccagtgatataagaatttattgaattgtatgtaaggataatttttcttttaatattatataaaaatactttattttgatcatctaattgatcaatgtcttataaagagataatcaagagaagtttctgtatgttcattccagtttaacaatgtaaagtttcttgaagtgaattttaattttctctgttatatttatattttaccagtgacattgaatatatgattttattaaaaaataatatagacatattaagggtaagagtgaaaatcttcttcatgccccatcctctttttaccattcctttcctcatagaggcccactgtcaatagttgatatataaatttgaattccttgttctatacatttatatatatgcatatagagtttggggttttttctacacattgtgtatatgtagaatcatggtatgcatgctactctgtaccttgctttatcacttacccctttttatttcttttttcaatatatcttagacaattttctttgtcgtcatacattatatctgtggacatatatgtagttatttatactgtatagtttcataaaagtgtaattgttggatcaaaggataagtgcatttaattttttggctttttaaaacacttataataatgtaacatatgaacttgattttaaaatacaaccagtatgaaaagatgtaaaataaaaagtctcctttttacatgtttgcaaaccccaaatccccagttcttcttctccagggtaaccacttttagtagtttctctcatattcttcaagaaaggttttctaaatgcatttatatgcatgcatatatggtatttcatcaattttaatactcattttttacatccaaaatatctaatattggaatgcatcttattatgatggaaagcatattacaattaaaattgtaaatatttttccccaattattgatacatgaaatgatgctggaccttccaaatgtagatgttttctcatattttaattaatatatacaaaattatactatacatctgctctgtacctagctgtcatcacatagtaaatcttgacaaactttctttatcagcctataaatgtatgccttattattttttataattatatagtatttttatgggggttcactataaataatttaacctattatgaatatgaaaattatttctaggttcatgattacaaacatattttgcactgaagattcttatccatattcttacatacatatcttaagaatctttggtaaatatcaccatagaataaattctgagcagttgctagaacccagcatatatgtgcctttttaatatctatatttactgccaaattttccaattaagtaactctacacctttatactttcatgattagtataagtgattttctcctcattctacagatattgggtgttatcaatttaaaaaattttaccaatctaatgggtgaaaagtagtgtatcattattgtttatatttgaattttcctgattacaagtggggtttcagatgtttttaactctttcgtaaattgtctatttatactctttgcctcactgttttacgagaggacttggttatgtatttcatactgatttgtaaaagtacattataaatgtgaagatgcatccactgtctgttatatttgttgcaaatattttctcccagtcagttgtttgtcttatagcatgtttactgtgcatttcgttatgtagatgtttgaaatttttacataggcaaattatgtactcatttatttattcattcacaaaatatctgttgagtatgtatgatttaccaggtactgttttaggtgctggagatacagcctgaacaaaacagacaaacttttactgccttcaaggagcttatatttagtcaaggagtcatacaataaacaaaataaataagtctgtattatgttagaatgtgataaatctcatgatgaaaagtaaagcaagacttgatgataggaatttctggaaattgttatattttgaaataggttactaagggaaagtctctctgataagatagagcagtgaccacactgcagtaagagagtaagtcatacaaaaaccctgaggtgtgagcatacctgacatgtttgagaaacataaatgagtccagtgtgttaaacagaatgagtgagttgaaacaaagtaggagatgagattagattggtaatgggggaaagattatatagtgccttataggtcatcatagtaggggcttttactcctgagtgaatcggggagcaaatggaaagagttaacatgattgtacattaattttaagaactatcacagcacctgttttggaaacagatcatagaggagcaaggatggaaagcagggaaaccagttatggtgatatttaaataatgcaggctaatgatgttgatggcttggatcaagatagtggcaggggaagtgataagaaatgggcagattttgaatatataatatatgtcaagccaggaagatttgtgtatggaatatgagagagaggaatcaagaatgactccagtttttatcctgagcaaatagagtggagttgctatatgctgaaatacaaaaactttgaaaaaagcaggtttagtgagaaagatcaggagcatagttttttattttatttatttatttatttgttttattatactttaagttccagggtacatgtgcacaacgtgcaggtttgttacatatgtatacatgtgccgtattggtttgttgcacccattaactcatcatttacattaggtatttctcctaatgctatccctcccccattcccccaccccatgacagggtgtgtgatgtcccccgccctgtgtccaagtgttctcattgttcaattcccacctatgagtgagaacatgcggtgttcggttttctctccttgcgatagtttcctcagaatgatggtttccagcttcatccatgtccctacaaaggacatgagctcatcttttttatggctgcatagtattccatggtgtatatgtgccacattttctcaatccagtgtatcatggatggacatttgggttggttccaagtctttgctactgtgaatagtgccacaataaatatacatgtgcatgtgtctttatagcagcatgatttataatcctttgggtatatacccagtaatgggatggctgggtctaatggtatttctagttctagatccttgaggaatcaccacactgtcttccacaatggttgaactagtttacactcccaccaacagtgtaaaagcattcctatttatccacatcctctccagcacctgttgtttcctgacttcttaatgatcaccattctaactggtgtgagatggtatctcattgtggttttgatttgcatttctctgatggccagtgatgatgagcattttttcatgtatgtgttggctgcataaatgtcttttgagaagtgtctgttcatatcctttgcccacattttgatggggttgtttgattttttcttgtaaatttgtttaagttctttgtagattctggatattagccctttgtcagatgagtagattgcaaaaattttctcccattctgtgggttgcctgttcactctgatggtagtttcttttgctgtgcagaagctctttagtttaattagatcccatttgtctattttggcttttgttgccattgcttttggtgttttagtcatgaagcccttgcccatgcctatgtcctgaatggtattgcctaagttttcttctagggtttttatggttttatgttcaacatttaagtcttaatccatcttgaattaatttttgtataaggtgtgaggaagggatccagtttcagctttctacttatgactagccagttctcccagcatcatttattaaataggaaatactttctccatttcttgttttggtcaggtttgtcaaagatcagatggttgtagatgtgtggtgttatctctgaggcctctgttctgttccattggtctacatctctgttttggtacgagtaccatgctgttttggttactgtagccttgtagtagagtttgaagtcaggtagcatgatgcctccagctttgttcttttggcttaggattatcttgacaatgtgggctcttttttggttccatgtgaactttaaaatagttttttccaattctgtgaagaaagtcattggtagcttgatggggatggcattgaatctataaattaccttgggcagaatggccattttcacgatattgattcttcctatccatgagcatggaatgttcttctatttgtttgtgtcctctttcatttcgttgagcagtggtttgtagttctccttgaagaagtccttcacatcccttataagttgtattcctaggtattttattctttttgaagcaattgtgaatgggagttcactcattatttggctctctgcttgtctgttattggtgtataagaatgcttatgatacatctctagaactcttcaccccaatcaacagaatatacattcctctcagcaccacattgcacttattccaaaattgaacacatagttggaagtaaagcactcctcagcaaatgtaaaagaacagaaatcataacaaactgtctctcacaccacagtgcaatcaaattagaatttaggattaagaaactcactcaaaaccgcatgactacatggaaactgaacaacctgctcctaaatgactactgggtacataatgaaattaaggcagaaataaagattttctttgaaatcaatgaaaagaaagacaacattccagaatctctgggacacatttaaagcagtgtgtagagggaaatttatagcactaaatgcccacaagagaaagcaagaaagatctaaaatcgacaccctaacatcaattaaaagaaccagagaagcaagagcaaacaaattcaaaagctagcagaaggcaggaaataactaagatcagagcagaactgaagaaaatagagacacaaaaaacccttcaaaacatcaatgaatccaggagctggctttttgaaaacatcaacaacattgatagaccgctagcaagactagtaaagaagaaaagagagaagaatcaaatcgacaaaataaaaaatgataaaaggaatatcatcaccgatcccacagaaatacaaactaccatcagagaatactataaacacctctatgcaaataaactagaaaatctaggaagaaatggataaattcctcgacacatagactccccccaagactaaaccaggaagaagttgaatctctgaataggccaataacaggctctgaaattgaggcaataattaatagcctaccacccaaaagaagtccaggaccagatggattcacagccgaattctaccagagatacaaagaggagctggtaccattccttctgaaactattccaatccatagaaaaagagggaatcctccctaactcattttatgaggccggcatcatcctgatatcaaagcctggcagagacacaacaaaaaaaagagaattttagaccaatatccctgatgaacatcgatgcaaaaatcctcaataaaatactggcaaactgaatccagcagcagatcaaaaagcttatccaccaagatcaagttggcttcatccctgggatgcaaggctggttcaacatatgcaaataaataaacgtaatccatcacataaacaaaaccaaagacaaaaaccacatgattatctcaatagatggagaaaacaccttcgacaaaattcaacagcccttcatgctaaaaactcaataaactaggtattgatggaacgtatctcaaaataataagagctatttatgacaaacccacagccagtatcatactgaatgggcaaaaactggaagcattccctttgaaaactggcacaagacaggaatgccctctctcactactcctgttcaacatagtgttggaagttctggccagggcaatcaggcaggcgaaagaaataaagggtattcagttaggaaaagaggaagtcaaattgtccctgtttgcagatgacatgattgtatatttagaaaaccccaccgtctcagccccaaatctccttaagctgataagtaacttcagcaaagtctcaggagcatagttttttgattgtcaatattttgttgctgaaataggaaattcatcaattgagggggagagagaggaagaggtaaggaaggcttgaggcctgtcacatagattttaggattttttggaaaaaaagtcttctacttatgaagacttctatatcctgagattataaaaatagatttatatatttcttacaggattttcatggtttttttctgtacatttgcattttaatgcacctgagtatttctgtatgttgtatgaggtgagaaactaactttattttttttcccaaataaatatccagttgactgagcctcatttgttacaaactcaattctttattcactgatataaaattgtatttaaattttttttccaaatttgttcatgaatttttttttctggaatgagtgaattttaacattttactaatggaatcaaaattaccataataaattgtctctacatttttaatgggtgatagcagaaaaatatgttttaattggtaaatgtccaaagtatattcaactctacaagcaagaggttagcttttagttcttctgtgtgacctacaagtatatttcagtaagcaaattttacactaaatttagaaacttaacaaagatgatattgtggaaataatgtaaagtagtctgttgtttctttcagatggcattattataccttaaaatagtgacatgttgaaaaaataaaagtttttttagctcagttctattaggtacaggtgatctttgcttttgcacaaatttcagttatcattacttaacaccgatccacaacaacattgtttaaattttagttgctatgatatattaactcttccatttataaatcatcatctaaataagagatgtgcattacaatcagtggacagtaatttcacttctttcaaattctgtcactaattagtaaccatgcatctgttcagttcctgcactgacagcaaagcatttagttgtgtcacctccttgtctcccagtgataaagcaatgtgacattttacaaaaatggataatcaaaagagaaaattagccaacaaagaagaaagtgcaacaaaaaaaaaaaaaaaggaaagtgatagcactggaagtaaggtttgaatctaaagtaaatggggttatagaattaatagccaaccatagaattgtagacactgccaccatttgagagactctagatatgcagctaaggaacttagtgaaggcaaacttatcaacattaatgaggaaaggagcactgatgaaaaggatgaagatgtcacagaggaagtgttgccatcacaaatttcacattaaaggaactcttggagatattttacaagtttgaaagtataaaggttaacatgctggaagctgatctcagtttagaaacagtgagacaatttctgtgccaaggcatagaaaagatgtgtgctctgtattgtaagttatacgagaagaagggagacactgttcaaattactcttggtaacttttttacaatgaaataaatcactttatttttcaatgtttctaatgtttaaattagcatttaccaaataaatattggatttactattttttatttctttatacatgtgtatctgacattaaaacatattttaatgttttgataacatttttaaaggtcatagaataattacattttcccccattgattattaagatcactttacatgattttggtttgcagtttcatttttccagttccacactaccacgtgaaacaaagagtacccatattataaaggaagagaagaagaacagttttaggaaatataatggtatgattgagggaaaacaagcataagacaaatttctgtaattactgagttgttaagaaataggaatagtggtaaaatatcagataggtagtttgttttatggatgtcactgtttatgaaacagcagctctgttagtcaaaaagcatgattaataaagtatactgaaaaccccagacaaggagtcagtaggcagaaatttgagtcctgggtttgtgtacatgaccttgataagtcacttaattcttcagtgtcttcagtaccttgtccataaaaagtgggagaaaaaaaatcctactttttgtagttattgtgaggtttcaatgagattaaaacatgcttcataaaaaagaaaaaaaaggaaaaggaatgaaacactttgtaaattataaagcattctatacatagtatttctttttatctaaaatgaaagggctggagtagagggtgtctaagatatctggaattctcaaatataatgactctatggaactatatgaatctgtaatgctcttttaatatagtgtaattgttctaaccttcataactcctttttaaaatctaatcatactacagattcatccctttcataatcccagatggcttttatgctgaaattgacaagtgtatcctaaaattcatatggaagtgcaaggaacccagaatagtcaaagaaatcttgagaagaacagatttggaggactcactcttctggatttcaaaacttactacaactatgataccagcactgggtagacatagagactgatggaatagatagagtccagaaatacccatacatttttggtcaactgattttcaacgtaggtaccaaaacaatttaaagggagttaaggatagtcttttcaacaaatgatgctggaacatggatgcagctggaggctactatctatcctaagcaaattaatgcagaagcagaaaaccaaatagcacatgttctcacttaaagtttggaggtaagtattgggtatacacagatgcaaagatgggacaataaattctgggtattcccaaaaggggtaaggagtgggggaagtgttgacaaacctatggagtactatgttcactacttgggcaatgggaacattagaagcccaaacatcaacatcacataatatacccatgtaacacacctgcatacataacccctggatctaaaataaaaaacaaaacaaaaatcaaatcatgctgggaaaagaggatacctgtctgcaaaagaatgaatctggacccctatctcatactgtatacaaatattaactccaactggattactgacctaaatataagaactaaaccataaacatattaggataaaagatgactaaattcttgtgaccttgcattaggtaatggtttcttagctatgacactaaaagcacaaacaactaaaggaaaaataaattgggctatattaaaattcattaggtaatggtttcttagctatgacactaaaagcacaaacaactaaagaaaaaataaatggggctttattaaaatttaatgtgttttctgttgcaaatgataccatcaagaaagtgaaaagacagctcacgagatgaaagaaaatatttgcaaatcatatatgagataaaggatttgtatacagaatatataaagaattcttataattcaacggaaagcaaataactcagtttttaaaagtgcacaaagtgaattggacctaacaaacatatacaaaatattctatccaagaaaaatgcagaatatacatttttgcaactgcacatggaacattctccagaatagacaatatattagagcacaaagtaagtcttcatacacttaaaaagattaaaaccacacagcatatattttttaatcatgatggagtgaaattagaaatcaatggcagaaagtaaactggaaaatctactaatgcatgtaaattaaacaagacgctcttaaccaatgaggcaaagaagaaatcacgagggtagttagaaaatgtaatgtctttttttttttttttttttttttgacagagtcttattctgttacccaggttggagtgcagtggcgtgattgtggctcactgcaacctctgccttccaggctcaagcaattctcatgcctcagcctcctgagtagctgggattacagatacgcaccaccatgcttagctaattttttgtagagatggggttttgccatgttggacagttggtcttgaactcctgacctcaagcaatccaccctccttggcctcccgaagtgctgggattacaggcatgagccaccatgtctggcagaaaatataatgagacaaatgaaaatgaaaccacaacataccaaaacgtacaggatgtagtgaaagcaatgctaaatgggaaattaatagctgtaaatacttacattagagaagaaacatctcaaatcaaaaacctaactttacatcttaaagaactagaaaaagaaaaactaaatccaaaactagcagaaagaaagaaataataaagattagagcagagataaataaaatacagaactaaaaaaatcatagatgaagtcaacaaaactaaaagttgtttcttcaaaaagataacaaaatagaaaaagttttagctagcttgactacaagaaaaagagagaagactcaactaaaatcagaaataaaagaggagacattactaccaatcttacagaactaaaaatatatgagactgctatgaacaggtgtttgctaacaaattagataacctggatgaaatgggcaaattcctagaaagacacaatctaccaagactgaatcatagaagtagattatatgaatagacctaaagtgagtaagaagattgactcagtaatcaaaaaccttccaataaagaaaagctcaggaccagatggctacactggtgaattctaccaatctttttttttttttttgagacagggtctcgctatgttgcccatgctggatggagtgcagtggtgcagttacggctcactgcagccttgtccttgtgggctcaagtgatcttcagcctcccaaatattttccaaacaattaaagaaggattaacagcatttgttttcaaggtcttccaaaaaaattgaagaggagggaacacttccaaactcattatattatacctggattaccctgataccaaatccagacaaagacactacaataaaagaaagctacagaccaaaatcccttatgaatattgatgcaaaaaatccttaacaaaatactagcatactgaattcaacagcatattaaaaggattatatgccatggtcaagtgagattttttcctgggatgcaaggatagttcagcatacaaaaatcattagtgtaatacaccatcacactaacagaatgaaggagaaatcccacatgatcacttaattaatgcaaaaaaaagcatttgacaaaattcaacactgtttcatgattaaaaaaacacaccacaagctaggaatagaagcgaactatctacttattataaaggtcatatatgaaaaaacccacagctaacaatggtaaaagtctgaatgcttttcctctaagaccaagaagaagttaaggattcttaattttactacttcctttcaacatagtactggaattcctagccagaccaattaggcaagaaaaagaaataaaagtcatcttaattggaatggaagaagtaaaattatctttgttcagagatgatataatgctatgtagaaaactctacaaagataccatatatgcggaaaataggtagaactaataaacaaattcagcaaagattcaggataaaaaatcaacacacagcagtcagttttgaatgttttgatgcatcaacaatgaacattccaaaaaggaaattaagaaaattaaatttacagttgcatcaaaaagaataaaatacttaagaataaacctaaccaagaaggtggaagacttgtgctctgaagactacaaaatattgctaaaaggaattaaagaagacagaaataaatggaagatttaatactgttaaaatgtccatactacccaaagcaatacacagattcaatgcaacgcctatcaaaactccaatggcatttttttttccagaaacgaaaaacttagtctaattcacaaggaaatctcaagggaccccaactagccaaaacaattctaaaaaagaaccaggttggaggactcataataattttttattagaaaacatattacaaagttatagtaatcaaagcggtgtggtgctgacataaagacagcaaatagaccaatgtaatagatagaccagagataaaatctctggtctgtagttgaatgatctttgacaagggtgctcaatggggaaaggcgttcaacaaatgcatgctgggtaaaatgaatgtccatatgcagaagaatggagttgaaccattttcttacatcatatataaaattaattcaaaaaagaatgaagacctaaatgtaagacctaaaactataaaactcttagaagaaaacatgggacaacatgcctcatgacattagatttttttcaatgatttcttggatatgacaccgaaatcacaggcaacaaaagaaaaaatagattaattggacaacatcaaaatgttaagcttttgtgcatccaagaacactactaatagagtgaaaaggcaactcatgggatggaagaaaatatttgtaaattgtatatctggtaaaagattaatttccagaattttaaaaagaactcctacaagtcaataacaaaagccatcaaacaacccaattcagaaataagcaaatgacttgaatagacctttcttcaaagatgatatacaaatggcaaattagtacatgaaaagatggtcaacatcactaatcattagggaaatgcagtcaattctacagtgagataacacttcatacccattaagaaggctattatataaaaaacagtaaataacaagtgttggtgaggatgtggagaagttggaactctcctgtattgctagtaggaatgtaaaattgtgcagccactatggaaaacattatggcagttcttcaaaagtaaacacagaattatcatatgatctagcaatttcacttctggagacacatctaacataattgaaaacaaaaatgggacctcaaagagatgtttttgtagccatgcttctagcaacattattcacaagtcacaaggtggaagcatcccaaatgtccattgatagaggaatgtgtaataaaatgtggtatgcacacacaatagatattttttgaccttaaaatggaataatattctgatacatactacaatatggattaactttgaagccgttatgctaagtgaaataagccagttataaaaagacaaatattacatgaccccagttacataaggtacctagaacagtcaatttcatagagacagaaggtagaatggtaattgctcagggttgggggaggggaaaataaggagatattggccaaagggtacaaacatttagttagttataagatgaataaactctagggatcaaatgtacagcatgggcactatagtttaaaatattgtgttgtatacttgaaatttgttgagagtagatcttaattgctttcaccacacactgaaaaaaaaattgtaactcggtgaagtgctagatgtgttaactaatttcattgtggatatgagtataaggtttccgtttgggttgataaaaaaaattctggagatatatggtggtgatggttgcaaaaagtgtgaatgttgtttatgccacaggactatacccttaaaaataattaaaatggtaagatttatgttttgtatattttgatactctaaaaagccacataaaatgaaaatattaattagcttgatttaatcatttcacaatgtatacatgtatcataacatcacatcatactctataaatgtatatagtttttatcagttaaaaataaaatatttttaagtgaaaaaatgaacaaaggaattgaatagctatttctctaagaaagatgtacaaatggccagtatgtacatgaaaaggtgtttaacctcattagtcattatgaaaatgcaaatcaaaaccacattgagataccacttcacacttacttgagtaggcataataaagagagaaaataacaaatgttggcaaggatgtgaagaaattagaacccttttgcattgccagtgggaatgtaaaatgatgcagctgctgtgaaaaaatatttgacagtgcctcaaaaagttaaataaagagttatcatatggctcagcaattccactcctaggtattttcccaagagaaatgaagctgtatttctgcacagaaacttgtacttgaatactcacagcagccaaaagtgaagaaaacccaaatcacaagaatggctaaacaaaatgtgctatcccagagaaaattgaggagagtgaggatcatcatggtggacgggagacaggactggattacagctccaactcggacagacagagcagcatacagaggtacgcattgtgaatttagttccagatcaactgcaacaacaaaccagtaatcacaagaggatgcacagaccctctgaaggaagtggacttctcttgcaggacccaggagacaccccaaatactgtgagtgccccaaatatagaagtggaaagtggagatccttctctcccaaatacacaccgccactggagaaactggaggtctgtttgtgggagaagtttctgaccttacctggagctgagtccatttagagagccaagtgaaatacaggggtagaggaagcagcaggaaaggccctgggggcttgctgggtcaccaagcaggccattcctgcctggcaccacagggatccatcgggagggcagccagaggagtggaggaaagcaccacagggagaaggaagcctccagctgaactttgtaacaatttgaaccaggcgagaagcctcctggccagaactcgggggagggcatgaatccagtgtgcagactccacagatgggggaagaaccaagcccttttcttttgcagcttggtggcaggtagcctgcggcaagttctcaagccctgctcacccaccacctggaaacagacttggggctgttaataggggcacagtgggagtaagatcggccctttgatttgtgtgggagttgggtgaggcctgtgactgctggttttcccccacttctctgacaatctgcatgactcagcagaggcacccataatcctcctaggtacacaaccccattgatctgggaacctcacctccatcccccacagcagccacaataagacctgcccaaggagggtctgagctcagaggtccctagccctgcccccacctgatgagcctttcctatccaccctagtagctgaaaacaaagggcatataatcttgagatttctagggccccacctaccactggttcctctccatactaccacagctgatgctttctggaaagtgccacctcctggcaggaagccaaccagccccaaaatagagcattaaaccaccaaagataagaaccctcacagagtacatttcaccccctgccacctccactggaagaggtgctcgtacccatggctgagagaccatagacagttcacatcacaggactttgtgcagacaattctcagtagcagctgagagctgggtagactttctgggtggctaaaccaagaagagagacaataatcactgcagtgcccctcacaggaagccacatccataggaaaagggggagagtactacatcaagggaacatcccatgggacaaagggatcagaaaaacagacttcagccctagacctaccctgtgacaaagcctacccaaatgagaaggaaccagaaaaccaactctggtaatatgaaaaaacaaggctctttaacactccccctctccaaaaaaaaaaaaaaaaaaaaagtcacactagttcaccagcaatggatccaaaccaagaagaaatccctgatttacctgaaaaagaattcaggaggttacttattaagctaatcaaggaggcaccagagaaaggtgaagcccaatgtaaggaaatccaaaatatgatacaacaattggatggagaaatattaaaggaaatagatagcataaataaaaacaatcaaaacttcaggaaacaatgaacacacttatagaaatgcaaaatgctctggaaagtctcagcaatagaattgaacaagtagaagaaagaaattcagagctcaaagaataagaaaatataaacaaagcctccaagaagtctaagattatgttaaacaaccaaacctaagaataatcggtgtttctgaggaagaagagaaatctaaaagtttggaaaacatatttggggaataattaaggaaaacttccccagccttgctagagacctagacatccaaatacaagaagcacaaagaacacctgggaaattcatcacaaatcgatcattgcctagggacatcgtcatcaggttatctaaagataagatgaaggaaagaatcttaagagctgtgaggcaaaagcaccaggtaacctataaaggaaaacctgtcagatcaacagcagaattctcagcagaaaccctacaagcttgaagggattggggccctatcttcagcctcctcaaacaaaacaattatcagccaagaattttgtatccagtgaaactaagcatcatatattaaggaaagatacagttgttttcgcacaaacaaatgctgagagaattcgccactaccaagccaccacaacaagaactgaggaaaggagctctaaaacttgaaacaaatcctggaaacacataaaaacagaacctctttaaagcataaatcacataggacctacaaaacaaaactacaagttaaaaggcaaaaataaaaaccccaaaataccaaggtacgcaggcaacaaatagcatgatgaatgcaatggtacctcacatctgaatgctaacattgagtgtaaatggcctaaatgctccacttaaaagatatagaactacagaatggataagaactcaccaaccaatgatctgctgccttcaggagactcacctaacacataaggactcacataaacttaaaggagtggaaaaaagcctttcatgcaaatagacaccaaaagcgagcaagagtagctattgttctatcagacaaaataaactttaaagcaacaacagttaaaagagacaaagagggacattctataatgctaaagggccttgtccaacaggaaaatatcacaatcctaaatatatatgcacctaacactggagttcccaaatttataaaacaattactaatagacctaagaaatgagatagacagcaacacaataatactgaggaacttcaatcctctactgacagcactagacaggtcatcaaaacagaaagtcaacaaagaaacaatagatttaaactataccttggaacaaatggacttaacagatatatacagaacattccatccaacaaccacagaatacacattctattcaaaagcccacgaactttctccaagatagaccatatgataggccataaaagaagcctcaataaatttaagaacattgaaatcatgtcaagcactctcagaccacagtggaataaaactggaaatcaaatccaaaaggaatctgcaaatacatggaatttaaacaacttcctctcgggccgggcatggtggctcacgcctgtaatcccagcactttgagaggccagtttgggcagatcacctgaggtcaggagtttgagactagcctggccaacatggtgaaaccttatgtctactaaaattacaaaaaatagctggggatggtggcaggcacctgtaatcccagctactcaggaggccaaggcaggagaatcacttgaacccgggaggcggaggttgcagtgagccgagattatgccactgcactccagcctgggtgacagaacaagactccgtctccaaacaacaacaacaacaacaaaaaaaaaaaaaaaaaagaaagcaaagaaaagaaacatgctcctaaatgagcattgggtcaaaaatgaaatcaagatgaaaattaaaaaattgtttgaactgaacgataataatgatataacctatcaaagcctttgggatacagcaaaggtggtgcaaagaggaaagttcttagccctaaatgcctacatcaaaaagacgaaaagagcacaaactgacattccaaggtcacacctcaaggaactagagaatcaagaacaaatcaaacccaaacccagcagaagaaaggaagtcaccaagatcagggcagaactaaatgaaattgaaacaaaaaagaattgcaaaagataaatgaaacaaatagctgcttcttcaaaaacataaataaaattggtagaccattaccaagattaagaaaagaagagagaaaatccaaagaacatcattaagaaatgacacaggagatattacaactgacaccactgaaataaaaaagattattcaaggctactatgaacacctttatgtacataaactagaaaacctagaagagatggctaaattcctggaaaaataaaaccctcccatctttttttttttttacaattagtattaaaatgggaagcatatctagctcccagatcttggttacttttttttaaaattattattattatactttaagctttagggtacatgtgcacaatgtgcaggtttgttacatatgtatacatgtgccatgttggtgtgctgcacccattaactcgtcatttagcattaggtatatctcctaatgctctccttcccccctcccccgaccccacaacagtccctgatgtgtgatgttccccttcctgtgtccatgtgttctcactgttcaactcccacccatgaatgagaacatgcggtgtttggttttttgtccttgcgatagtttgctgagaatggtagtctccagcttcatccatgtccctacaaaggacatgaactcatcatttttaatggctgcatagtattccatggtgtatatgtgccacattttcttaatccagtctatcattgttggacatttgagttggttccaagtctttgctattgtgaatagtgccacaataaatatacatgtgcatgtgtctttatagcagcatgatttataatcctttggtatatacccagtaatgggatggctgggtctaatggtatttctagttctagaaccctgaggaattgccacactgacttccacaatggttgaactagtttacagtcccacctacagtgtaaaagtgttcgtatttctccacatcctctccagcacctgttgtttcctgattttttaatgatcgccattctaactggtgtgagatggtatctcattgtggttttgatttgcatttctctgatggccagtgaggataagcattttttcatgtgttttttggctgcataaatgtcttcttttgagaagtgtctgttcatatactttgcccactttttgatggggttgtttgtttttttcttgtaaatttgtttgagttcattgtagattctggatattagccctttgtcagatgagtagattgcaaaaattttctcccattctgtaggttgcctgttcactctgatagtagtttcttttgctgtgcagaagctctgtagtttaattagatcccatttgtcaattttggcttttgttgtcattgcttttggtgttttagacatgaagtccttgcccatgcctgtgtcctgaacagtattgcctaggttttcttctagggtttttatggttttacgtctaacatttaagtctttaatccatcttgaattaatttttgtataacgtgtaaggaaggtatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggtgactgtagccttgtagtatagtttgaagtcaggtagcgtgatgcctccatctttgttcttttggcttaggactgacttggtgatgcaggctcttttttggttccatatgaactttaaagtagttttttcccattctgtgaagaaagtcattggtagcttgatggggatggcattgaatctataaattaccttgggcagtatggccattttcacaatattgattcttcctacccatgagcatggaatgttcttccatttgtttgtatgctcttttatttcattgagcagtggtttgtagttctccttgaagaggtccttcacatcccttgtaagttggattcctaggtattttattctctttgaagcaattgtgaatgggtcttcactcatgatttggctctctgtttgtctgttattggtgtataagaatgcttgtgatttttgcacatcgattttgtatcctgagactttgctgaagttgcttatcagcttaaggagatttggggctgagacgatggggttttctagatatacaatcctgtcatctgcaaatagggacaatttgacttcctcttgtcctaattgaataccctttattttcttctcctgcctgattgccctggacagaacttccaacactaagttgaataggagtggtgagagagggcatccctgtcttgtgccagttttcaaagggaatgcttccagtttttgcccattaagtatgatattggctgtgagtttgtcatagatagctcttattattttgagatacatcccatcaatacctaatttattgagagtttttagcatgaaggttgttgaattttgtcaaaggccttttctgcatctattgagataatcatgtggtttttgtctttggttctgtttatatgctggattacgtttattgatttgcgaatgttgaaccagccttgcatcccagggatgaagcccacttgatcatggtggataagctttttgatgtgttgctggatttggtttgccagtattttattgaggatttttgcatcaatgttcatcaaggatattggtctaaaattctctttttttgttgtgtctctaccaggctttggtatcaggatgatgctggcctcataaaatgagttagggaggattccctctttttctattgattggaataatttcagaaggaatggtgccagctcctccttgtacctctgaaaaccctcccatcttaaatcaggaagaattagataccctgaacagaccaacaacaagcagcaagcttgaaatggtaattaaaaaattaccaacaaaaaaaagtctaggaccagatgaattcacaacagaattctgccagacattcaaagaagaattggcaccagtacttttgacactattccacaagacagagaaagaaggagccctccctaattcattttaggaggccagcatcagcctaataccgagaccaaaaaagaaaactgcagactgatatccttgattaacatcgatgctaagatccttgacaaaataccagttaactgaatccaacagcgtatcaaaaagataatccaccatgatcaggtgggtttcataccaaggatgcagtgatggtttaacataggtaagtcaacaaatgtgatacaccacataaacagaattaaaaacaaaagtcacacgatcatttctatagatgcagaaaaaaaacattcaacaaaatccagcatcactttacaattaaaactctcagcgaagtcagcatacaagggacatacctcaatgtaataaaagctatctatgacaaacccacagccaacatagtactgaatggggaaaagttgaaagctttccctctgagaactggaacaagacaaggatgcccactctcaccactcctcttcaacatagtactggaagtcctagctagaacaatcagacaagagaaagaaaaaaagaacatccaaatcggtaaagaggaagtcaaactgtcactgtttgctgacaatatgatcgtttacctcaaaaaccctaaatactcctccagaaagctgctagaactgataaaagaattcaacaaagtttctggatacaagattaatgtacacaaatcagtagctcttctttacaccaacagtgaccaagcagagaatcaaatcaagaactcaaccccttttacaatagctgcaaaaaataaaataaaataaaataaaatacttgggaatagacctaaccaaggagacgaaagacctctctacaaggaagactacaaaacactgctgaaagaaatcatagacgacacaaacaaatggaaacacatcccatgctcatggatgggtagaatcaatattgtgaaaatgaccatactgccaaaagcagtctacaaatttgacacaatccccatcaacataccaccgtcattcttcacagaattagaaaagacaattctaaacttcatttggaaccaaaaaagtgcctgcatagccaaagcaagactaaacaaaaagaacaaatctggaggcatcacactacctgagttcaaactatactgttaaggccatagtcaccaaaacagcatggtactggtataaaaataggcacatagaccgatggaacagaatagataacccagaaatgaacccaaatgcttacagccaacggatcttagataaagcaaacaaaaacataaaatggggaaatgacacccttttcaacaaatggtgctcagttaattggctagtcacatgtaggagaatgaaactggattctcatctctcaccttatacaaaaatcaactcaagacggattaaggacttaaatctaagacctgaaactataaaaaatctagaagatatcattggaaaaatccttccagacattggcttaggcagagattttatgaccaagagcccaaacacaaatgcaataaaaacaagataaataattgggacttaattaaactaacgagcttttgcacagcaaaaggagcagtcagcagagtaaacagacaatccacagactgggagaaaatcttcacaatctgtacatctgacgaaggacgaatatccagactctacaacgaactcaaacaaatcagtaagaaaaaaaaacaaaaaacaaagaaacaatcccatctaaaagtaggctaaggacatgaatagacaattctcaaaagaagatatacaaatggccaaaaaacatatgaaaaaaaatgctcaacatcactaatgatcagggaactgcaaatcaaaaccgcaatgcaataccactttactcctgcaataatggccataatcaaaagatcaaaaaataggagatcttggtgtggatgcggtgatcagggaacacttctacactgctggtgggaatgtaaactagtacagctactctcgaaaagagtgtggagattccttaaagaactaaaagtagaactaccatttgatccagcaatcccactactgggtatctactcagaggaaaataagtcattatacaaaaaaaagataattgcacacgcatgtttatagcaacacaatttgcagttgcaaaattatggaaccaacccaaatgcccatcaatcaaagaactgataagctgtggtatatatacatatatacaatggaattctactcggccattaaaaggaataaattaatggcatttgcagcgacccggatgacattggagactattattctaagtgaagtaactcaggaatggaaaaccgaacattgtatgctctccctgatatgtgggagctaagctatgaggacgcaaaggcataagaatgatacaagggactttggggacttgtggggaagggtgggagtggggcaagggataaaagactgcaaatacggcacagtgtatactgcttgggtgatgggtgcaccaaaatctcacaaatcaccactaaagaacttactcatgtaaccaactaccacctgtaccccaataacttatggaaaaattaaaaaaaacaagcaaacaaaaaccaaagtgtgctatcccatacactggaatatcatttgacaattttaaaaaatgatgtactgatacatggtgtaaaatggatgaaccttgaaaacattatgctaagtgaaataagcaaggcacaaaatagccacatatcatatgatttcatttatatgaaatgtccagaataggcaaatctgtacaaagagaaggcagattaggttttgctacggcttggagggagtgagaatgagaaatgactgctaatgtgtacagtttcttttagggggaaatggaaaattttctaaaattagattgtgatgatggttgtacaatcctatgaagatactgaaaacattgaattgtacactttaagtggatgaattgtacggtatataaattatatctcaataaagttattttaaaacaatgcacattatagaaaatctacaaagtttctgctaataacatgtaatgtttttagttgtctttaaattactatctttattttaggatgtttttagttctagaatcctgagatttgatgaacaaatgggtgtgattttccccacaattaactttgggcacattttaagtaattgtatgtgctgtgattactagaactacacatgctgtgctagtatggaatagcatgatttatgaatcatattttttctttaatatttctttagtattttgagccacctgtaggctcattgagctgatgtttggagcaatttgctattatgcctatcttgcatggtaaagggtagtatagagctcattatcttttaagtttagttcatattctttttctctaagttcatcattaccttagacatactactattgaatttcatgtggcagctttggcctgctcaggcagccttgagccattatttatcagtttgttactgttagcttaacatttcactactgggaagagctaaataacatgcaaatttgaaggtcttattgtataattccttttctagataattaaaatgttaatggttgctcaatggatataaagcttcagttatgcaagatgagtaagttttacagatctgttatacaatatggtgcctacagttgacagtacagtattgttcaccttaaaatatgttaagaggatagatttcatgttaagtgctcttaccacaaccccccgacacaagaacatgaagaaatttttggaggtgatggatatgtgtagtactttgattgtgcttatggtatcatgggtatatgcatatatccaaactcataagtatgtatgcattatgtgcagttttatatataaattaataaagctttaaaaaagtatctctgcatgcacttttaaatttccctctgttaatattctgggtctaaaatagaacctatttatggttttgttcatggtctttaatctccaaatacagataaggttgtaaaaacattaacaattatgtgggaaccacaacttccaactgatggtctactcttgtaatattcttcttgcataaagcaagatatgatgtttactctttctcctcaaatattttccttttgttgtctttgtttcccccagtggcaatgcttctctagttttacagtggaatgcaagaacaaaagtgattagcttttttaccaatagatgtcttctgttctgtaaaatggggcaagcctgtaagtttattctgaattttgggttatagtatggaatggaggagaagatgctattactaggacatagtagagattggctatgatccaaataccattacattacaatttgaatcttaacaacaaagaagatatcaaattgactcctttttctacgtgatacaacacagtgaccttgaaagcagttctaatttcaggcttgtctttcagtgttactatagtcattagatagtttcacaatggtaaatgtgacttattaggtatgagatatttcattttcagaattatatcaaagcttgacattagaacagatgtagatatttgcagctgtgtgtccgagtcattcaaatcgcttctacctagaagtgcaaatagatttgaattttcctttctcagagtgatttgtgtccagtttgtagattttctgagcactgtcttctttatctcttcttgctttccttttttgaaattcattgttttcaatgagtttgtgtgtgaataataaaaggctagataaagcttaagctagcaaatttcagtgtttttttcagaagccctaataaaatatttactttatttttaaaaggtacttggtttgaaggagtagggccataagagtgattacagaaacggtattgagggcaagtgctggctgaacttagagactgggcttacagtagtccccccttaccaagggggatacattccaagaccccccgttggatgcctgaacctgtggataatacctaaccttttatatactgtgtggttttttttttccatctggtaacagagacagctactaagtgactcatagacaggtagtgtttatagcatggatatgctggggaaaggagtagttcaggtttcgagagggatggaatgggacaacatgacattttatcatgctacacaaaatggcgtgcaattaaaaacataaattatttatttctggaattttcaatattttcagaacacaggtgactgaaaccatggatagcaaaaccatggataaggaagaatttctgtacttttagaatttaatgtcctttagtatcataaataatccagagtttgccttctgcctttcagatttaccactagcagaatagtggaatttttttcttgttttttattttggtatatacatttaattttttcatgaataacaaaaagaatcatgatagtttattcaaaggtttcccatgtaaacacctaagatgggaccaattcaatccaaaatttaattgtatacctattatgtgcctcaaaatgaactagatatttgatttacaaggttcagaaaaaatgtatatattcccagcccaagattcttaatttttttaaataataggatgtaaggaaaaagagactttagtttaaagagctattaccataatgcagaaacatgagtcaaaaatagatcttactcacctgcaagtgtatgtactaagtgaggaaggaagtattcagtaggtgatgttgaacactagcaccttattgtaaaggtcctgatcttcatgcgcagagcagcaagccctgcagtagagatttagtgttaaggtatatgttgccattgttattgggaaaaacttgttttaattgtgaaagtgggtatgaattcttctaaggctctattggaaaaaaccttaatgcaaatattcattgagcaaaaacggttatacatatgtgaattatctcttacccaaaataaactttcaatgtaattaaggagttaagactgcatatatgaagccattgtagacatgacagagtaagaacctaccctaacctcttggggtaaactctctttgcccaggaatgcttcatggaagaagtaggatttttcttttcttgttaagaggcagggctccctctgtcatccaggctggcctgtagtggcatgatcacggctcaatatagccttgacctcataggctgaagccatcctcccacctcagcctcctgagtagctgggactacaggcatgcaccactacgcccagctgatcttttttattttttgtagagacagagtctccctttgttgcccaggctggtcttaaactcctgggctcaagcaatcctccagccttggcttcccaaagtgctacagccacaacactcagccagaagtgggattttagatgcccactgaagaattgatagacttccttatgttacagtgaaaatcacctttttcagtagaacgtactatagcttttggttgacatgtgtactggaagcaatgaattgcattatggcacagtaggaatgataaacacaggttctgaagtcagactgtttgaatccaaattcggatttcatcacttactagctccatcactataacatgggaataataacagtatctttctaatagggttgttaaggattaatgagaataatacatctacatactgtgagaatagtatgggctatgtagtctgattggctacatagctgattgtagtctggttcaaatcccagttctgccacttacaaaaaccttaggcacttggcttctcaagattcagttttctcatttataaatggagataatgaagcctaactcacagaactgttgtgatgattaaatgaagcaatttacatcaagtacttactggagtgcctgacatataataaaagctctataaataatgttatgttcttatacaatctaagtcgtgtagagacttcagtattatctttttattcgtgttttcagggtgagcctggtctgcctggatacccagggaaccctggtatcaaaggttctgtgggagatcctggtttgcccggattaccaggaacccctggagcaaaaggacaaccaggccttcctggattcccaggtaaaatttcttctcttaaatgcttccttctttccttccttatctactccaaccagtatcacagagcagcttcttatttggcagacttatattttatttcccaatcagatactgactagcaacataatctcaaactatctctttaccttttctttgcccaaatttatttctgtataaaatgagaatgaatattactgactcagcaggacaatatcctgtggacagagagactgtttggtggagcatttttcaatctttgactgctagccacaaatcacttaagaagccttgctatttttgtaggtaataatatatacttccaagcctctgcctgcagctgattatcttagaaaggtatgcccaggcacaccgctggtagcggttggtagaacaatcatacagttccttcaaatggcaaggattgagccattcaagtaagagattagcactatagtcaattatgtagcctgaactagattattatagtacctacttgtttagggttgaatttattttttgcttgttttgaattacacagtggcatggatgaatgaacctttcctttttattgaagtgaagcatacatgtagtaaagtacacttaagactatagatgagtttttacctaagtacatatatgtctttgaattgaccatatgtatcaagatataaaatagtttcttcatcccacgaagtttacccatgcccctacgccccccaaccccgaggtgaccactactatgacttccattaccatcagttaattttgcatgttattgaaattcatataaatgaaatcatacagtgatccttgtatctggcttttttcagtcatcattatgtgtaaaagattcatttattttgttacacgtgtcagtagtttgttctttatcattgctatgcaatattacattgaagaatgtaccacagtcaattacacattcccctgttgatggacttttgggttgtttccagtttgggactattatttttaaaaatgctattaacattcttttacatatcttttgataaacatatacattgatttctcttagacaaaaacttagtagtagaaatactgaatcacagggtaggtgtacattgaactttagtagatgctgccaaacagttttccaacatggtttgtaaattagtttcaacagccatgtatgaaatatccagttctccaattgcccatgtcctcaccatcactgggcagtgtcggtcttaattttatctgttttgatgagtatgtagaagcatctaattgaggtttgaatttacatattcctaatgaataatagtattaatcatctttttattatactattggccatttggatagcatctttttgaagtttcttcttaagtacttttgttcattttttattgaattgtctgtcctttttcaaatagattcagagtagttctttatatactcaagatatgagtcctttgtcagatacatatattgcaaatctattctctgtgcctcagatttgcctttcctaatgctgttgtgtaatgaacaaaagttgttaattttaataaaatccagtgtatcaatctttcctttcatgaatagtgatttttttatccaattcaataaatatttgtctatttgaggttatggaaataatcttctaatttttataacatgtttcatgtttaaactttcatatttggcttatgagctatctcaaataaaaatatttttacagtgtgaggtaggggtcaaggttcattttttttccagcacagttatccaattgctccctacactattttttttttaaagaacctaaacgcatccaataaattacagtcacacctttgtaagaaagccaaatgactgtacatgtggtgggctatttccagactctgtgtactgttccaatggtttattttctattgctgctttaacacaacactgaattactgtaaatttatattaagccttgaaaaatggtgggtaagtactagaaatttgtttcagttttttaaagcttgtcttggctattctaatttttttgcaggggaaatcagtttatcaatttccatttaaagtatctgtagggatttttaagtttgcaataactctctaggtaaggtagaggagaattgatattttgacagtattcaaccttccaatgaaatgaacatgttatctctccatttatgtaggtattgagtttgatttaacaatatgctgcactttttgttttgtaaatcttgaacatattttattaaatttatctctggaaatttgatgctttctggtgacatttaaatcatattgcttttcccagttcatcttccagttgtttcttggaagtatatggaaataattgacctaggaatattgaaataatatatgagaaaattgccaatttcactttttaaaattctgagtttgtataattttttgttttataaaatatcaccttagatatttttatttcttctttttcatttctttataccttttatttctttttcatgcttaattgcaccagttaggacctgtagtgcagtgtttaatagaagtggttatagtcaacatcattatcttttttctaaactcagagggacaatgattgctatttttccattaaatgtaatgttagtgccagggttttggcacatatattttactaaattaaggaaatccctttctagtcatactataatgggaatttttataaagaatggatgcgagttttatcaaattctttttctgaatctacagagatgataattgttttttctcctttactcttgatataatgaattacactgattgatattttatgtaaaaataaccctgtattcttgggataaactccaagatggtcatactgtacacattatctttaagtattgttggactggatttgctgttttttaaaaaattatacatggccatgagagagattggcctacgattttcttttctcatagtgtccttgtcaatgttttagtatagggatttgctggccttatgagctgggaagtattccctccttctctattttttctttaaatgtttcatagaattcaccagttaaggaatctggatctgtagttttctttgtagaaacctttttaaattacagattaaaagtctttaacagttatattactattcagatgatttatttttatgtcagtttaaatacattgtgtttttcaaggaaattgaccatttcatctaaattgtcaaattcattggcagaaagttgttgataatatccttgttttgtccctttaatttctgcagaatgtgtactgaagtctgcattttaataatgttttgatataagtaattttatttctttattttgatcaagcctctgaggcattcattaagctttattaattgttaaaaattaactttcgtaagtgattttctctaccatttgttttctattccattgatttctgcttatatctgtattatttcctaccttctaccttctatggatttaatcttgctgttctttttctagcttctttacctggaagcttaaatcatagatttttcagctttgtcttttctaatagatgtatttaaaaacttaaatttccatctaaggagtgctcaaaccatatcccagaaattttgttcttttgcgtttttcctttgatcattcggtttaagatattttctaattttcctgttgatttctgtttttctccatagattatttagaattgtgttgctcaacttacaaatatttgggggcttcccagatatctttatgttattgatttttaatttgattctattgtggccagaatacatattttgtatgatttaactattaatacttattgagacttatcatatggccaaatttagggtttatctgggtgaattttccttgtacccttgaaaataatttgtattctgcaatttgtgtattgcattataaatgtccattaggtcaggtttgttggtagagttgttaaaatcttgtgtattcttaccaacttcttgcctaattgttttatcaattactgagaggtaggtgttaaaatttccattatgattgtagagttttctatttctccttttctctctgtcaattttttgctgtatgtcttttgagatatttttattaggtatatataaattcaggaaacgtatgtcttcttgaagagttgacctttttatcattatgtaaagaccctctttattttcataatactcttttctttggatttttctttgtctgatatcagtatagatacatcagattctttatacttagtacagtataactttttctatataatttttatttttacctgtctgtacatttaaaatatgttttttaggaataaaatgcattcatatcttgcttcttttcgagtccaacaatctttcccgtttatttggagtgtttagttgatttatatttaatgtatattgttatgtttggattttagtcttccacattgctatttgttttatgctcctcctttgtccctggtttcctgttctgtttgggttcatcagatatgctgtggtattccattctatctcctctattggcttttaagctctccctctttctactatttttaaatgattgctccaaagatttcagtgtgcactcataatttaccacattctgcattaaattaatattatgtgacttcacatataatgtaagattcttacaacagtgtaattttatttacatataatgttcttttgtgtgattgtgtttatatatttcagatgattattatataggtaataaattttacaattaattgctattactattgctttaaacagcttcttctaaataatttagcatgagaaacaaaaccaattttcatatttaccaacatatttacatttctactcttctaccctcctgtgcagcagacttctagttggtatcattccctaaagcctgacgttcttccaccgtcatttattgtaaaatgattttgctggtgacaaattctctcaccgttaatttatctgcaaatgtctttgttttagttccattttaaataaatttttcactggatatagaaatccctttttgatatttgttgctttcagcactttaaatatttcttccactgtcttttcgtctccatttttcctgataataacacatcaattatttttaatattttgctcctttatattatgtctggtttttctctggatgtatttgagattttctctctgtaattggttttcaatagtttctttttgttgtggttagttatggttgtatttattttgccctctattcattaatattcctggatctgtagggttgttattttttaataactttggaaaatctcagctatcttttcctcatatatagtcgtgtgtcacataacaacattttggtcaacaacaaaccacgtatatggtggtggtctcatatgattatcatggaactgaaaatttcctatcaccacgtgatgtcatagctgtagtaacattgtatcacatttataatgtatttttactgtaccttttctaggtttagttatacaaatacttaccattgtgctataattgcctacaggatgcagtacagttacatgctatgtaggtttgtagcttgggagcaataggctctgctatacggcctaaatgtataataggccataccatctaagtttgtgtaaatacactttatatgttcacacgatgacaaaatcgcccaacaactcatttcttaaaacatacccagttgttaagtgacacataactgtatttcttctgtcgtattttctcctcttcttttggagtgcatattagatcacttgatactgtatcacaggtcactgagggtctaggtatgttttcaatttttattctctctgagtttaatttggatggtttttattcactgccttcaaatttactgattttttgatgtgttcaatattctgttaatcgccacaaaaattttaatttccatttggttcttttaagagttatcatatttttccagaaattccctattttttactcattatatacatgtttgcctatagattctttaacatatttattatagctattttaaagatcttttcagcttattccaaattttcagataaccatgtgtctatttctattggtagttttgtttttcttgaataagcaccacatattcaagtttcttccaatctgctaatttttattgtatactaaatgatatggatagtatggtataaagattctggattctattaaatttcttgaagaatgctgaatattgttctacctggcagttcaattcctggtatcaacttgatcctgcagtgatggagttttagattttgttatagcagggctatttccaatgccctttgtcttacgtgtatcccttggacttggcatacgggctttattgttaatgtgtgggttttctggggtaattttatttaaaaaatttcatttagtatttcttttttttaagtttattattattatactttaagttttagggtacatgtgcacaatgtgcaggtttgttacatatgtatacatgtgccatgttggtgtgctgcacccattaactggtcagttagcgttaggtatatctcctaacgctatccctcccccctccccccaccccacaacagtccccagtgtgtgatgttccccttcctgtgtccatgtgttctcattgttcaattcccaccgatagactagattaagaaaatgtggcacatattcaccatggaatactatgcagccataaaaaatgatgagttcatgtcctttgtagggacatggatgaaactggaaaccatcattctcagcaaactatcgcaaggacaaaaaatcaacaccgcatgttctcatttagtgtttcttatagtgaagtctgttggcaacaaattgtcttagctgtcattcattagaaaacatttccattgtgctttcacttgttattgagttacatagtagacagaattctaccatctccaccccaagatttctggcccctggttatttagtaaaaaaccaatctccttaaagctggtaagcaacttcagcaaagtctcaggatacaaaatcagtgtgcaaaaatcacaagcattcctatacaccaataatagacaaacagagagccaaattatgagtgaactcccattcacaattgctacaaagagaataaaatacctaggaatacaacttacaagggatgtcaaggacttcttcaaagggaactacaaaccattcctcaaggaaataaggacacaaacaaatggaaaacattccatgctcatggatagaaagaatcaatatcatgaaaatggccatactgcccaaagtaatttatagattcaatggtattcccatcaagctaccactgactttcttcgcagaattagaaaaaaactgctttaaatttcatatggaaccaataaagagcccgcattgccaagacaatcctaagcaaaaagaacaaagctggttgcatcacgctacctaacttcaaactatactacaaggcttttatcacctagtgatatcatagccatagtaacattgctaaggagagaatccagctcagctgtgcccagaatattacctacagaaatggtgagataataaatgggtattgttttaagtcattaactttgtggtaatttgttacatagcaagagaaaactaatgcactatccttttgttcattatttaagtttttacttccctcctaaatatgcttgttagtatttattttagggtctttgaatagttgctttttgtattctgtcaagttttaaattataatcagtgagaaaaaaaggctgtagtgggcttattctatcttggcttgcctcagaagtgtttaggggtaaatttaagaaaatatttgcatggtatattcactgaaaactataaaacctgctatgttagacttttaaataccaaaataaatgaagagatagatcatacttatggaatggaagatcaaaattgtttggaagccattatccttagtaaactaattcaggaacagaaaaccaaacactgcatgttctcactgacatgtgggagctgaacaatgagaatacatggacacaggaaggggaacaacacacactgtggcctgtggagcagggtgtttgggtcagggggatggagagcatcaggaaaaatagctaaggcatgctgggcttaattcttaggtgatggtttgataggtacagcaaaccaccatgacacacgtttacctgtgtaacaaacctgcacatcctgcatacgtaccccagaacttaaaataaaaaaaaaaaagatgccagttgcctctaaagtcattcatagattcaaagtgattccagtttaacccaacaacctttatttggtaacagttgacaaatggattctaaaatgtgtatggaaatgaaagggacatagaatatccaaaacaatattgaaaacgaggccgggcgcagtggctcacccctgtaatcccagcactttgtgaggctgaggcgggcagatcacgaggtcaggagtttgagactggcctggccaatatggtgaaaccctgtctctactaaaattacagaaattagccgggcatggtggcatgcacctgtattcctagctactcgggaggctgaggcaagagaattgcttgaacccgggaggtggaggttgcagtgagccgtgatcgcgccaccgcaatccagcctgggcaacagagtgagactccattacaaaaagaaaaaaaatgtgtggtacttgataaggattgagaaatagatcaatgaaacagaatttggaggataaaaaagactaatatacaataaattgacttttgataaaggtatcaaataaattttttagagaaagcaaattcttttcaacaaatggccctgaaacatctagatattcgtatggggaaaaaataaaacttaattcatacattacatcatacagaaaaaaaaatgtttttaattagatcttagtctgaacataaaagctaaaaccataatgcttttagaggaaaacatagatagatatttccgtgacttggcataggcagattttcttaggatacaaaaagcagtaactgtaaaagaaaaaaattgatagattagatttaaatttttaaactacttttatcagaaaacaccgctaggaaaatgaataggaaagccacagacaaggagaaaatatttgcaaaacataactgacaaattactgatatctaggatatgtaaaaaacttcaataactcaataataacaagatgtattatccaattttgaaaaatggagaaaactttgaatagatacttcacgaaagaagatatacaagtggccaataatcacatgaaaaggtgatcgatgtcgttagccatcagagaaatgcaaattaaaaccacaatgaggtagctccatatacccaccagaatgtctgttattacagcaactgatatcatcacaaaggttgtgcaaggatctggaacaattggaatttccacacattgttctgagtgtgaaatggtttggcagtttttaaataaaacacaacatatacctactttttgacccagcaattccacttcttgttatatacctaagataaattaaggcagtggtctacaaaaagacctgtgcagaaatactcatagcagctttatttataatagataaaagctggaaataaaacaggtttttataaataggaaagtggatatttgtaataactaaaacctgtcaataaaccaaaagtccagcaagaggaatggattttttaagttatggtatattcatataatggagtcctacaaatcctaccagtataatatggtggtagttatttttatgtttatgaatatataataatgccaacttcaggataaatggttaaaaacataaaattattattaaaaatagccaacaaacaccagcatcttttgggtttctttttgttcttcactgtttctatgctagcactataaattgtaagtttgaattgtagctcttaaagcaatgcagtttttctttcatttttaaattgagctctttactctaggaaccccaggccctcctggaccaaaaggtattagtggccctcctgggaaccccggccttccaggagaacctggtcctgtaggtaagcatgaaaaataacagtttgctgttttataaaactaatgtttatcatattaagtttgggaaagtcaaatcatgttcagctgtgaacattttcaacacaaggaaatatagtgttcattcacttaacactgcatgtgaggtacagaatgaataacttttaataaaaagtgcttaaaattggctgggcacagtggctcacgcctgtaatcccaacattttgggaggccgaggtgggaggatcacttgaggtcaggagctcgagactagcttggtcaacatggtgatacgccatttctattaaaaatacaaaatattagctgagcatggggatgggctcctgtaatcccagctacttcggaggttaaggcacgagaagtgcttgaacccaaggggtggaggttgcagtgagccaagatcgtgccactgcactccagcctgggtgacaaagcaagaccctcgaaaaaaaaaaaaggacttaaaatgatcatatgtgaccttattttctaggcccactttttccagggagagttaattcaagtgtcctagaatagaagctttgatttttttagaatggcaggctgtagtaagtaagtttgtttattgatttctaaagtaaataacttctcttggccccatatgaggcctataattctccccaccacccttcgcaccttactctcttagatattctgaaactatattaaaatgaagaactgaaaggttttagatgctgaatgactattccttattttcattatcctccttcatatttttataacattttgtgatccaaaggagtgtctcaaaagcaccttgtttcttttggataaagaagggagcatatggaagtaaaagggagttggaaattggaaaactgggtgtaacctgctgtactcaattttttaggtggtggaggtcatcctgggcaaccagggcctccaggcgaaaaaggcaaacccggtcaagatggtattcctggaccagctggacagaagggtgaaccaggtgctgtagtttttcatttttcctatttttctaattttctctgtgttgaatttaacttgcctttttattacccacagtgaaattgtatcttctttcttactaagctaccacacactttccccttttcctagttaccgtcttcctcttcatcctgagactattagctcatgtatcttgatcaagttgcctcttacaaaaaaccccatatcttttcttgtctaattttttatatcaaaaagaagttacctagcctttgcaaatttctctgtggtttactatgcaatctatatttcatttatatttttttcttataagcatatagatatatttaacattcatcggaaatagaatatatgtttagatcattttctcatgttagaattgcagttctgtgttggaaataaatcttctgcatgtttcatataatatacattgctgcacctaatgaaaacctcaatgatctaaaaataatttggccttgtttcagtttgtattatccacttgagtttttgttttgttttgttttgtactctgacaggtcaaccaggctttggaaacccaggaccccctggacttccaggactttctggtaaaccttaataaaacatgctaaatcaatctataataaaatgagattatttccaaatacatctatttttccatctccaccttttactatcataaaatgcatgtaagaacccagaaaactcaaacctagtgttaacgttaaaacatttattatttagcaacttagtttaaggagttgtgttaaataaaaatgtatccttacggaaatttacatgtagagatctcttcactaaattcataaataagtgctgaggaaataagaaagaaggcaaaattgcaggaagataagaaaagtctgtagaaataagaaaagtctgtagaaatatacgccaataataaaaatgtttctggaaatttcagtcttaatatatgttttgcatatttgggtagatgtgtgtgtgcacacacacatctaccctccctcttttgtgcttactcttactgtgagcaccaaatagtagaaggactgaatgtacatacagacatgtatgtttatgttctgaaatgacgactggccattttatggagacttttctcaaaccatacacatatctcctgtaaagtcaaatagatatccttcccatgataccaacatggaaattattactttaatgtgccactgttacattgctcttaaaagtgtcagaggtagagaaaaaatgttgagaacaattttgctagacggtgattataaatattgggtagaatggtcttcggggacacatgacaaccattgaagagccatatctttcattagtctcaaaattagactcaaaatatttgttttagaaatttcctccagccatcttgaaactatttttgaagatactttatactttttttcctcacagctattggtgatgtatcattgctctgtcttaacacaaaggataccttttaggatgaaagctattattatttctacatttctatatatactctaataaatacttctgctaacaaatgcatatatttaataggaaggatggttttctgggtagatttgggatttggtaggagatagaaatgactcttgtgaattccattaattgccctaatgtatgtgaatagctaaccttataagcaagcttgtaactcggtattatttatcttctaattatactttactttcataggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtatgtccgtgagtggtaggagaatggtctatttattagtccatgtatttcgttttgctggcaggttattcagtctttaagactttagaatttttccggtgcattggaggatgttaaaaaaaagactttaaaatttgtgatataacttcttacaagtaaatagcttggttcatagctaactccatctatttccatggttctaataatttgctttagtaatgcattttatcatttatatagaggaagtaaaacaatttggaggaataaaggaaatggtagttttattagtcttgttactaaaaggtaaaactatactgttaacctgtcagcaaaatgccatctgcatttttaaatgtgagcttctcagcatgtcatcacagaaatcattttagtgatcacccaatagatgcttgtggtccataccagaagtattgctttggttctgtcatatgatcagcaaatctcaccaggcacaattaaaaaaattatcttctataggaactgggcaatcaaatttatctccaacatcacagcatgatcaaattgactagtgatctcttcataccaacctcatgtctatacctcatttgtcttgtgttcactgctctagtagtctcagttttgcatccaatgttcaccttttcattttgtatctgtgctgtgtcatttcattttactaattttggaaatgctcgttttcatccttgattaatgtcactgagcctagtcactggtgataggttatgaacagattttgagacttgatattcaaattttatatttctggtcactgaaaacttggaagtaaatgtccttttattctttgaaagtctctgacattatataagtgcatttcaaaatgaaaaatgttatttatattacagtaaaatctaaagtgattggaattcattttaataagatgttctaaacacatgaattaaatgggatcacatactgtgttcagaggatcattttcaaaaccaaattttatctgatctgacataatctgatggaaagtattgtttaaggttttatgtttgtatactactgaagaaaaccagtgaaaatctcctcagccatgttaactctcttgcatgtaatgtaaagaactgaagcaagtatcttgcttggttttgcatgcagtaattcaaataaaccaaactattatcttttttatattttaatcatcactgtggttattcgttcttactagtaatgaatgagtaatgagctcactgttgaaccttactttgaaatttgtcggtatgaagccattagtcacaaagatgtcctaaaaattacatttttaaagaaataataacaaaagtagttagaagaatgcacacctgatgagtgtttgtgacttctcaaattatttcataaactataaattaaaactgagttgtaaaccccattgctcttagaattgattgttcttagtctgagctcatagtaatgattatgatagcaatgacttttggcctttaaaaatacgccacagtgtgctgttttcattttagttttgtcactaagtggtgataatttggtttatatacagatgcatggatatgaactttcagagtattcttttattgaaatgaattttaacttgaaagtatttagtgtaatgctttttagtttcttgatatttctaacagttttgatatttttcctttttgttaatgatgacattgggccttggtgaactttgatccctatccaggtcctacaggttagctccttaactccaaagtagtaactgcatgaagtttgaaacttatatacctgtaccaaatgttttcaagtgtttgaatgtattttaagagcatatgtgccaattcaattcttacatagtggcttatctctttaagtttttaggaacttgtagaacccagtgtttctgtctattggaaagacccaaaattacctaactaggaaaactaatttaacatttaaaaattcatatatttgtgtcattttcagttgaaaatctgtagtaccgaaaacagccttacatattctacctttctttggagtctgtttcttatgtttaatttatatctgttaatgcaaacgaattgaactatccttcaaaaggacattctttttttaaacaataatatgtattatcagatcttgaaaatatgtaattcttaacttgccatatcttttgcaggttttcaaactatcccaccttcacattttgggttgtcacaaagttctcaattctactgctgttaaaaatggactaatagggccgggcaccatggctcatgactgtaatcccagcactttgggaggccaaggcgggtggatcacctgagatcaggagttcaagactcgcctgaccaatatagtgaaaccccatctctactaaaaatataaaaattatccaggcgtgttggtgtgcgcctgtagtcccagctactagggaggctgagaaaggagaattgcttgaacctgggaggtggaggttgcagtgagctgagattgcaccactgcaccgcagccagggcgagactaataggcacagagaaaaaaaaaatcaatgcaaccagcacagattacgaggttcttaatcttattttcattatacatgtgtaaacagtacacaccaaagaacaattaccaagagctacctaatggaaaattgctgattcttagtgaaagatgtttgtttacctaattagcagtaaaaaaagccacaaatatttgaatgtatttattgttattcaaaataaatagtccttttcaaattgttaagaaagaatcaaaagaggtaatagtataccccatgatatctggctgttgagaatggcaggacattttttcatcttataaaattaaaaaaaataatttttcaagattatttttagggagccatttgtttctacctgaattgattctctagtttcttactccactgcaaactcattatttcatagaaccatagaatgtcagatctagaagggacctaagttttacctatgtcgaggagaaattatccacaagacagattttattcaggactattgcagtagagtagaaactattgcagtaggagagagactgagctcaacttcaaatacaacaaagaaaagtgattatttacagccaaggagcagagtgagagggccagtaatggaaaattactaagaggagacatcaagggtagagaggggtgggttcttgttaaactggcccaacaggatttttgccagaaacaggccaaggatttagacatcaaaggtgggagatcaggaacttgatcagatatcggggtgaagggactctctctaaaccgatttagcaggattattgatgtaaatggatttggaaggccaaaaagtaggcccaaggatgaggcctaattgagaggagggctcagaggagcctgtctaaagtttgatcaaggaatctttgtcacatatgaaaaaatggaggcccaaagaggttaagaaacttgctcagggtaatactgttagttagtggcataactgggactctgacttaaggctccccagtgatcaattaggtgtctattctacagggagcagactgttcgctgcatccactttcttgttttctgttacctcaaaagctccgtcaacacctccatcaaccagattgcttcttgtgttcttcttaaatgatgtcatcaaaaagattaagacagtgcatactatttaactatcactaagataaagcaaagactagggggttactttgaagtaatgttgagtcccaccttatctgacctacatagaattttgccactttgattactgctaaactctactgttagctaggagatttctatcttctgagttactataatatattcaaagaagaaaaagaaaagtagccacattcctttaaaagaaatttaacaatttattatttacaaaatgtgctctaaattgcatagttgttggaacttggtctctgtgatgttttcttctttgcaagactacaaccttaagtggaaactgaatttaaaatataccagtcaattcatcagtatacctttagtaattactacttatggacaatattttaggtttttgttttgttttctttttcagtttaactttgttacacagttgaaaaataatggattgtggacctcatacaaaaaaaaattgacttggcatatagctcattaaaatgttgctttttaaaatagagtcttagaagttttgctatgatatgatccacagttttccttgctaattactcaggctgaaatgtcatatttcaatgaaatattttgctgagagttcttgttattggtccctctatatcaaacacatatataaaatgtctttactcaaaccttgagttgtcttagttgggaattctaatttatttaactaattttgtggccagactctgctctaagtattgtcttgagttaatttgctgtctgtgatttagaaacaatttaaataaacagaagccaatatttagctttctgaatttcaaagtatcaaatgctttgaaagttttattaggagataatgataatgttttctatttatatgacatgccacaatttacatcatataatgtacttttattgtaagcatcttaagggcagagtttgagtcttgctcatctttgtgtttcctgtagcaccttgcacatggcagacattaggccagtattttacaacttgaatttgatctttaaaacattcctgtgagggaggttagggcagataccagtattcccattttacaggtaaaaaaccatactcagaaagattgaattgcccaaagtcatatagttattaagtagcagagtcaaaaatagatcctaggtcttccaactcctaggattcattgctctagcacaatttattctctctgctaacatttggtgcttataaatcatagcaaaacttgtaagaaaagaaaattgtgtttttagtcaattaacactaaccaaggggtgctctatttgtaggcttttaatctttttatttaatgatccttcttttaatagtgaatagcctgtcttaatatgtgcattgaataataatagagtaaatatgatattttctgtggttcggggtgggatattgcatgccaaaacattttcaagtaccctttcactgataggcttcatatcttggaaaagttgaatctttatttttgtgttcaatgttgtacaaatatatattggctttttctccttaagtaacttattgcaagtactataataataatataataataataataataataataggccaggcatggtggctcacgcctgtaatcccagcactttgggaggccgaggtgggtggatcacctgaggtcaggaattcaagaccagcctggccaacatggtaacaccccgtttctactaaaaatatgaaaattagccaggcgtggtggtgggtgcctgtaatcacagctgctcgggaggctgagccaggagaatccctagaacccagaaggtggaggttgcagtgagctgagatcacaccattgcactccagcctgggcgacagagtgagactctgtccaaataataataataataataattcaataaatagtaataggaaagcctcctggtgaattatgaaaaaaatcagaatgtggcttcatgaaatgcttttcaaatacaagcaaaagtacagttggtaatggccatcgtatattcatgttttgatttttctattctgtcacccatgatctttatatttattgccaatgaggcctttaaagtcaactgtatcttcttgaagcagtctgagcatatcaagaaattggcacctggtgtttttattaaaagataacacaagccaagataaacttcagcattaatccaaaaatacccctttactaaaggaatttgaaggctgttggtgaaatggtactatctagccaactttaatgttttgagaagctaatttttggaaagccacagtagcagtgttaacatgatgtcttcagtagagttttctattttctggattaacgaagaccaacagcttatcctttagaataagctctatttgaaaaagtttggctctctatacttctgtatggttctgtttgcatactgattatgctgtaagtataagaaatgctggcaaagaacattattgttttaacttgtactataatgtgaaccacttctaactcataatcttattttgtactgtgtgatgtctgatactgctaacatcgatctttgggctttggtgaactctgatcttcccaggttttcaaggttagactcttcactggtcaattcttttttttttttttttttaatgctttgtgtgtgtgataagagaaatgcaattttttgctataattcagaagtcattggagagtgctgttatcctcaagctggggttttaacattttgatgaaggtaatgtgacttgattataattaagtttcaaatgacgttagggtctttgtgtttgcaattgtttataataagtaatcaatacataaagacatgttgaattttaaacggaaatacacttatttttaccttcaagactgcattaaaatatttaggcaagcatatgacctatttgtaatctctgaatgttgattttattttctcaaaattttgttttctcagattgccctgatctgtgtatttatggctattttcagtgatggcagagatatactattgaatactgttaaaaataaaacttatatgttctttatgtaattaataactcataatttgaaggactctaaacatcaggtctgaattaacatgcaagtttcccatttttttttaatttcgaaaagtgcagtgccttaggttatttcagatgatacagtgttctgataacttttaaaatggagtagagggtcataaaaggtttctttttttcccatcttactttgttattgttatcaggttgattcacagtttatttatttttcataattagctgatttgctacttaatttctagtgcaaatcatacattgtggattaaattgacaagtttgcttagaacactgaagttctgtttttttattcaaatgtacaatgtactaaaccttttcgttatgattgagaagggaatttctgtgttgactggttgccagcctagggtgactatatgagttaaattgtttaaatgtaaaacaattgttgtactattgtaaatctccttcctctttctcatatgccagatagagtcatgttatattatgaaattacatagaaatacctgaaagattaaaaagatgctcatattttaagatttgtttttatcttcaattttactaataaagaaaataataataattttaaaaagtccttccatagcttctactatataccaggcactgtgctaagtaatttttacattgtatctcatttaatccttggaacaacctgctaaagtaggtgctattcttaattccattttatagaagaagaaattgaagccaaggagattaataatcttactgaagtcaaacagctaataactaatggagctgtatttgtaacccagcattctagctccaaagtcctgtgttcttaatcacagtgtcattctgccttgttagtattttgccattgattctgaatcttaagagtattggaaagggaactaaagtctgaattttattttaggttaaaaagacaaccctttgtccataagaatgaactctattctaaattcataacaagtgcctattatagttcctcaaaaaataatccctacatatcttcattttttgttgaaatcaataaaatttgaaatgaccagaggagagaaggtgtaaatgctaactattggctgttcattatttagggttttgtaattattttcttaaggcaggattacttagtctcagcctcagccactgaacactctgcaagcaagtaacacctatttgccacctggtgacaaaagacttggccaatgataagatctccctggttgcttaatggacctcatacctttattcagaaaaagaaattaaaaacacagcaaaagtaaaaatgctaagcaaaatccagttttaaattattttgtttattcacaagatacatacagaattctttatttttcttgaaaaatatttaaaatgtaaagaatatgaaaacattttaaaaatgaattttaaagtactttattgattcaataaatttctaacatttaaaaaaattcctatgtatcaagcatatcactaaaatgaaattagtttgcttaaattgctatctgtattgcatagtaataaaagctgaataaatgtaactacttacaaataaagcaatttgatcttaatcacaatgagacatggcttgaatttctgattgccctacagcagtgatgcttaaagtgtggtcctggaactagcagctttagcttccacaaagcacttgttagaatgcaaattattgggcctctcctaagtctcttttttctaaattatttattcttaagactggtcaagtgcagtaacgagaagggaggaaagagttgaacaaggagttcaatctataactgaacaatcaattgagataactcactaccttcagaccagtctcctcagtcttacggaatccaaaactcttggggtgggcccaggaatctgttttaacaagccctctagttgattctgatgcatgctccaatttgagaaaataccctacagtttctgtttaatttaactttaagtcaaactctttgttaagaattacagagccacacattgttaagccatgagtctttttctttagatgttattttattgaatttaatatataataaaatgtaaactaaaagagtctgcaaatcagtgttcataacaaaaagaatccagttcaatttatattagaaagggaatcagcataggtctagatattttaatgttgtgtgggttttattctgcaaactaataggaagatgactgatattttaaaagcctgacttttatgctactcttaacactatactgaaatgtcgtcatttgctgtggattattaaggtctaccaggtccagaaggtcctccaggtctccctggaaatggaggtattaaaggagagaagggaaatccaggccaacctgggctacctggcttgcctggtttgaaaggagatcaaggaccaccaggactccaggtaggaaatggaagtagatatctgatgagagaagaatgtgggtgtttgtattcaaaatgtgaattctaagctgcatcattttaattaacactcactagacaaggttctatgtgtggctcactggcgaattaaaaagacagtagaaggcaagtttcctatagtctcctaaagggactttgttgtattatagtcagagttcctgaaaagatacttcacctggagtctttggtatgcatatttggatttgagtagccttcatttcagtgaaagcaaatttatgcaaaggagacatgcatattagagcattgcatatagatgaatccacccatagagaagtaattatggtgaatagaggcatcttttaggctttgaaattagataaagttagggtcaaatgtcagctcccctgcacacttctgctttgtatctatgaggaaaacagacactgggtttctgtcttcacctataaaaagagaataataacatatccactcatgtgctttctatgttggtttgagtgacccagagcagagagtcacattcctctttatgggttctcaaaactgcctccattcggtcaagatgattgctggtggatttggcagtcaacacaatctggactgtcttttaattctgaagactgctttatggcagaaaaaaagtatttaaagtagtgatccttaaagcttttcaaaatctaatctttttccccatgccatcactattcttccagttacctagacttaaaaatttacttctgtttactcattctctactcactccctataaatatgcatatttccagaaacaattaagagtaagtttcacctgctatacccctttaccactaaatattttaatgcagatttcttaagattaaaaatattctcatgttttattataagatgacaataaaaagctatgggattgtttatattttataaaattcttaccaaatgtcttggctgcagcctgtaatcctagcaacttgagaggctggggcaggagggttgcttgaggccaggaatttgagacgagcctggacaacatagcaagaccctgtctctaaattttttttaattatataaccacagtacacttattaacttcagaaaatttaacatagatatacattaatttctatctttcatattccagttgggtccaatgacctaataatgttcttagcatttcttcttccagtacaggatccaggccaagtcatgttttgcatttaattgtcatatctctttagccttctttaatctgaaacagttcctaagtttattttctttttttcatgacctcgacatttttaagaaattgtaccaccacccccatttttaaatagaatattccttttttgcctgatgtttattcataattagattcaggttatgcatccccagctggaatactacatgagtggttctgtgtccttctcaggctaaccgataaggaggtccatgatgtctatctgcttctcatttgtggttttagttttaatcatccagtcaagttgttgctcagtttctccactgcatcattaggtttttccttgcaactaataaaactgtaggaaggcacattaagatagtgcaaatataccaatactcatcaaaaatttcccttagatttaacatctattaatgattttgcctcaaccagtctctagtgggatagtggcaaaatgatgttgtttcaactctagcactacctccacatatactagtcagtcctactgtaagcaagagccctcccttctctctggtttacctatgcatttcttatcatttttgactcattttttctcatgttttccactaatttacaatttctaaactatcattacttatttcgatgctctcattgttccagatttggaagccccttcaagctggatttgatgtttttctgatatgtacttccctccaactatttttttagcactttttaatattatttcataataagatgctccaggcttgttcctctttcattcttactaacataagcttcgttgtcctgcacttgaagtagagcaatagcctcctatatgatcttgctattctatattcttcctgtagttgggtggctgaggggggatgattgtttgagcctaggagtttgaggccagcctgggcatcatagtgagatcctatctctatagaaaagaaagaaaaaacaaagaataaaataatagttacctttcattaagtacacaccacacaccagtcttctaagcacttaatattgtcagcaaaagacaatgagatctagaggagaaaaaggaagagctttattttctgtaaaaagtaatctgcggattgggaaggcacagctttctgtacaagcgaaagtgtgatctctgaagaacaaagggagggtttggcttaagtagggaaagttctcacccatgttctcaaccaggtccatttatgcaaatgaaggattcagacttatcagttctgattgattgaaatacttgagccctgatcaggtgatttccaaaaccaaagccagaagtctgccagatgtttctttcaaatggccaatgggcagggggtgtgttcaagccacagtttatcttcgcagtggtttgacttgattgtacaaagggagatcctgtgacacttttacaacatctttccaagaacacaaggtatgtgacatttcccttacccaaccacggccagttggttgtgttttaactttgcgcacctcagttagccatgggaagttcattttgtctgtcagccaggggtatattttaacaatatgaactgtctcatttaattctcaccacaaccctatgaagtaaatactgttattttctccaaatttgaggtgagaaaactatgaatcaaggaggttaaataatcaactcaattcacacaagataatataaggcaaaattgagattacagtcttggaagtttgactctagaaatagtgctatatgccactatgtaattcttatgccctcaatcaccttcctcccctcgctgcaatttttttgtaacattaatgattttatttattcagggtaatcctggccggccgggtctcaatggaatgaaaggagatcctggtctccctggtgttccaggattcccaggtatttgaagggatttttgtggtttccctttatattaaactcctctgggacaagatagccattttctgatttgactgggtaaaggttgtagccctgttgctttgccataaaactgtatgtaccttctgtgcaggcatgaaaggacccagtggagtacctggatcagctggccctgagggggaaccgggacttattggtcctccaggtaagacttattcctgaagatagttatacctgatacttagatgctttaaagaatttgaaagttttcattctgtctttcagccagaccatcggaggctaagtccccaacaactgaggcaaaataaacaaggctctgcctttatttactaatctcttaaattctctattttagtaacataatattgatagcagaccttttaaagttaagataaatgcaggatcaacaaaaatgcttccttgacattagcttctatactaacttccccaaattcaattgaacagatcacaagagcaagtcacatatgaattttttataatattttcgatattaaaatagttctttttcctaagaggcttatagaggtttcttataaattgagaaataaggaatctgctaaattcccctactagatcaaagggtccctggacaagcacagcaagcaaaaactgcaaatgatgttggagtcagaatggatgtgtaagggaataaaattgtcttcccctgacaccagtgttcacagatttgaacacagatggatgagactttgtagtaactgagtaagattcaaggtttgaaaatagagatgatatgcttaatttttacactgaccctaagaaacttatttttcaattgaaaattatttttcaattttaagttttcctaaacagatttctgttagatatggcagcaattcaaaaactggtttctctcacaccaatttttgtcctgaacttaggtcactttggcttccatttcttgtaacctttctctttcccttcaaatttgtgtgttttgtctcataggtcctcctggattacctggtccttcaggacagagtatcataattaaaggagatgctggtcctccaggaatccctggccagcctgggctaaagggtctaccaggaccccaaggacctcaaggcttaccaggtaccaatgcagatcatctttattatcattattatacttttaatttctgggatacatgtgcagaatgtacaggtttgttacataggtatacacttgccatggtggtttgctgcacctatcaacccatcatctacgttagatatttctcctaatgctatccctcctctagcccccctaccccttgacaggccctggtgtgtgatgggcccctccctgtgtccatgtgttctcattgttcaactcccacttatgagtgaaaacatgtggtgtttggttttctgttcctgtattagtttgctgagaatgatggttttgtccatgcaaaggacatgaactcatcaattttcatggctgcatagtattccatggtgtatatgtgccacattttctttatccagcctatcattaataggcatttggattggttccaagtctttgctattgtgaacagtgctgcaataaacatacgtgggcatgtgtctttatagtagaataatttataatcctttgggtatataccaaaatgggatggttgggtcaaatggtatttctagttctagatccttgaggaatcgccacactgtcttccacaatggttgaactaatttacactcccacaaacagtggaaaagcattcctatttctccacatcctctccagcatctgttgtttcctgactttttaatgatcaccattctaactggtgtgagataatatctcactgtggctttgatttgcatttctctagtgaccacagatgatgagcttttttcatatgtttgttggcctcataaatgtctttttttgagaagtgtctgttcatatcctttgcccactttttgatgggattgtggttgtttttttcttgtaaatttgtttaagttccttgtagattctggatattagccctttgtcagatggatagattgccaaaattttctcccattctgtaggttgcctgttcaaactgatgatagtttcttttgctgtgcagaagctccttagtttaattagatcccatttgtcaattttggcttttgttgccattgcttttggtgttttagtcatgaagtatttgtccatgcctatgtcctgaatggtattgcctaggttttcttctaggatttttatggttttaggtcttacatttaagtctttaacttatcttgagttaatttttgtataaggtgtaaggaaggggtccagtttcagttttccatgtatggctagccagttttcccaacaccatttgaatatgaaatcctttccccattgcttgtttttgtcaggtttgccaaatatcagatggttgtagatgggtggcattatttctgaggcctctgttctgttccattggtctatatatctgtttcggtaccagtaccatgctgttttggttactgtagccttgtagtatagtttgaagtcaggtagcgtgatgcctccagctttattctttttgcttatgattgtcttgtttatatgggctctttttttaattccatatgaaatttaaagtagtttttttctaattctgtaaagaaagtcaatagtagcttgatggggatagcattgaatctataaattactttgggaagtatggccattttcatgatattgattcttcctaaccatgagcatggaatatttttccatttgtttgtgccctctcttacttccttgagcagtggtttatagttttgcctgaagaggtcctccacatcccttgtaaattgtattcctaggtattttattctctttgtagcaattgtgaatgggagttcactcatgatttggctctctgtttgtctattattggtgtataggaatgcttgtgatttttgcacattgattttgtatcctgagactttgctgaagtcacttatcagcttgagattttgggctgagacaatgaggttttctaaatatagaatcatgtaatctgcaaacagagacaacttggcttactcttttcctaattgaatacccattatttcttcattttgcctgattgccctggccagaacttccaatactatgttgaataggagtgaactcaggattaagaaactcactcaaaaccgcacaactacatggaaactgtaccacatgctcctgaatgactactgggtaaataacgaaattaaggcagaagtaaataagttctttgaaaccaatgagaacaaagacacaatgtaccagaatctctgggacacagctaaagcggtgtttagagggaaacttatagcactaaatgcccacaggagaaagcaggaaagatctaaaatcaatacccttatatcaaaattaaaagaactagagaagcaagaacaaacaaattaaaaaactagcagaaggcaagaaataactaagatcatagcagaagtgaaggagatagagacacaaaaacccttcaaaaaatcaatgaatccaggagctggttttttgaaaagatcaacaaaattgatagcaagactaataaagaaaaaaagagagactcaaatagacacaataaaaaatgataaaggggatatcaccaccgatcccacagaaatacaaactaccatcagagaatactataaacacctctacccaaataaactagaaaatctagaagaaatggataaattcctggacacgtaccccctctcaagactaaaccaggaagaagtcgaatccttgaataggccaataaaaagttctgaaattgaggcagtaattaatagcctaccacccaaaaaaagtccaggaccagacggcttcacagccaaattctgccagaggtacaaagtagagctgataccattccttctgaaactattccaaatgatagaaaaagagggactcctccctaactaatttcatgaggtcagcgtcatcctgataccaaaacctggcagagacacaacaaaaaaagaaaatttcagtccaacgtccctgatgaacatcaatgcgaaaatcctcaaggaaatactggcaaaccaaatccagcagcacatcaaaaagcttatccaccacgattaagtcggcttcattgctgggatgcaaagctggttcaacatacacaaattaatagacgtaacccatcacatgaacataaccaataacaaaaaacacatgattatctcaatagatgcagaaaaggccttcaacaaaattcaacagcccttcatgctaaaaactctcaataaagtaggtattgatggaacatatctcaaaataataagagctatttatgacaaacccacagccaatatcatactgaatgggcaaaagctggaagcattccctttgaaaacggcacaagacaaggatgccctctctcaccactcctatgcagatcattcttttaaggcttattcattggagaacatttccctagttctccttttacatgtcagaggttgtctctgacaataggagtctaagcaactagtagaataccagaccaccacaagttccattttcttttttcttgaaagtgttaatttcccatggttgaatttctcttagactatgtcaggttactgttagcccctctggctgttccaatttgaacaactaattaatgttagaaaaatttataatgaaatgaaaatgcatttaagatctggtgctttctgtacatcatccagcagaaagattgaaggctgatttggtgggctatcagtttcccactgtgaagccccttgtcttttaaactaactggtgtctagctggccatttgactctacgtttatagccaactttcattaatcattataaaagaaaactagaactaacttcagtcttttgctcttattaagtgatcaagtgacagtcttatcaaaaacaaagtatacctggcagtaacttatggtggaatagaaaacgaaagttgggacttacattcttgtctgattctgaagacaaagagagcacaactccattaaaagcatcccagaagcaaatggattgtttaaaactaaagctaaatccttgttggcttctttggtcctggacttgagttatctcttcttttttctggatttaagacaaaaccaaattgtgaattcagtgtctcgagaaccttatgtctcctagatctgtccagatgtgaaaatattctactcatatttgaatgcctcattcttttcctgtaggtccaactggccctccaggagatcctggacgcaatggactccctggctttgatggtgcaggagggcgcaaaggagacccaggtctgccaggacagccaggtaagacaagtaaaacatgctgttggtggagggaaagtctttgagtctgagagacctctggacatagggcctccacttagagctgtgagatcttctcttgatgttagcatagctgactggtgaatgtggacctgaggaaaataggaaagcacataataaggagatttgtcactatcagagaagcatacaagattgcttttatttgtgtttagagcagtggaaaactcagttaaattttccaagcactcactgtacttacttgttcagcaaattttcaatatgttgatttaaatcccttgaccatattgaaactattgtgaatatttccacatttgaaaatatcgcagtaggctgtaatttctttcataaagagcagcaaatataaatgaacagtttaagtgattgccatagacctttaagagtcatggtgaagtttcatattgagatgataaattgatattaggagcattaataggtgctcctgataatattgagtctggtatctgttagattttcaatttgtactcaacctacttccaaaaagaatttgagtcaacttgaaataaaaaatactttaacgttaaggtttctaaaatagaaatagaggatcatacattatatatgttaacaactctagattatataaatatgactaataaataaacataaagagtttgtatttcaaatatcagtggcaacacagcagagtggtaatacctatagccttcctagagtcaatgccctgacatttcattaatgctatatttctagggaaataacaagttagtgtcatcttcatcacaagtgtttctgtgaagtttccctaaaatgaaaatttatacacagactgtccaaaggcctgtatatacagaaaattattaaatgaactcaaaccaagaggctaaatcaggaagggaagccagtggtggattgaaaatgggcattttgaaaatacttctttagaatgccctgcctgttctctacacaaaaaggtatgcctgagaataattcccccagacggattcaaaggaaaatgtttttcagcaatgaagctggcagattgatggcaaccacacccttcctttctcattgatgaacaaaacagcaggctgaaaattgaccatggggttcagattcttttagtacaacaagagactaaataacatacagactctccaaataagcatattttatttgtctcctagcccatgatatctgacaatgcctttatagacactctataaatatcaaataaattaactagtcaaatgaggtcataatgttttgtcaatatccataagagtggatcagagcttacttaatcttgtatactgattatttcgtggaaataggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttgggtgagataatcaatatctaatttcctactgtgccttttgtttttgtttcagaaatcctgttgggttctagagtagccttggccaaagtgcctctctctattcttttggggcttccgaattgaaaaccatgtcaaaggcaactgaatatattcactatgatttttaaataaataatatttaaccttaaactaaaagcattaattagctcttgtgaggtacaattcttggcctaaagcagatcatttcaaaaaggccacatttacttttagttagattagttattaagggaacagtttccctgggctctttgcagtatagcagctgcttgagtgtgcagtgtttataattcctgggagatacttacctcatctttgaaactggtcttcatcaagttcataagttctgaagagaatcttggttcatagatcaaagaaagtaaggtcattgcttaattatgctagtttgtagttcctaaaataagtgccttagctttataaagtattgctggagtcatttaaagctatataaagtatgacatttctgtacaaaatccagttcatttaaggtgttcccatgtatcttctctatactggggtggacagctaggttgatgggatgaggggactaaatcactctcaaggactcttccatccccatgaattcttttcctggaattctgactttggatgttgaagtcccattgtcttacctggggctgcattttgttgttgttgttgttgttgtgttgtttttttttttgatacggagcctcgctctgtcgcccaggctggagtgcaatggcgtggtctcagctcactgctacctctgcctcccaggttcaagcaattcttctgcctcagcctccgaagtagctgggaattacaggcgcccgccagcatgcctggctaatttttgtatttttagtagagacggggtttcaccatgttggccaggctggtctcgaaatgttgacctcgtgatctgcccacctctgcctcccaaagtgttgggattacaggcgtgagccaccgcacctggcagggctgcctattttaagactgactatcccctttgcctccataaagacatttaagaagatagtctgggctcccagtttctgggatctctatgatgagaagcttcctgagatctcattgtctgggccattcattctgtggaaatgtttctgcagcagcagagaccccggaggtcagctttactccctatttttccaaggcatatggccacaccagttctggcccaccagggtaaggatattcacttacatgtaagtcagtggtcataggccattttatgaaaccaaataatgtaagggtttgcccaatagctttcttttccatcttctttttttcttccgtttatatttcctttttctccttttcaactttcctctgctacttttctttctccttttcacttggttacatctttttaaattttataattgaccaatcttcattaaattagtaattaaattatctttccataatttaatcgaataataaatatctaaataattaatttaatttaatatcttcaggtaattttctctagtctttctcctataaatttcttttttgttcattctctctacactgtcagacttataatcaaactttaaacttcaaatccctaacctaccaggtcaacagaggaaccattataagttttgagcactacgaattcaaaaatgtaatgcagttagaagatggaatctgctatcagcatgtaattataacttttcagaatccatgtattttctctaataagaacaatcagatttggaatctataaactggccctgactctggtacagtttaggcctcagacacaggaaggccatgacggagcccaagatcctaggaatggtcctggattgcagaggctctgctggggctcacacaaggatcacattggaagtatcttgatgactaagcaaagatacaggcagctgtcactttgatgttaaagaaacaattacctcctgatcgaataaatgcagtctgtgttgaattagtggaaggattataggatgtaagaaagaagacagagaagatggattaaatactaaagcttttctgtctgggagaaaagaaaaacatactgagaaccattagtctattaaagtcttataactatggggtatagagggcattgggagtatatgggatcactctctcttcgaaaatttggagactataacccagaattctgcatcattgtgggcagccacaggtgcaaccagatactccagatacttccatcattatgggccttccttttatttacctttcttttccttacgagactggatattttcagctctgtcccaaattaggcagtagaataggtttttttaaattactttataatgtacaaagcactttcatgtccattgtctaatttaatttacacaactatgattaagaaaaatgtatataaatattctgctttttcattttatacacaaagagactggctaataggttaaataacttacagttagaaagtgatggaggtaacacctgccaattctaaatccatttctttttaaattttcccatgttgttcactcttacatgactgtgagtcagtcaggtttttcttaacgagtttttgaaagggataaattagactaaatcaatgattttcaacctagggaattttttaagactcctagtcttatgccaaatccattgtataaaaattccaaataattctgataatacaggtttaagatctattggtcttttatcagtcatcttcagtctgagataagcatacccctttgaatatatgaagaatttccatgatgcacagaggcattattttttaaaaatcaaatttcaactcctcgacttttatatgtattttctcctaaagtcaatctgactttagcagatgtgctttgggcaatctcctttcccatgtctcctttgtctcctttcactgtcatgcattccccactttgtaagagtcatactcttgcacattgccttgaagtatgaaaacctctgacagacaaattcaaagggataattcaaaataacagctttgctaaagatacaattaccgttagatccagcaatcccattactggatatttacccaaaggaaaatagtatatcaaagagatagttacactgacatgtttattgtagcactattcacaatagcaaagatatggaatcaacctaagtatccaacaaaggatgaatggataaagaagatgtggtatatatacacaatggaatattattcagccatataaaaaatgaaatcatgtcatttgcagcaacatggttggaactggaagtcattatcttaagtgaaataagccaggcacaaaaaaaacaagtatcacatgttctcacgtatatatgggagctaaaaatttgaacacatggaggcagagagtggaaagacaggtagcagagacttggaagggtaagtgtggggaatggggaggatgaagagaagtgggttaagggatacaaacatacagtaagatagaaggaattaattccatatttgatagcagaagagaatgactatacttaaaaaatatattgtacatgagtgatggacaccctaaataccctgacttgatcactatggattatatacataaaaaaaatgttcatgtgccccataattttgcacaaataaaaaattaatggttttgttaaagtctccattaactcaagctctgtaattcacttttaatccaaccttctaagaaatacgtttctaataaaagtttttttgtaataattatataaaaatttataatacatatatttttatcagttgtgaattaataataacaatgacaggtcaaaataaaacatttaacacgtaaagtcttatagtcacaaagttttaaaaaggtatattcaatattaatttttgagaaatatgatagcatgatcaataaaaaactttcaaaaataaaaatatgttacattaggaaaaaactgtgtgagaaaagtggaatggaaatataatttttaaatgtagaaggaacaatgtataatttccaactgctaaagacaagtttatatattttctataatggttaatgttagatctcagatcattatattggatgcatttaaaagagtgatataaaagtttgttcttagatatcaatattcacaaaacaccataaatgaaaactggcaaggtagaaatgtggtttgcaaattcccagtccctgctattacaaagtggaataccgaagggtgggtgtggagctgagagacaatagctaaaatcttaatactggcacagtatcaatttaaacttacgatgaaatttagatatcaaaactttagatatgttaactttcaaaagtgtaagagagtgcatttttcatcattcttttgtgagtaaatgagaaaagaaaggcttgatcacaagtaaagataacctctcttgtccctactagctctgaatttcaaagattagtttctttctttttttggtttgtttgttttcccctcacatctttccttcctgtcttatttttttcctttttacgtattcttcaaacctgactgtggtggctgtgcacactggccagcattactattgtccctaggcctaagaagattgcagattcacacaagatacatactgaggaagtcttagaagaagagagggcagcctggagcacgaaatattgataagatatcgtaaggactcagtatgtgtccttcacttgtacacaatgaattactaaatatcctccataagacaccattgtttataagatgcatcactagtttaaaaacagcattagggaatatataatgagctaccacaataaatattaacatactttattaaacacatcctaattttataaatgttaaaatatgagtaaatcttagacttaagaaatatagtatatttattacctatgaaaggctggcaagtttccttgaaaggctgtttgctattgttttagaagaaaccaaagtatcattatcacgcagtcctttactgttttctctccaaatctttctagggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcggtaaggcattgatttagctgtgacttttaccaatccccagttagttagctagtcagatttgagtccaaagctaacaatctgatgatattcctcctaggttaggtagaacagaggtacctcttaatattcaattaagtatttagtttgactcatatttattgggggtctgcttttgaccaggcccccatgatagacatagtgtaatagccagataatgcacagtgtagtaattatttattacataaatttgtctaatatatatcagatttgggctaagttctataatagatataataaaaatgttatgaaaacatagggaaagagatgtttagtttcaactggagaaatgtgggatggccatatggaaaaaatatgtcttgaactggtcagtccttgaatgactagaaggacttgaggcacaggcagttataaaggggaaatatacactaggcagataaatgacaatgggtaataaaacaatgtgtctaggatgtagtatgtaaaggttatgttgggagaaaagattgtaaagttagcttgggcccagatggtagaaggccttctgtaccaaattgtagtttaaagtttatttgatatgtaacaaggagccctgaaatattttagagctacacttcaggttagattatagtgccatcaatgtgtaacatggattacaaaagggatagtctcgaggtagagagaccagttggattgaagggtattgctatagccctgatgtgagtaaattggaactcacagtggggtacatgtatcacattattaggctagataggatttgacagttgattagctatgggaagaaggtggtagctgagatttggagcatgagtaactaagaggagggtgataccattaatagaaatctcttagagttttgccattttgaaacctagtttaactcaatctcttaggaatgttggttattgccgtttttattctgatcatgacccaggatttcaataaccataaaggatgaattgctggaaattctcgttcctttgatagtaaatataaagattaaagctggttcagccttagtagcaaattcatggtgccctttttaatacattttcctgaatcctttgggaatttgggtgtatgtgtgtgtgtgtgtgtgtgtgtgtgtgtacaattttgtcagtcccaactcttgggagtaaaagcttgtctaaatgtattaactattttgttaggtaaactgcaaaactggcctcagtaatatgtcaagaggtccactcatgttttttattaaagatatggaagtctcagctatattcattctgttgctatcttacttgattttatagatttcagccacatctccaagtgcctgggtacctgcccagcattctggatatggtgtacttctccagatatagtcaaatgtttataaatgtcctttggaccaagaataatgagtagagattgagaaagcgtccgtttcttatattttccagtctttctgacattgttcttaccacagtttcagcattactaaatgtctcccctccaattgagtactttgacaacaagtagtatgtgcaatacaccaaaccaaactcttacggcaattgaggcattgactatagcaagtatgaatagacatttagggcataatggaatattaaaaggccattgcactggttctgcagttttttgaaaaaagtttacagtttattatgtatactgggagacaatacttagcaaatgcaatcctcaaagtgcattttttcaccttttgtgatcattgaaagagacattaatcggcttccatactaagaaggcttccaatgaagcaggatggctacttctcacatgctcactctgtagattatgttccttctccttttcctttaccagatgtgcagtatgtgaagctccagctgtggtgatcgcagttcacagtcagacgatccagattccccattgtcctcagggatgggattctctgtggattggttattccttcatgatggtattttacactcttccttgcatttgtcatcatagctgactgtccattccatctacatttcttcccaatatgaggaatccctgtcatttgcataataagaagcttaaacttcaaacagcttctatccaagcactgtgttccccctcacacattttttgtaacatattttcataatctgcctattacttttttttgactacccttggtgtggatactattgtcttacctctgggcctgttccttcactagatttgaatttggccaagctcagcacacatctttggatattcactaagctattatggcacatgggtattgcggcacatttttccttgtcttttatagcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcaggtaaagtgcttatagctttaattcaggtccaaagcttccttcagagatgctagggaagaaagagacaatttatggatggtttatcctcaacaaatgttaggaatttattggattgtgtactttattcttgcttgttcttctcatatacatgactcaggtcagaaaaacagacttgattattaatattaggtgagtttggtttgtgatagcttagtagtaatccttcaataatgaaacagagataaagaaaggttatgtgaccttcctaataagtcagcagctgttcaactagattgagaccaccccaggaattgaagttacagtctgtcttttccctctcagtccagtggtctcctttcccaggatattttaaagattctcatttaagggtttgaatgagcaagacatacgtaatgtatgtacctcaggatacttcattctgttgatttttttcagtttaaatttatttttatgtgttgcttttgggttatcactacttggtatttttcttatggtccttgttatctatcataacatcatcagttgcccagatttccctcatcctgtgaatattagaaaaatgtatgagagaaagagaaaaagatagaaaatgagagggaaacacaaatatacaaagataatagtggtggggagaatcgttacaaaatatctatgaccactaatggctcttaaaccatactagtcactgcattagatcatattgctgaaaagtaaaccattaagtcaccaagagagctacttaacacacaaaaaatgtttagttataaatttgaaccagtaacagaattgaaataccagaaaatgtggatctgattgtcttatttcttatttcccagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggatggtctgttgtgtatctcttcagcctgtgtggaaaaaacccctgctcatttacagatagattaccaatctgcacatcaacaagtcatctcttcccagggaatcagtttctccacgctttgatcactctgttagtagatagaaaacatatagtaatgtaaactttttccaatgaagaaaactacctattggaagacatttccaagataataaatttcttgacaacattgtgttaatggctaagaaaggaaacaactggcttctatttggggaagaattcattaataatgtttaaagcaggttagtgacctaatattcttaatgattaagaatgaacacgcatagttctctaaaatagtcaaggactggttaaaaataaaatattaaaaacttccatagtaaaatttgtgttacagctaaaagataaaacaaccaaaacaattttgagtattctaaatcctaatatggacctatgtaaaatctaaagcttagaatctctggtggtaaaacttaggatccaaacaatgataactatctaattattttattgattctggatagccaccaatcgcaaattttagctctattttttcatttagtcccatgcataaagtcagtaatgagtaattgtaactgaaaacaccatatcacagccccacagattcttctacatggtgtacactcaaaggtgccccttctgttatagtcgcaaacactaattccagagattttgctttttgtagctttccctctcatttatagctggttgaaagccttggcccaaaaagaacctcctttgtttgtttgtttgttttgttttgttttgttttgttttg

SEQ ID NO: 13359 - DNA, 32573 bp, Human
  misc_feature (1)...(32573): n = A,T,C or G
ttttgttatgtttccatttagactttgttctatgtactttttacatagttgaacctgttgcacttacaattacgtgtcttgagtcttttacttactactttttgagtttgtttctctttttttgggaaactatgcataacacatttttaactttttacttatacatatatttacagaaactgcataaaacataactgtataatttgatgaatttccacaaacagaatatatctatgtaagtggcaatcagatcaagaccattacccccaaaagcccctctcttgctcctgttgtattctagcaaccattaagtaaccattcttctgacttctgacatcaaagattagttttgccagctttctaaacatattttgataactacatgaaattctatcatttgtatatgctgtaattcacttattcatatgttatgagatacttacgattttcctaagttttctctattacaaataaaactataggaaacatctattttatatattactacagaagctttcccaggagtaatgttcctcagtggaatggcataaacatttctgaagcatttcatgtatattgacaatttactttccaaagtagttaaaatagttaatactgtcaccagtggtttatgtctcttgtttaacgaccccataataagtgttgagtattgatttcatttaagctttactaaactgataggtaagaagtggtatggaaaataaaatttgaaactccctttacttgttgccttatccagtataaaacacatagtatagtgaatatattaatgtttgcatctcaatatctttttaaacaatgggctctatatgtttacgctgtatgactctgacaagttttagtaattcaggtaaacagtttacggctttgtgaggtgggattttgatcaagcgactttatttctctgagcctcagtttctacatctggaaaatgatgacgctgaacccagcaacctagtataaaagtctatgctagttatccggaatatgcagctctaatgttggagcagtttataaactagcacagaagtagattattgaagaggccatttagctcaccttatgggttctgggatgaattgtgtgcatattagttaaatgcaaggactttgaaacaggctgcataggttccaatcaatgctggctcttctgtgcctcagtttcctaatctgtaaaataaggataataatagtacctacctcttaggggtattgtaaagattaaaattgctactctctgtgatgtctttatagccttctatgttactggcacatagaaacgctgcaaattggagataatgccttagctgaattagccagagaagaacattttaggcagaaggaagagcaagagcaaattcagaaaactttgacatatgtgcagccaactgtaggtaatccagtatttctagtgcacaaaatgcataaagaggacaaagacagagatgggtctgagggggaaacagagaccagttcatgaaggccttgaatgcctgtttgtcttattcatcacttttttctctattacccaacataatgtcggtcataaannnnnnnnnnnnnnnnnnnnaaactgatatttaataaaagcactttgaatgaaaaaattaattaggaggctgtagtatatcttccacatgatacagagtctttgaaaaattccatgaggagtgtgacatagtcatatttacattgatgtcattgtatggaagggattccggatagaatggagtagaaaaggagtaagactggtcagtaagaccagctaagaggctactgaggaaaaagactgaaactacaggactgatagtaattgtgaagaagaggggccaaagttataaaatatcaggtgcaggaagcagtaaaaggggaagaaatgaaatcagactaatacatcctctttcttttctgttcctttcttatgagtagctcctatttcccaccccctcttctaaatgtttttactctatgtttctttttctaggtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaagggtgagattttaatgtaagacataatatttatgataagtcatatgcctcctagttttttattttttgggggttaatctctgtaaagatgatattcactctataattttgtagttaaagactatactctgaaaaaagtggatttttttaacttctgtggtcaaaaagataagtgaattagaataaggtgctaaatttttgaaagaaaacaacacatgcacgttgtttaaaaggaattaggtgaggtaaagttgcatgaagaaaagaagacattagctttgccttcgaaaaatgttcaattaacattgttgggatagcgattggagaggaagatagtttagatgatgcccaaagaaagtgtaaatgtgataacgtggtacaaacatattcagtgcaacctggcattcattcactgaaaattatcttaactattatttcttctttctgagctgtaataaaattgtactgtttgaatactaaacttgtagatttataagtttgtattgcccatggaaggttgaacttacatttagtatagactattttagttatttaaaaattttgtacgatggtcataattctgttttccagaatatttgaatagccaggaatcctttgtgaccatattagataaaagaacaaaatagtaagcaagcatacaaatgctaagttatttttgccatatatgaacagccagatcttttcatgaattttagaaatatttcaatcaagtaccatatcttcagatagatacgagatgattgagatttgttgtttcttccattctttcctttagtgaggtctggaactaaatttgtgcattttggcacaagggaaacaacctgacttctcttaagaagtgaagtatctttatttaagttggttttgacatgtatgagcataaaaatagttgttataaaagtgtactgttatgagatgaatcaacatttttagtagtgttaaaagtaaatcattttaccttgattccagactcttgaatcttacattatttttctttatatatttagctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaagcttactggtaccatccaaaatgatatactaaaggaatttatggttcgaaatacatacatttttcctccagaaccatccatgaaaattattgctgacatatttgaatatacagcaaaggtatactttgtggttattataggtttttctatagttccttgaatgtaggaatttttacaacatgctataactgaatttaaaaatttagtctgagtaatataaatttagaatgttttgttattgttactttttgtttttaatgtactaattttatgttctgtcgttacttgcaggaatctgggcaacagatctttactgtgttttctttattcctaaaatttaactctgataattgttagattcagggaggtcttctacttacatttttaaatttccctccgaaattcagatgcagttgtgaagtagacactggtatcagacaaatggggattggaatatcagctttatttctgctaaaagctgaattggaagatatcacttatcactcatatctgcaacctcaaggaggtccctaatattcacccttgaattaggctcatctttcccaataagaatgatgggaaaaatccttccatagggacacattttcctccttcattttcctgtgagcaatttgtttatatttccccccattattcactctttgcttcttaccagcaacgtactccttctccttacctacgttaaagttagatcattatttcatggcacagagaaaatcgtcatcaaccctttttatctttatcaacccttgtaattactgttatctccaaactctagcaagcattgtgtagcaagcattttatgtttggttaactcttggtaaagatagtttttcttggctgtgcaggatatgtgtgatgtactctacctaacatgaaattttaggggaatagtggaaatacagtttttgtagtgattgtggtggaaagaacctgtctgggatatgcttagtattaaatgtcacagtaaatcaaactgaaatctttgatttttaaagccatgcattttatcccattttgtttcaacatatagtactaagaatcaaatcattttattttttttcctactgtgtacttattcatgtttgatgccttcattcaaactagaaaattaataactagtaaataataataaatttatacatcttaagcagattaacccaaggtttgggtctacaacctcttatgaggtccaagtcattggtttggaattaaaaatgcttcatttagttctcaggccaaaggttacattcctaacctcagctagctaattccacaatttaaactttcagaatggttagtataaattcttgtccaccagaaaaataaagtaggtacagtcctgatgatggttcatggacgaaccatttaaattggaaagcaaattaaatgtaacaaataagcattaaatattttgttaacattatgaactaccaagtttatttgaatttaacatcattttaaaataatgtttatgcttagaaagtggatttaataggaccttttaatatttttacttattcactgttacaatttttttttttatgtagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggtgagtaaattaaacctagatattgtttcaacattaagaaatgcataggaccattttatatattgataaaatgaatttataaatataaatgtcaggctagatttagattttcttatattttatctgagtgataatgagagaaaaagccaatatttctaataaaaaatagaattaaatttggctgtacttctttgtaaatttgaggaatatcttgtctccagctatttagagaacacaattaagttccacattttaacaaattacattaaaatgtaaacataatgttgagacagttttttctaatttttccattttagaatacagaattcatctattattatttttttttctgttgcactatctaatgtaatgttttgggatccactgtgctgttgaaacatttgtttcacaacagtttcttaataatgttgtatgaaaaatatgggaaaacttaaatgtagtttatgaaatatttaaatttggaagtcgaaagtcattcggtggttcaatcagtacagcaatcacttgctaagctttgctgtgccaaacactagcctatatgctgacaatacaacatgtagaaaacatagcttctgcctttagtgtttatagactactgaaatgctcctttgtaccagggatttgtgtacttactgtgacagcagttcccaaagtgtggtctaagaacagttgggcattgctaagactctttctggggtatttgagatcaaaactgtttttatgcttatgttagagctttatttgcctttttcactttcattttctcaagaatttatagtgatgtttttcagaagctacacgatatgtgatactgcaacagattgcagaaacagatatgagactccagctgttttctcttaagccatacattgaagagatttgcaaaaatgtaaaacaatgatgcttttattatatatatatatatttttttaagaagcatacttatttttcataagaaatgttactaatgttaacatgttgtgggtttattttgatttgatttgatgattattgagataggatcttgctctgttgcacatgctggagtgcaatggcatgatcactgctcattgcagcctcagcctgccaggcttaagggttcctcccacctcaggctcccaagtagctgtgactacaggtgtgtgccaccatacctggctaagttttaagttttcctgtagagatggggtttccctgtgttgcctagctggtatcaaactcctgggctcaagctatcctcctgccttggcctcctaaagtgctgagattctaggcagtagcctctgtgcccttccttattgttacttttgaatgaactagtaaataaaatattgatagatattatacaaataaagaaataaattctttggaattttcagtaagttttaagagtagaaagggaacctgagatcaaaatatttgaaaactgctgtgttaagaacttctttcaaggctgggtgtggtggctcatgcctgtaatcccagtgcttcgggtgaccgaggcggacagatcacatgaggccaggaattcaagaccagtctggccaacatggcgaaacccagtctctattaaaaatacaaaaattagctgggcatggtggtgcttgtctgtaattccagctacttgggagggtgaggcacaagaatcgcttgaacctgggaagtggaggttgcagtgacccgacattgcttcattgcactccagcctgtgcaatagaacaagactctgtctcaaaaaaagaacttccaaaaatgtgtcagaagtagatttgcaagctttgtgcctttagagacaggcaagtaacctaaatgtttaaatcagcacagaatataagataaaagggagaggtgaagggcacaaattggagaagtatatgcctagaccaatgcacaatcattcttttacaaaacacttttctggctaaacaaagcaaatttgctgttttatttcattcataggtgactcctgtcttacatattgagtattcctaaaatatacattttttaaataaattgaatctttatttaatgaagggcataggaagagattctttcattaagaaaaccaattacaaagtgaataattcttacctgaagcaaaatttcttccatatgcataaaactgtaattttatgttaggtttaaagttacataaatgtacgtgcactgatcttaattcaaattaagttcttcgaaattaaaatatagaccttgattttctagtgtgtgatacaattagttttattttctgctctatattgttaactttaattaaattctggacctaacgttactattttaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggtatgtatataatttaaaatgtagaattttaataaagttatatatatatattttttctgagcaatgtggcacaagcaggaaatagaattaagaagctatctgttaatatttgaaatgataaatattctgaagcataatgtatacttaggtttgtaattatacataatataataaataaataaataaaaattgtctccccctggtggttaacaatataaaatcacttacatcctagcttccctgtagtgctgaaacacttgtaaaagtaaacaaggctgggcgagttggctcacaccagtaattccaacattttgggaggccgaggcacccagcctggccaacctggcaaaaacctacctctactaaaaatacaaaattagttgggcgtggtggtgcatgcctataatcccagctacttgggaagctgacgtaggagaatcacttgaacctgggaatcggaggttgcagtgagccaggatgacgccactgcactccagcctgggcaacaagagcacaactacgtctaaaaaaaaaaaaaaaaaaaaccaaagaaagaaagaaaacagaatttgatgatgagaaggaagcaaaagtcataagttagtactctcatataattgtaagagttataattcttaacataaaactgcctatttaaaattaattatatatacatacatattttatgtgttaaagttatgtatttaagcaagcatgcaagcagactgtttaaagactatttttacttgggtaatttaatttgttctcttaaaaattgtatagttatggccttgtttttatacatgttctctttacatatgaaattattttggtacatttaaaaataatttatatgtgcaaagttacattgcttttatacatttaaatgttgaataataactattatactctgtatgaaataaaacttcaggttcttataaatggagaaatagacctggcacagtggctcacgcctgtaaatcccagcactttgggaggccaaggcgggcagatcacaaggtcaggagatcaagatcatcctggctaacatggtgaaaccccgtctctactaaaaatacaaaaaaattagccaggtgtgttggcaggcacctatagtcccagctactcaggaggctgaggcaagagattggagtgaacccgggaggcagagcttacagtgagccgagattgcgccactgcactccagcctgggcaacagagcgagactccgtctcaaaataaataaataaataaaataaaaataaataaataaatacatggagaaataagagatttttagggttggaaggaactttaataatcatttttattttaacctgcttattttttcagctaaagaaactgaagttcagagagatccaatgacttgcccaaatcacaattaggcatgcaataaactagaactcaaatttctgatatctcagttcattgttcatctattttattaacatttattcagtgcctgttttgtacacatcattgtggtagatactgtgaggtagacaaaataatcagcaaagagtgaattatgaaatgaaggactatataatcttaagtagaaaaagaatgcattgttgatatacttatagaaaagtatttaggcaatataaaagtaagcacaacaatatctgatatttcagaggattataagaggcactaaacactgaactctgactcttctaattttggcttctaaactaatttgtctgaatttatttgctattctgaagcttaatatggaaattgacatagaaaatatgcagcagttgctgtttaatcatgttgctgtttatagttgcaatatctatcacctgtttctttgagtttttgttttttatcaaatattttaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaaggtaagtttttccactttgcaactttgttttcagaatttacagatttgtaaagatttatagattttaaaacttacaagtcaagatttatagattttaaatttataaatcaaatcacttacagatttatataataatttaaacgatgtttgcaaaaaaaattcagatttgattttatagttttcaaaacaatccatttaaaaatacatttctattaaagtattttattaaaagaattaaaaagacagctagtattaaaaagctcatacaaagaacagcagtttttgatcatccacttgttttttcctgcttcctggagtaagatacatacttctttgcttatttttgtttttatctgcatagtttaaaatcacatgtatactatttcttgtaattttatcaactgtagacattacacatgagaccttagacactatctattgctttcctagtagggtagtttagattttggctgattcatacccctacttttcctcctcccttactaccaatataattatatctcaatgtaatcttttctgaattcttctaatgttctcatttgacttaaattgttttttctctatttctgctcactattgctgttctttgactcctctttgccattatagtaggaatatattttcatttctcctctgtttaattctgaatcttgaatcccatgtctatctcttggttatttggaagtacatctcatagaaacctgctaaaaatggtgcatgggagataaattatttgaaacttttcctgtttgggaatgtctttattctatttttataattgattaatagcctgactaagcttgacattatttccattcaggaaattcataagcaagtttataagcattgatctgttttttattctagatttttattctggctttcaatatttctgatcagaaatttgatgccattctcattcaggatctttctttctgaaagtattgggacctcttctttattttttgtattgatgtataacttggtgtattttttcctacatggtactgaacctttattgggtctttttcatctcacctttttttaaaaaatatttttatagctctaggaaattttcttgtattatttctttgacagtatttttcttgtcattttcatatgggttctctttctagaactcctagtcataagctacggacctccttaaataatatcctgatgtgctgatgttcttatcttttttttttttttttttaagacagagtcttactctgtcaccaggctggagtgcagtggcgtgatctcggcttactgcaacttttgactccctagttcaagcgattctcctgtctcagcctcccgagtagctgggattacaggcacacaccaccacacccggataatttttgtatttttaatggagacgggggttcaccgtgttggtcaggctggtctcaaactcctgacctcgtgatccactcaccttggcctcccaaagagctgggattacaggcatgagccactgctccctgcctgctcttatcttttctatagtatatctgtttgccttttttttctgtgttcttaaagatttgtcaactttatatttctacttatttttacattcatgtattatatttttgattcgtagagctcatttttgttttctaatttcccccttataattaatgtcatcttcatttgtttcattagtacagaatccatttatattctgaattcatgatattttctgaagttttcttttacatcctgtattgtctccattttctctctgtgctttttgtttttagtctttagtcagagtacaggcttttatttcagtaagacatcttacccttacttctgtctgtatttggtatttgatagttcattgtgtctcgagttcattttctgtagacagtaaactttggttctcctgacagaatgagagaggggtggttgcagactctcaaattgtcttcttctttttagcttctcattttacacttacgtagaatccaatatagattcttctttcttgaattcatcagggaaaagcaggttgaccttgatcctttctgctaagtcatatatcattccactgtctgttttctgccttcatatatgaagctatgattgaaggtttaaatgtttcctgatttcattaaagatgaggttacattgtttctctgcagctcaaatcaaaagtaaattgcattttaaaatatatttttcttacagactttatgtaattatgaaaactttatgtacctaaaaataaagattagagaattgatgttgctttaattttctcccaagacttaagaggttttgtgttttttggaatatacttgttagttgtcttttcaagtaactataaacacacaaattctaattaatgactttgatgtttatttaattctgttcttatgaaacattaacatttagtttataattttattaatattagtaattatataacactcataacaaatttatatagtttacacacatttttaatattctcttttagttttgttaatgtttttctttttagctcattaatgaaattgaagaaatgggtggaatggccaaagctgtagctgagggaatacctaaacttcgaattgaagaatgtgctgcccgaagacaagctagaatagattctggtaagatagtgagaaagttcatatatgaaatccagtagttaaaaagaaattcatttctgtttgaagataacatgtatagttaacaaaacaaaaataatgaaaaatggaacttgggtaaattttttctcatatacttgtatctatctatatatgtattttcacatacatggatgcacacaggcaagcatatttacaaagtgtgtgtggatgtctaaccattgtatatatgtacatgtttgtgggtagatgtcattaacattttgaagatgacactgttgatgatcacagtgttctctgcattggagtattcattcattcaatgaatacttctttagtttattttgtttgaggcacttgctatgtctgggcatacaactgtgaacaggacagacatgacctctatgacctctatgcacacaaatcttacattctagtaaaagagaggaaaatgaacaagtaaataaagaattatagatcatgataagtgctatgaaggaaatatgaaggagtataaccaggggtaggggttgtgggaagttttatataagagtaataatctggtagtttgaggtaaaatatattctttatcatgtaaggaagtatctttgtaattttgatttactaatagattatagaagggttctttttttgtttaaaagtgactggctgaattcaaaaaaatattagaaaagctactgggtattcattctctaccttataaatcttagatggcagctgctctgattgttatttcgaagtgttaaaagatttattagaaaccgtgggaaagtgtatattaatagtttggtagaataatgaaagtccttccttacagagactctgacatatacctctactttcctctcacacccccttctcagattgggatttgctgatctatattgaagttgcattaagaattaagaatactacttaaagatattaaatttataaggaaaatacatcataaccagagcattacaattaggtaattatttgtgaataaaatttttctttgggaaattaccaggttctgaagtaattgttggagtaaataagtaccagttggaaaaagaagacgctgtagaagttctggcaattgataatacttcagtgcgaaacaggcagattgaaaaacttaagaaggtattaatagcttgcttttttttttttttttaagtattttctgtgttctgggctctggctaagcttttaaactgtcctgcttaaattaatccttacaacagcatgaggtgtgtattaatttccatcatttcaaatgtaagggaactaaagataaggcattgagaaacttgctcaggataaatagacaaccaggactcagtcttagtctgttgacaccaaaaacttgttttaaaccatgatatctacctctgtgaaacttataagttgttattaaaaaccacactacaataataataccttccataatttatagattaaaaccaaggcttagatgattatgtaacttactaaaaattaaaaacagaataaagtttagagttattatttgaacccagggcttcttattgtaatttctttcaccagaatgatggcatctgatactactttgaaataattacttgctttttgatttttaaaattcaactatatttggtagtgctttagtaaggtacagtttacaataaactttatttattttgattgaaactagagtatcgtattcccttcttatttttagtttgtcactgagttgatccagagcatatgaaatactaaaatagataaatcaaattaattgtcactgttgtaacctatatatttttgttgtatgaagctactttggcctcttaatctttggcatttgtaagtactgctgtttccaaggtagggagcttatacatttaatggttttctttgtttacttttcctgagattgtttaatgtatggctttttttttagttcaatctataaaaatctaatagtatttatttttggaaaaccctttcttttctgttatactttaggttattaactttatatcttcatagcctgaaggatttcatttatcataaataatgataagccttattttgggcaacagagagaaattcattaatgacaatatagcaataatagttaacatttattgagcacttactgtgtacccatactgtactaaatccttttcttgaattgttgtttttgtgtattgttttatttaacaggtagttactatttttatttccatttacagatgagggaactaatgattggagagtctcatttagttgctcaagtttatagtataagtgacaaagctgggatttgaatgcaggctttttgactctagagccagtttaggagaaatggatattctgatgtaactttttcctagttttgaactttcttaggaccatgaccaaatcaaagttcttctattacaaaaattaattttcatagctagaatcagatatttttatagcaaaatatatttctgctgcaatactctgagctctctttagtaatgaactcaagtttatattttcttacgctttccttttacctatggttttaacaatattttacctgtggtggtaatttttttaaaaatgtgaactatctcaacagtaattttatattaaattatttttctgtaaccgtcagccctaattaattttagcatctgttttcactccctgaattttagtaatctgttgttgagataattatagcaaactacctaatctaaggatgactaattttctagtaaaccagaaaaggtgtacttcttaggtctttgctcaaatgtcaccttatctaagaagcttacagtgatccaatatctacaatagcaccctactaccttgtgccaaatcacttcgttatttactcgatttactttatttttctcttaaattgtatgtgtttattgtttctttctccaataaaagataaagaaaaatgggcatttttatggagaatttggagttgagttttttcttgctctaaatatagttggacctccatatctgtgggttccacatctatagatttaaccaataatgaattgaagatatttgagaaaaaaagaatggatatgtctgtactgaatatgtacagacttttttcttgttatttcctaaaccatacactataacaactatttatatagtatttacattgtattaggaattataagtaatctagagatgatttaaagtatacaagaaaatgtacataggttatatgcaaacactacatcattttatataagggccttgaacatccctgaattttgctatctgtggatagggtgggcagtgggtcatgaaaccaatcactcacagatactgagggatgactataaattttctgtacctctgcttatatatgctatataatactagtggcatcttgagcagtatattttagactcttttacaggtggtacaatttgtaaaaaaatggatttatgcaactttattttgacaaattattggcagagcagagttaggacccaggggaaaacttttttactgtgcttttcattgtatatctttttcttagtccctctttcgctctcgagattatttttaaataaaagtatagcaatatgcatattattatcaatacattgttatttatctaaaggaaacttaaaatataactaaaatattctctaagttttgattttttttcttgtcactattaatctttagtgttccttcaaaatacttcatatgaaagacccacttgtttacaatgtcttggtactttagaaaagcctaagtaacatgtgctacttgggaaggtcagcactattattgcccttcatgtttctgatttgttaggattataccaaatgtaatattattttaggaaatcctgagtgaatgaatgaattgaatgaataaaattcctaggttatatattattcttttcaattttttcctcttaaatttggagttaggattatggaaaaaaatgccatatgctatgcatcagggtctaatctcttgatctctgttttattctctcttcatgtaaattgtccctttccttgactttttccatagatcaaatccagcagggatcaagctttggctgaacgttgtcttgctgcactaaccgaatgtgctgctagcggagatggaaatatcctggctcttgcagtggatgcatctcgggcaaggtgaagatatataagtttggaggtttccaaagactaaaagttgaccagtttagcttttcagagtatacttaaataaaaggttgatcctgtaaaccatgtgagcccaaaagaaaataatggcatccatcgtaaatttaattcttatcattttaaaatttctgtatttaaaacattcatgttttgagtgaactgtattaataattgtgtattttactgtggctgaggaattttgaaactattgaaatgaatccatttcactgattcgcaggttgaaatgtgttggactctcaagtatatcaccaggtttatgcctattaccttggtattttaccagttaaaatggctgtggggtggggaggggaacattaatctgagaatttataggaaaaacttgtcatcccattgcttttgaattagttttaaccatgaagcaaccggaagagcaaccaacttccccacacccccctcccagtccttcccttgttattggagccatgtgttcctttaggagtagaatacttattaattgttactagtcttttatctccttttgacattttggtctactgcatttgattttctactgtaatataattgctcttactaagttcactagagacctcctctttgtctgatattgtgaataatttttagtccttatcttgaattctctacagtatttaacattattgaccacctcttccttcttgagacgttttgcctttgtaacccttaacatgctcctttgtctcctaacttttgtcatcctgcatttaaaaaaggctgagtgaaaaacagaatctaatctcatgttatatctgcttcagtgttcccatagacacgatatttggcaaggtaaagttttttgtacttactacctaataggatttttgtgagaagacattaaatcattaaaaatagttcctggaacagaatatggcacttaatgtgttaatttttattatttttctatttgttgttatttaaaaattatctcattatatgtatcatatataaataaatttattatattaagaaccagaaggagtctgaaatattacccttcttgcaagctaacaagttatcctgtatagtggggtgttggttgatgatatgagatccctggatcagaacctaatgacagtttgttactacaatattaatagccataacatcagcaggttttgggctagttcctttgatgcccaattgatgtgagtgatgtgaaaaggactgctagatgatacctcatgtacagtgcattgggttacattcaaggagaggaagcctgagcttagggattcggaatcttttgtaatgggtaataagcatgtcctccatttttctagaggaagacattattatattggacagaaagcaaacctactctttgctctggaggtagccaatatttctgtcttctaaggcgattcactatacagacatctttgaaaagatagtccagaataaagaggtgtcagtgctttgctccacaggatgtgcagaaaagcaagtgacccatggaaaattttctcccaatatatggcagtatcattaaatgattacttttgcttttaagtgtttatttcttaatataatgaagttttaaaaaaatatgttgctttaactggttaaggtatagtataacttgtatgtactgtttttttctactactaatttcattaaaaaaattagatgacttttattaaagtcctttgatggttgcccattccttttatattcaaacctaatcttccgatagtctgcaagatgtgctagatgtgactcttgcccatctctctgacctcatcttataccactttcctcactatgccgtgttcctaatgcccttctttctatttttagaacataaaacatattttcctacatctcagagcctttgcttttagtgcttcctttttcaaacactcttactgttttatgttcccttgggatccccctttttataatttatatcttagttcaaaagtcatatcttcacatcttcaataactttaaaatggttcttccagtacagcccattccatctttgcgtggtttagtgtctttgtagtacttattaccttatgaaattgtcttactagtttatttatttagttatttatcatctgcatcctctgactagatgttacagatgttaatgtctataagaacaagtactttttctttggtctcatttattactgtatcgctatagtagatatagagatatagtaatatctggcacatattaggcacacagctaatgttggatgagttagtgaacaaatggatggaatatgctaaaagatttacttcttatcaaaaaatatttatgggagtgttgctgtttatccatttgtgttaagtggtgaattattcagcaaccttcaggtacttgtctatatatataattattaggtcattcagtcatttcttggttgacaaatgttgaaaagagaattggatgcataaaggcatccagaataaatttttcttaagtaatttcagaagagatgctttcataatgcattaaaaaattcttattttacatttttacagtcatttacttatgtaataaaatgtttaattatattgaatattatggtaaacagatatctttatcacaaaataatgaagttaatggaaccaccatttcatgtttcagatgtacagtgggagaaatcacagatgccctgaaaaaggtatttggtgaacataaagcgaatgatcgaatggtgagtggagcatatcgccaggaatttggagaaagtaaagagataacatctgctatcaagaggtaatatgtaaggtttcttaggccagaatttcatcttttctgttagcacaatccccttgaatctactgggagcttaatttccttacatacaactgagaaaatttttgaattttataataataaatagtaaattaaatattaattatatagactatataacatataatagagtatataatttattcattacatataatatataattagaaatatatcatacatgatacatattatatatctatactatcattttaataggtacatgataatatttaataataaatatcaaatattgaaactaatattagttttcatataattaatactattttgaactttcaccatagtccccttcaggagtttctcatgtcaaacagatgtttaactaacaatgatattgcttcatatcctccaggtatttatatttcaatctgcttactatggtagagtttcatattttttgaagttgtttacatttttcattgcttgaataattataaaatcttaattttcataattgaaagtaaacatttagttggcatctatgcatacattacaatcagtatttattgaactgataataacttacatttatttccacagcatgacttggaaatatatattaatgtgatcatatttctcaagtgtaagaactagctttttgatgattggtctttccaacctctgtaacaagcttccaattaaaaactgaatttccatacttgtacactagataaatatcaaaacagccaaggtgaaagtcatcaaaatggaacttttttcttttaacaaagataagtgcttttttgtgttggaagtaaatttgtcagtggagcaagcaagcattttgatttatatagcatgataagaaaccatattgctgttaccttgggagagttcacacttatgaagggtagatgagatatggacaattcaaagcagccagtctatcacatatatgtataaatgaccatgaagtcactttttagtttatatttcaatctttctgcatgttgtactctgtaccctggctcacgaaggtgggaggttgtcattttttgtcttagttcaccgtgatgttctcagtgttatgtgcttacagtctgtgccatctttcagactttcctctaagggggaaatggctttaatggagctctcaatgtaaaatagatgcattaacaaaatatggacgagagtagggagatcatcacaaagaatagctaatggatgctgggcttaatacctaggtgatggggtgatctatgcagctgtttaccatggcacgtgtttaactatgtaacaagcctgcacattaacccctgaatgtaaaataaaaattggaaaaaaaaaacaacccaaaatacaagtaaacaaattaggtgcttttaaataaacttgaaagatttgctgtgaataaattagtttttatatcttccctttggaaaattagtatctaactactgatatatttttaaatgtttttcagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccaggtactaaaaactgttggggggaatttcaaaagtatttactagtcacttacatttagaaaatgtagtaaaatgatgacagacattgagcaaattaatacatctcctggtaactggtatgtagccactgacttggcaaatgcctttctctccattcctgcccataaggcccaccagaagcaatttgccttcagctggcaaggccagcaatatacctttactgtcctactgcaggggtttattaactctctggctttgtcataatcttattcggagagaccttgatcacttttcacttctgcaagatatcacactggtccattaattgatgacattatactgattaaatccagtgagcaagaagtagcaaacatactggacttattggtgagacagttgcatgccagaggatgggaaataaatctgactaaaattcagggaccttctccctcagtaaggggtccagtggtgtgggacctgttgagatattccttctaaggataatcttagaaggataaattaatgaatttgtctcctactaaaaccaagaaagaggaacaatgcctagtgggcctatttggatttttggaagcaacacattcctcatttggaatgtgttactctgtgttactctggcctatttatcgagtgacccaaaagactgccagttttgagtggggtccagaataggagaaggctctgcaacaggtccaggctgctgtgcaagctactctgccacttgggccatatgacccagcagatccaatggtgcttgaggtgtcagtggcagatagcaatgatgtttggagcctttggcaggcccccataggtgagtcacagcagaggcctctaagattttggaggaagggcctgccatcttctgcagataactactctccttttgagagacagctcttggcctgttactggactttggtggaaactgaatgtttgactatgggtcatcaagtcaccatgcgaccagaactgcctatcatgaactgggtgctttctgacccatctaactataaagtgggtcttgcacagcagcattccatcatcaaatggaagtggtatatatgtggtccagcttgagcaggtcctgaaggcacaagtaagttacatgagaaagtagctcaaatgcccatggtctccactcctgccaccctgccttctctccctcagcctttatatatatatatgtaagggggagtttattaagtgttaactcacatgatcacaaggtcccacaataggtcttctgcaggctgaggagcaaggagagccagtccgagttcccaaactgaagtatttggagtccaatgttcaagggcaggaagcatccaccacgggagaaagatgtaggcttggaggttagatcagtctctctattcacatttttttgcctgcttatattctagccacgcctggcagctgattagatggtgcccacccagattaagggtgggtctagccctttcctagcccactgattcaaatgttaatctcctttgacaacaccctcacagacacactcagggtcaatactttgtatccttcaaccaagttgacatggagtattaaccataacacatatagtccaattaattatgatagaaataaaaataaaatataattaatctttcagacttttaaaagtgtcagttcagaactaaaactgattatgcctctggaactatgaagattactttcaaagatcttattgtactctttattgagatttgactaatattttgtgggaaagatagcccacatgggattggtgaaaagtgttttgaaaaagaaatcaaatagcaatataaactcaattcataagtaaggttattttcgtttatttttgttgtctttttttaactctctactaatatgttacttagtcacagaatattagacttagacaggaaaatagtttgcaggagataaattacactgacattttccatagaatgataatacaaaaaaatttgactagaaagtacattgtaataattttatatgaaaagccttctctactacatatgtattgatcatctaccagatgctaggctctgagttgagtaggatacaattttgtcctcgaggttacaatctcctaacaaagagagatttacttacttgtaattacatcgtatgaaatttactatgtaaattattactatttcgtacatagtatgaaaattactataactaaattactataactttatactatactataactatagtataaaattactataactaaaatatggacaaagagggcacctcacttgttacaagaaacccagaaacttatatttgttgatccttaaaacttatgtttgtttcagaagcacagtgccattcactttctagtaaaatcactctctgaagtggatggaggagagctgcaactagattcaagcagtacggtgaagaaaaacaatgagaaacaacgaagaccttaactagggcaatgtcagggtctcaagagaaaccaaatctcagctaggattttgaagaaaatttaatggagggactacttacagatatgtaggcaggattgctagaaccactaaggaataatgaggcctccaggaattaaatttttaagaatttcaaaagccagttgtttttcatggtgtgaaatggtgtctcatttgtttaagttccttgtagattctagagagtagaccttttactattgcctaaaaccaaaagtgataagtactaaaaacttatcactccctatatttatatattttattatctgctttttaggttatttccatctattttttctatatggtagtgatactgtataattgtgtggctattgtgtgtctttttttctgctttgcatttagtaatgtcatgttaatagggtgaaattggctatggttggaatattcacaacataaaaatcagcaaacactaaaaattagggattgagttattgttttcagaaaatttgatgaaaaatgtaaataatcagaacaaagttctctgagggaaataatgtaacgatgaatattaaatttaaaagtttctgatatctgtaggcattacattaggaagaccccccaacatttgaggaaacattcttttagtattcaaaaaaatattattttttgtttgtttttttaacttttattttaagttcaggggtacatgtgtagatttgttatataggtaaacttgtgttgttaagcctagtacccattagttgtttttctgacctccctcctcctgctcctctaccctctgataggccccagtgtgtgttgtttccctctttgccttgtttgtgtccatgtgttctcataatttagctcccaattataagaaagaacatgtggtatttggttttctgttcctgtattagtttgctaagggtaatggcttccagcttcatccatgttcctgcaaaggacacgatctcattctttttttctggctgcatagtattctttagtgtgtgtgtatcacattttctttatccagtctatcactgatgggcatttaggttgattccatgtctttgctgtggtgaatagtgctacaatgaacatacatgtgaatgtgtatttttttttttttttttgaaacagagtctcgctctttcatccatgctggagtgcagtggtatgatcttggctcactacaacctccacctcctgggttcaagtgagtcttctgcctcagccatatgagtatctggtactacaggcacgtgccaccatacctggccaatttttgtatttttagtagagatgggtttcaccatgttggccaggctggtctcgaactcatgacctcaagtgatccacccgcctctgcctcccaaagtgctagaattacaggcatgaaccaccacgcccagctgcaagcatgtttttataatagaaagatttctgttcatttgggtatatgtacggtaatgggattgctgggttgggaggtatttctgttttgaggtctgtgcggaatcaccacactgtcgtctacaatggttgaactaatttacactctcaccaacactgtataaacgttccattttctccacaaccttgctagcatctgttattttttgactttttaataatagccattctgactggtgtgaaatggtgtctcattggggtttttatttgcatttctctaacaatcagtgatttggagctttttaaaaatacgattgttggccacatgtatgtcttttttggaaagtgtctgttcatgtcttttgcctgctttttaatgtttttttgtaaatttgtttaagttttttatagatgcaggtattagacctttgtcagattcacagtttgcaaaagttttctcccattctgtaggttatctgtttactgtgttgatagtatccttttcagtgcagatgctttttagtttaattatatctcatttgtcaatttttgcttttgttgtaattgcttttggcatcttcatcatgaagtctttgcccattagtatgttctgaatggtattgcctagattgtcttccagggtttttatagtcattatctagtaataaacaatgatttatctttactttctgactgtttagactcctcgtgaagtggcccagcaggctgtggatgcggatgtgcatgctgtgggcataagcaccctcgctgctggtcataaaaccctagttcctgaactcatcaaagaacttaactcccttggacggccagatattcttgtcatgtgtggaggggtgataccacctcaggtattttttatctctatttttctagtactgtgatgggaatcttgagtaatgatagcttatttgtggttctaaagataaacttgtagatttaggaacatattatttcctggtgatttcactaaataaattctacaaggtctaaaagtggacagtgttgttttgcattcaagttatattgcaatttattatgtataatttaacttaacactttacaaagcttcaatgagagaactacctcccttgcaaaccagtaacctatgctagatgtttaccttcattctcaataaacagttatggagaaggaacaggataaaagtaataaaactcataagtggagtagagaacagtggtagtaaatacacagtgaatatatcaaaacctagccagagatatagtgagtactccttgtcctggggggtggaatgagtcctttagtttgcttgcttctatttagaaggagctaccttgtgcttttcctccaggatggtcccatccctaaatgttatcttacctcagagctatatcatttacatggtcctataaaaccctttattatttaagctaatctgattagggcttggtatttcgggagccaaaaatatcctattgcagacataaatggaatcagcttgtcttgaaaattataggctgaatggggaggaggtgaatacatgaacaaaactgtgagtcctcttagtagaggagaaacagatgttacctacaatgatatcagttaatttattaatgaggtagggagacaccttccacatatgacattcctggccagttaaaatagttatttaaaatacaaataggttctgtttccaatccagttctcaattatatcaagattttcttttttactgagaatggaaaaaatgtcaagttagaagaactgtatatgaagctgtcgtaagtaaatgactcatagatgctagctgcaaaggccccatcactatagcaggaatccatcagtaaaatgtgaccttgtttccagctctacagtttttttttcctccattaatactcagaatatagaatagtacattcatatactacttgtgaaaggagaaaattcatatgaataaagttgtgagattcgtaataaagtggggctactgaacaaactacatatttattttctttccaacaacacattatttaatgtgatataatcaacacaaaattctttttgttaatatgcttgcctattatattcataaaataggtcattatttgagaaaataaagggtagttattctttattgcagtctgtctacagaacgcttctatcagcgttgcagttttagagtctgtgatacctaggcatgatattaaaatgtaaggaccaaaataattagccagtagaaaacatttgaattggaattcatgttgagaaaaaaaaaatgcctgttatataagtgagctgacattttcaagaattatatttcaaataagttgtattaattctctggatatttaaattacttagaacatctttaggtgtttgccatgtgatttttcccatgaatttaacaactaaggataaggaccattttctgtgttatacttttgtgtgaatatgggtattatataattatagcagttaacacccttgtattttctcactatttgtttgcagtgaatatgtaaaatgttgctattattcaattaaaggtcacttagttttaaattagaaggcactaatatctagtggctaatcaaacagatacagcttctgccatgtggagcttaacagtttctgcagtctgattaaatgaataaacgtggtctctcctcatcagtatgttactacgatcagtattttctaactctcttagcagcagtcgcctccaagttttttcagcaagttgagtagactcacaatgcctgcttccatcatgaagcaggcactgtgctatccctggcccagctaagtggaggacattcaaacatatatttttatttggaaataatttcaaactaacagataagttgcaaaaataaaaatagtacaaaaaatatctgtatacaaccccctcacaaaggtatattttacaaggcttatgtaagtaaagcagttagtataagtcacatacccttttttcagttgcaacatcttgcagttctcttccagttgaatcctccattctaaatccataactcagatgtcaggacaaatggtacatgggatttttaggaaggagagaagtacaagacctattaatctgacatctccaatttagagatgattattattacatgtttcattcagttcccttatgagctcttaaactctgtatcatctactcaagaacaatgacatgttttgagcacttttatgtgtcaagtactggggaaacagattggacatgatctctactctcagaatttcacagactagaaggagacaagttcaatgagatgtgttaagttctgttgcaatattatagtattataagaatattacaagtatataatagagacagaaaagtagtagttggggagtaattagcatgaccatataatttatcacttgagaatagaaatgggtgctcttaaaaagggtgctgcaacaataaacaaaaatcagactgtcctgtcatatatgatcaccctactggataatgatcaggttcttgtagcacatcctaacatcaatcgatattgcagctacaaatgttcagatgttataacagcctaaatcctgcagtattatttgtgcccttgatatcttttcactcatactttgactgttaaaataaactaaaaaggccaggcacggtggctcatgcctgtaatcccagcactttgggaggccaaggtgggcggatcacgaggtcaggagattgagaccatcctggctaacgtggtgaaaccctgtgtctactaaaaatacaaaaaattagccgggcatggtggcgggcgcctgtagccacagctacttggaaggctgaggcaggagaatggcgtgaacccgggaggcggagcttgcagtgagccgagatagcgccactgcactccagtctgggcaacagagcgagactccatctcaaaaataaataaataaacaaaacaaataaataaactaaaaaaaatcaacagcaacagagaatgaaaaaaaaaatgggcttattttcatttatagaaaatctatcagttgtccaaattcaaagtgccatcattcactaactgcagacaaaatacctaggagaaaatagttttttaggctcaaacttatcacatcatactaaatttaacacacataatgacaactagtgaaaatttaggtgagagaaaattatggcttaaggctcagaagttctcagtcaggatatccagcttcctaccacaagcaacacatagaggcatttagaaaatgggcggagtgttttgttttttaaataacttgggctgggaggctggtgctgatgactattagtagcactcccaatcaaggaagaattttttagccccaaatgccagtagtataccagttgagaaggttttgggtaattgagtgacaaagaagaaaggatagggttttatttccgtgaaaatggaaatagtggctcttattaattaaacacattctttcaacaggattatgaatttcctgtttgaagttggtgtttccaatgtatttggtcctgggactcgaaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcatgctgggtgacatgtgaaataaactcatccttgaggaatttacagctcttgacagtatcttttgagtagactactttgggaggaagaatagcagccacttgctaccaaatttcacatccattgtgtgtgtgtgtgtgtgtgtgtgtgtgtgtttgtgtgtgtgtgtttacccgaagtcagaagtactggctccaataaccttactattgaaaacctattttctgaaatatccagtggcataactcatagaaatgaaatctggcctgactctaagattaaattttctcattattattaaatcgagaaagtgttaaaacttaaacactttagtgttatttagattccaaaagattccaaaagaaatttcatccgacctttattactatccttatttttggatgaaaacttgtatgcccaacaatgagctgacttttggaaatgatcaggaaaataaccaagtatattaaaaaagtggatagatattttatacagataagctatccgatattcaccaaatagtacaagaaaataattaatggatcaggaagacaactactttcctcatttcctttcatcgaaaacatctgattcaaaatagaagattccagcacaaccaaaacatactgcacaaagcaatttaacttactgatatgtgttgtttcacaggtgagcacttcatcaatctaatagtgcccaatcttagttacagttatttcatctttgataagattatatttatgatgcatgatgccagtgaggcaactgacagagataggaagaagattttgcattcatagccagtgtgatctagatatctttgctttgtttataggctaatgaagaatcaagagttcatctgtgagaaacacaccatatacacatatccacacctgaactgaagaaatagggaactcaggcattaactaacttaaactcttaccaatcagggttcagagaagaagaatcagtaggagacgtgtgtatgagtgtgtgtgtgtgtgtgtgtgtgtgtgtgtgtgtgtgtgtttatgagccggctggaaccccacaggcataagctgaagcttgttttcttcagggaaccagtcaggaaggaagataatagacggaagggagagcaattgttgattcaatgactggagtctgggctcaggaaaggttcaaaccctttttattatttttattttgtatttttaaattatactttaagttctaggatgcatgtgcaggacatgcaggttttgttacatagatatacatgtggcatggcggtttgctgcacccatcaacccatcatctaagttttttaagccctgcatgcattaggtatttgtcctgatgttctcccttgccttgctccccaactcccccaacaggccactgtatgtgatgttcccctccctgtgtccacgtgttcaactctcacttaggagtgagaacatgcggtgtttggt

SEQ ID NO: 13360 - DNA, 35647 bp, Human
ttgatttaaagtttcttttaaaaatggatatattcagacaaacatgatgtgattgtaaacacattagcctttatctatctctcaagatttttctgggataatccagttagaaatattctatcatgttatgatatgctagataaatgtgtcagattattattttagggaaaaaagttattgtagatagtttcctactatgctaaaaagcttaaacagaaagagaacaatctatgaaaataggaaatttatgaacagaaacagccaactggcacccatgtttgggactcacatgcaaatcaagttattccttgctttccaacacttcccaaattcttttaaaaccatatatgaagctggatagcaactctatatgaagacatcagtgctataaatacagacagcattgtgttgggtagagcaatgccaggaattgccaggaccaacagataaaaccagagcaattaagtttccataaacacttgacttgatgttgaatcaacactctcctttataaacagcagtttagcaagaaataaatgacaattatacatttctaatatataaaccatgctggtttggtgaagtaatagcattcttttgcagctttctttttacaatgtagtttgttggagaaagttgctcaataatttggaagtgttaatttcaagatcatgtaaaattctttaaagccaattaaagttaagctaaagataattcatcttatctatgaaagagtttacagataagcttttctatgtttttagattaacaccatctccctcaaccaaaagagaaattcttctaggtataggtgagcaatttttagtgatgtttagttctcctttcctgcagatggttttctggacattcattatatactttagcaagaccagaaagttctatcttaagagactctgatctttcttttaatttttatttcctaaccctcaccccagaactaacacaaaataacttatgactacacaattcttaccttatttttactctttccttttagatattcaattgccctttcttaagcaagatacaagaaaaatattttttattaaataataatgtattctttcttacaaagaacaaagacttaattcataattttaaaaagaggccagcaagctatgacttcaatataagcgaccatgcactcacatatacaaacatttcccaacttttcagaataataagacaattcaaaaacatctgattacacctagtttcagagtaaattttctattctcatatgtgatttctgtctgtgtgatatttctttctttgttctaagtgtcctgtgatatttctcatcatgtgactcaaatgatttctggaatttttagtgttttacaatttagtgttcagtatttctagacctctcaaggtagttagttgcttccacattgtttctggacaaatctctattagaattctcccaaattgcagaagttttccttttaaccaggaaggtcttaggaaaatggactacttatcttttcattcccagagcctctccaagtatgtgacacattatagaacagttaccaaactccataagattgtgtagtttatatgtttggtgattctatgtatcctcagcatctagaagagagcataaatcatcttaagacctcaataaataattactgaatgaatttaataaagttgagaagtttctggaccagcaagtcattttcccttacagtgacctttgttatctgattgtggctctgctgaatcatgcaactaatctttgcagttagttcccagggtaaaagtttaaaattggtgagttccattgatgatgttgccttggttacaaactagaaatgtccccataatcatgatttgtaatcttcacagactctagatttgttctgattatcatgtattcatgcctggtgtccaccgtaaatcccttgatctgttataggcatttaccttgtactgactacctcattgaacaaatctcccctgtggactgtcatttaaaagcacaaatacactacatagagaaaggcttggttcttatcaggacacaaatttaaaggctgtgtggacttgggtaagttatataatatctttgtcagtttctttatttgaaaataagattcataagtgactacccaaaagcattgttataatgttaaatgagattacatgcaaagttttattctaatgctattgttatctaaaagtaaatgttagttatctccatgcttttaataaaggtgtttataagctgatatactatccaaatataaagtaatattacatgttgagttcattctcatgaacttcttggggagggcttagaagaaacattttttcacgtagggacaattaccatagggttatatagatctgaaaatgacaacgtaggcatcttttatttcacaaaatattgaaaatgctgccaaaagaattagccagtaataaggggccatagtcaaacaggtagtggtcctctgtcacttttataacttgacattttgttttcgggagttgctagacatttaatggataatggcgattaaagatttattttacagactgtaaggcagcctctatcagaaccaagacagcatgaaggagaaattgagaactagtgatgggccccagcgggcaggattttaagctgtccaaacttctttctgcagtctttccatctgccagtctccacccttgtttcaagtctccagggtcttcatgctaggtcttggacttgtaaattacacaacttttgtgccccacctcagccctcctcaacttccctttgggcccttcctgctccctcactccctttccagtttctatctcaatcccattaatgctttgtactctctgaattattctctccaaaactgcttatggaaatcttacctttagtaatatataccaaagcaaccaccaaccaccttccttttgttttcacaaagaccttttacatataatgcaatggatcaaattgactataatgagagaaaatcattagacaagagaatttggaagaaatatggctgcacacttcaaataatatcagataatcatcaaatagctggtatttatgtcttacaaatatgatagtttgcacatttagatttgtaaaaataagatggtactcacatttaaatctataactcaagggaaaacaatttttgtttttagtggaaggtagttatcagaatccttatcttttctctattagatattccattgacctcatctcttttataaaaatgatcatcctttccccactcaattgcatttgagactttgtcataaatcagatgactatgtatgtgaatttgtttctgtattacataatatgccattggtccatttatctgtatttgtgttactagtactctgtcttaatgacttcagcattatagtgagttttaatacttggtattgtaaatcctacagctttgttctccaatattttttcaatgttaaatctatcttatagaagaaaatgcctttatgactcattacttttggataaccaaaatttcttaaatagaacacacacatgccaacacatgcataagcactaacataagaaaataaaaattagctagatttatttgaattagaaacttttgtttaacaaaagctacaactaagatagttcaaataataagccacagactaagggaaggtattcgtaaaacatttgacaattgccctatcaagaacatgtaaagaattcatacaagcgaataagaaaaagagccaacctaattacaaccatggaaaaaacattcaacagagattacagaaaagatgggatcaaagtggctgataagcacatgtaaataagctcaatatcttgttattaaacaaatataaattaaaaactgcaatgaaatagtattacacaaacataatagattaaaattgaaaaaagctgagaatacaaataataggtgagggtatgaagctgatggaagtatgatttgataaaactcatttggaaaaatatttgacaatacctaccaaaggaagacatgtgtataccatacagcccaataatcccactctggggtatatatccaaacacatacacacacacacacacacacacacacacacacacacacacagtgaatagcaacagtgtttactaaaagaggtacagagaaaatgttcatagttttatttataatagttccaaactgaaaataatcaaaattcttataaataatagaatgattaaattaattatactgtgtgtataccatggaatactctgcagttattaacaaatcaaacttcttcacatgcaacgtggttgaatctcataagtataataatgagtagtgaaaaaggttagacattaaaaatagatatttcacttattcaaagtttaaaaactgataaaactaatcctagttatatcaagataggttttactcttgagggcttcagactgaaaggggtgcaagtgaccttcctgggtgttggaaatcatctatatattgcttttggtagtggttacactagcatatacatagttgtaaatcaatcaaactatacacttaagacttgcatgctgtgttatatgtaagttatacctcagtaacttttttaaacaaataacagattcactgaggtgaggaagattaaaaagaagatgtatttcttgtagagttcatgttaattctttgtagagttaattctttggttaaggcaaggaagggactgttcttcatgtaagtgctttctgagaaggtcatggtctaacaattgattctatgagagtgcattccccagggcatgccatagggcagtacccagttgtcctcagtcttttccctcatctttgatctttcctctcacaaaatattaacttttagttgtttatgatttacaaatttgtcaacaagaaacacaatctgaaactaaagggtaaagaaatacatttaaataatgtatcaagttgctggtattattatctggaaatattttaagagtattggcttaagattgccatctgtgtataaaataattgtgttaagaaggaattgatgctaaagccaatgaagtaatgcttcttcttcttctgtaatacttctgttcagaagagctacctttacctaagttcaagcagctatgtaattccttggttgaaatggcctacttagttcctagatttgcaatcttccaggtggtagagaataatttatcctattggaacattgggataagataagtcccagaggttggactagggcttagtatctcagtctggatctacagggtcttttaccctgggcccatttatattttcaccctcacaaactctgttccagctctgagccatgctctacaattctaatctttaggtctgcatctttcttacatcagcaggatttgctatttgccaaatgctctatttcctgcagttttccatcccttcggctttacctgattttgacccatatgtccgggaattatcccaaggcccaaaatctgtactattataattctggggcaacagagataccttcataatttcctgtattcaatcctcattctgaaatgcttaatttacttctgatgttgaattattaacttttaccctcatattttgactcagtcaccccaagtgactattttagacctcaagcaaaaaaaaatgaccctccagttttgttttgtttttttttttgtagcttcttttctctgagaaggtgtaactttgagtgtacgcattttacctattcattgacctcaagccaaagcatggactgaaaaatctaaggtcctttcttagcagtttcccttagcatagttgccctaaactttgatcaaccagaattcattggatatgccaacatgcaaagtaaccataatcccaggtgataccgattatcccataatcattctcaagagatcataataagttttcttctggatgcttttaatacttgcacagaaaataagttctgggattaatttacctagatttagcattatatcaaatatcttatatcataaaacaatgaattttttcacacacttttgacaaaaaaaactatatgtaaaatatgcagattgtgtgtgtgtatatatatatttttctaataatatcagtaatattatgtattttcagaagtcttctattagaattaattagagcccataatttttgtgtccttttcaatttctttcataagagtttttcagttttccttgtagaagtttttcacctctttggtaaaatttatctttacgtattttctttgaaacactactgatttttgcatgttgattttatatcttgcaaagttatttaacttacttatcagatctaagaatttggtggagtctttaggttttctagacataagatcatatcatctgcaaagagtgacaatttgcctttctctttcccaatttgaatgccttttatttctttctctcaagtgatttctctggctagaacttcccagcactatgttaaataagagtgctgaacatgggcaatgttgtcttgttataggccttagagaaaagacattcagcttttctccatttagtgtgatgttagatgtggatttgtcatatatggcctttattatgttgagttatgttatttttttttttatggagtcttgctctgttgtccaggcttgagcgcaatggcatgatcttggctaactgtgacctctgcctcctgggttcaagtgattctcccacctcaacctcctgagtagctaggactataggtgcgtgccaccatgccttgctaatattttgtatttttagtagagacgaggtttcaccatgttgcacaggctggtcttgaattcatgacctcaagtgatttgcccacctcggcctcccaaagtgctggaactacaggcgtgagttaccgtgcctggccgagctaggttctttcaattcttagtttgttgagagttttttgtcaggaagagatgttaaattttatcaaatgcttttaaggagtctgttgagattaccatatggttcttttcctttattttgttaatgtgatatgtcacatttattgatttgcatatgttgaaccatccttgcatccctgctataaatcccactgctataatgatcatggtgcattatatcttacatgtgctgttggatttggtttgttagtatttttttaaggaactttgcatctatgttcatcagggatattggcctatagatttcttctttgttgcatccttgtctggttttggtatcagagtaatggcagccttttagaatgaattagggcaactttactttccttgaatttttttggaattgtttgagaagaataggtgttagttcatctttgaagattcggtagaattcagcagtgaaatcatctgatcctggacttttcttattggtagagtttttattataattcagtgtcattattcattattggtcagctctggtttctatttctttctgattcaatcttggtaggttgtatgtctccaggaatttattcattttctctaaaattttcagttgttagtatatagttatccatgattgtcttgtggtcttctgtatttctctagtgacaattgtaatatcttttgtttttctgattttgtttatttgggtcttctcttttttatcttggttactcggcctattggtcttgtttatattttcaaaaaatcaacatttttttatcctttgtatattttttaaagtctctattttgtctagttctgctctaaactttgtgatttcttctgcccgttttgggtttgatttgtccttattttcatttagttcttgagatgcattattagattgtttatttaaaatctttcttttgtttgaggtagttgtttgtcagtataaacttgccttttagcacagcttttgctgtatccccataggttttggtatgctgtgtttcaatttttatttgtttaaaaaattgtttgatttactccttaatttcttccttgacccagtggtcattcaggagtctgttgtttaagttccacattttttacagtttccaaatttcctcttgttattgatttctagttttatttcactgtagttagagaagatacttgacatcatttcaatttttaaaaacttgttgagacttgttttgttttgtaacatatggtccatcctagagaatgtttcatgtgctgatgagaggaatgtgcactttgtagctgttggataaaatgttctataaatgtctgttaggttcctttggtttaatatccaacttaaatccaatgtttctttgttaatttctatatagatgatctgtctaatgctgagagtggggtgttgaagtccccactattatagcattggagtttgtctctccctttagatataataatatttgctttatatatctaggtgctccattgttgggtgcatacatttagaattgttacattctcttgctgaattgatccctttttcattacataatgaccttctttgtctgcttttgctgttttgaacttaaagtctgttttatcttatagctataagataaactatagctattcctgcttggttttggtttccatttgcatgaagtatcttttgatatccctttgctttcagtctatatctatctttacaggtgagatgactttcttatagacagaatacagttgggtcatattttaatccattcagccactctgtattttttaaattgaaaatttaatccatttacattcaatgttattattgatatgtcattttgttagttgatttctggctgttttgcatattttttgtttcctttttctcttattgtttatcatggtggttaggtagttttatgtagtgataacatttgagtttttgctcttccttatttgtgtttgctctaccagtgggtttaatacttttgtgtgttttcatgatggtagatatcttttcacttccatgtgtagggctcctttaagcattactggtaaggccagtctaatggtagtaaattcccttagcttttgcttgtctggaaaaaactttttttttaatctttcatttatgaagaataactttcttcgttatagtatccataggtggatgtttcttttttttttttttctttcagcacttgttaaatatatcatctctggcagcagcagctaggtgcagcagacacttcaggtgggaaatgtcaatgtggctccagagatgtggatatgcaaggactgctggggccctgtgcaggatgcagcctggttgggaataggctctcaataaaggacgcttctgtagctgcctagcactcaagggtgtgtgaaacccgtgggacccaccgtgaactctcctctggaactgtgcctttgggcaggctccaggcaactctttggtagcctcgaggggtctgtgagagtctagaagcatcccaatggctaggaagcagaagtccacgatgaaaatgtgcatcagtgggggtcactcacttaccctttccatgtgttaaggagcctttccaggctcccagtcagtcccaactgagcagactgccttgtttttctctccttttttgctttaggtgtttcatgtcacttatctgttgaatactagatggtctatttgaagtttaattatctactccttattttggttcttctttgtggagaaggcaagtgccagatgcctagtcagctatctttcttgaagcccctcccctcagaatctcccttttatttaccttttttgtttcagttacctcagggttaatattatctgctttactagattttttgagcattagaaagagaaagggacatttcatcatctgtgtcaccatattacgataaatcttgaaatgtgaggctatgtgaacatttggagggagaaagaaaggaaaggaaatagatgaaaaagagtgataaaggtgagattgtttacatgtgtatgttctctgaaagaattgatttagagagttcttctcatattgagcatgtctggcagtcagcaggggaaacgtgagagcaatggtaaactacatcattgggtgaaaaagcatgattaattgtctgccctgtattattctgcacaaatttgttaacttgctctttaaaagtgcttgcttttgtaaaatgagaaccaaactgttagccttttttgcttctcacacagcaggattaattcagaaataaacttggcagatggtgaaaagaaggtgccaaccaaattcaataatctatacttattaatatcctagagttagctagctatattaactaaaaataaaagagaaggtacattagctctgatttgtctgactcataatgacaaccatgcttagcaaagtgatcagatattatggaatatcgctaagtcacttacataaattagtagtagcaagttactcctcttctttgtagctgacggagagtttaaatagaatctttctgtgttcttatattagtttcctcttgctactataacaagttatcataaattgaatgttctaaaataaatacaggtttattatcctactgttctggaggtcagaaattcaaataggtcttcctaggctaaaatcagaatgtcaacagggaaactctatggggagaatctgtttccttaccttttcctgcttccagaggctatccatattccttagcttggagtatcttcctctgttttcaaattcagcatgactggtcaagtctgtctcatgctcatcactgacattgactcttttgacttcctcttcaacattaaatactcttgtgattacattgggtccacctaggtattccaggataatctccctactttaatgttagctgattagaagtttgaattccatctgctaccttaattcccttgtgtcatacaatatgacatattcaaaggtccagggattaaaacaatttatatttttgagattctactattcttcaaacaacagtcctgcctttctatctggatcccaatgactaacacattaaaccttgttcggatcctaaaggtttcttttaggaaaaaaaatgcaaacacatgtaaaagtggtttaaatagtttattaccagatgttatcccatgaattgagaataatctaaaattgtgttatttttctttcagggatggaaattaaacacctcttgtttttggttgctgctgcttgcttactgcctatgttgtccatgaaagtatgtgagggttggatgtttcataattactttctaaataaagataagagctaacactttaatacaattcaccatgttagaggcactgttgtgaggccactacacccattactcactttgttttcacaatagccctgttaggcaagtactcatcttaataccattttataaaggagagaaccaaagaatagtaaagttgagtaatatggccaatatctgaggactaggacatggcagggcctgaaattatacttaatcagttagctctgtgggtccatatctatttcattgtggcctctctgaataacacaggaaaaaaactgagaatgcagattagctatataattttttactataacaagaatttaaagcatcaaaattaaatataaaatggaaaggtgccaacagcacaaagagcaacgtgaggagctgattagcagtttgaattccattggctaccttaatctcactaataattaaaaacaataatctcactaataattaaaaacaataactttaacagtcacaaaacagaagtagaacactcaatgatataatattttatgatcagccaataatattcacctttaaataacttcaatgatataaagaaaataatatatattttaatttaccccaaattttgtgacaaactgaagtaaataactttggtatagaaaatgagtggtttttatattttcgtaggccaggtagagaagtaagaaataaaaggcacttagttttattgtggaaagaaaatccatatgcattaggctattagggtgttggtttggtatttggttcctattactcactcttcttccccagagagagactaggtggagctcctgtttaatgcccagtaatcctccagtaagctggaattagcgtcctgaattagagtcctgaataagacttcttccttccctctgattctctgaccattttacttccccagtgaggaagggtgaccttcatgcttcataataaggaaaaagctaacctgaagtatagccaccattccagaggaatgggaaaagggcaaacagtcagaaacctatatttgccatcaagacctagtactaggctgtttagaccacttaggccaagttctgggaaacagcctggcccagattgtcatgtgaaagaagaaattagtatcactagttaaaagtccagagcaaagagcagataagtagaaccctacccgtccaagggaaaccatacccaatccgcttttgaccaagaatacaaaagaaaaagtagaaggcattgataaaacaataggttgatgctctataacagagaattattagaatattttcatacattttatagatagtttggtcataaaataaaggcttaagaattttaaatttaaacaagaagataaatttaacccccaacacaaatttattacataaactttaaacatgagtctgagttaaagtaaataatgtgttccaatttgccaacaaaagtagtattatgctttcttttttcagactccaggtagaaagcaaatagactaaccaccagacctgaatcatattttaaacttccaccagtggcagtgttttttgggatattagatgtctaatttaacaaaaattgtttttactttttatataggtagttttccatgacaatctggtagatgttacacaaaaagtttttttgaggaaaactatagagagttgtgatcaggtaacaggcaggctgaatcgtctctgagttaattagagacttatctgagcacacggtatacctgcaatctgaagaataagttggctttgcaagttaacaaggtgtactatcaaaggtacaggcatgggcaaatattctatggcaggaaggaaactggcacattcagataaccaaaaaaaaaaaaatcagagataaggacacatatcctaaatagaggctgagaataaacagagtattcaaaggccttgttaaagattttagttcctctttttatgaatggtaaactgttgaagacttctaacagtaaagtgaatccattgtgtctgtgttttaaaatttttactccgaatgatgattggagaatgcattatgaaagaatggatcacggagtgggagagaggctatagacatagtaaagcattagtggattctgggaggccagttgaaagctagacagtagccacaatcagtccaggtgaaagaagcaaagaaaggaaagagaaaaataaagagtgtgtttgttccttacaccaaaagaaagagtatttctacactgaaagtttagtcaaaagagtcagctgccaataaaccaagcagaataaagtcattaaaacaatattgcatatgcaaattgagcttgtcagggattttaataggagtatttttaatgtagggtttcccaacttcaaccttattgccattttgtatgggataattatttgttgtggtgagggctgttctgggccttgcaggaatttagcagcagcatccttgccctctattcacaaaatggcaggagcactctccccctatcatgcccatcacgacaacctcaaatttccccagacattgcctaatgcctaagcagcagggcaggtggatcacctagaatagagaacatattattgaaaaaaatggagggaggtaaatgcgaggctctattacttgggcaactgtagacagccagagttggcgatattttccagaatattgatagggaaagagagtagagacagagaacaatagttgaatggggaagtgatgtaaatgaaatgatggttgcttgtttatctgttttaagaaataagcagcatgtagccagtaatggtggtgcacacctgtaatcctagctactggggggctgaggcaggagaatcgcttgagcctgggaagtagaggctgcagtgagccaagatcgtgctactgcactccagcctggcagcagagtgagacttcttctcaaaaaaagagatataagctgcataatcataaataaacactgctgggaagggccaaaaagaaagagtggctgacagcaaacaaaatgaaaagtaaataatgtaagatttgggggaatggtagaagagaatggactaaataacactgttggagaattgagccttagaaagattagaaagaatgacccattcacttgtaccacagaagaggaggaaagaaaggggacagatacaggtagattgacagactgggtgagacagttgaagcagctgccctctgatggcttctctttactgagggaagaaggatatttcacattctgttgagagaaggtggttgtgaatgggggagattgcaaaagttctacaataatgtggagagtgacagagtgagttaatcaaacaattcattagaattgattagcagagttaaggaactatttgaggtcaatcttactgatttggggtcatgcagatatgtgttgttttgttttgtgagacatttttctggcaatgctcagctgatagaacaggcaggagaattgtcagtctcatccgaagttgggatgttttaggtaggcatttctagatgatggtgtgcagacaaaagattcaatattgcaaaaggagagttgtgaaagtagagaacacagatagagatgaaaggaaagacaagagagggctagtagagaaaatgaagaatgagttagaaggctcgattatattaaagaacagtcagaatggctgatcgtggcaacttggaagaacaggaaattccaatcaggcagggaaatgcttgaccaggtgatttgggaggtatggtgttttgggatgatcatgagatatagtaggtgaccattaaagtgaggataaagaggactgaaggagaagtctaaaggaggaagattttaagggcctgagacatcaaagggttggattcatccatgtggatgttgaagtcctttgagttgacttcagaaatctgggtggaaaagatgaattcgtttcaggaaacccaatttccaggaatgagaggaagtaagaaaaaaatccatgataggatgttaaataaatgttcaggaatgaggtgtgagaggaaaatgtcatgagtttccctgcagcagagattttgagaggagcaaggagagttgtaatctggaaatagtatgtggaatcatgtgggtccgcagcctgtcctctagtccaaatcagcatgacttgcaatgtgagaaaaaagtgacatcatgtgagtatgtccacagagacagtctctagaggagtcttctgaattccatatttaagttttctccccttaccctaaactgttgatataaatgacagtgaatacttctatatattgtgtaagttatgatgctagatcgtattcattcataaattgtgctgatggtcatgtggtagttaaggaagcaacagacacccctcacattatagtacattagttctgccacattttttaaaaaaggtatgaagtacatgtgatatcacacacacacacacacacacacacacacacacacacacaaagattctctttatagcgattaatgctaacctaaatactttggtcatgtatttttcttcttagtgagtttcagaataaaaaataaataaatgaaaagaacggtcacaaattcaagattataggctgaatttgaattctatgttttactctctcacacatacacttgagagcattgatgttttctcatatgaacagtaagaagacatagaatttgtgttaataacacttgcaactttgtcctcaataatgaatctcttagtttgggttaccccagacacacacctctacacaagggttcaagtggaagtagtttatttgggaagcagagagtacagttgttgcagggtgggagatgtggagaataagccagagaagtaagtaacaggtgtgattttaagatatctccctttgtggatcttattgcccaataaaaagtgcttcaacatggtccaaagtatgaacctggaaaaaccctaataacaggataacaagtgcattattctgaagactaatgtgatgtcagcctgacgttgagaaatcctcaaaattagtactggagaaatggaatccaatataatgagacattataaattcaaaaatgctataaatcactgtttaatataaactataaatttgcattacctataggtctgcaaaatatatgtgacaaattccacttaaaagaagtaacactaattaatatttttctggtaacagaagaaatcagctagagaccaatttaataagctcgtcaccgacttgccaaatgtacaagaagagatcgttaatatacacaacgccctcaggagaagagtagttccaccagccagcaacatgctgaagatggtaagatcaaaaaatagcaacaaccatgattgcaataatagtaatggtgtttactgagttttattaagttctatgcactttcaaagtgctaaaagttttatcttcacaacaaatcttttacatagcagaagaaacagaggtccagagaaggtaagtaactttctgatgattatatggttagtcaatgacagagctcagccagtctagcttcattcctccacaccctaagacagtgcttctcaacctttaatgtactcaagaatcacctgaagaacttagtaaagcacactttcctgggtctcactctctgatatcctgattcatgaggtctgacctggagaccaccacaagctcccagctgatgctgatgctgccagtacacacgacaaatattgattaacaagttatccatgcatttcatagctgtcttcattgggcagtagtccagaggctaagacactcttcctagaattaaaatatccagatatctagttagttgatgtggccaggtaaataaatattggcaaatttatcccccagtttcattgcatcccataaataggaagagaaattatttcattataaacctgctatgctctgctacaagacaaatttagggaagtctcaggtgtttaggtgattaccctcacatttgttatccagcagtatcactcagtttcatgagcaccctcagcctgcttccttgaaccctggaccggcctgtagcaacaagggttagaaatagtgcaggctctggagggtgattctaaggagcacctttctcttgcaaatgatgaagaggatgaaacaaggaaatacataaatgattttgagatttatctcttaatcactttaaaatccaaaggggtatttgaactaaaaataaaaatcaatagctttcataggcattcctgcatggtgttgtagccaacatacatgtgtttattatttacaggcatttttctaataccttgttacattaactcacttccttctcccaataaaattgtcttcattttacatattatgacactgaacctaaggaaaattgagtagcttattcaaaatcttaaggactggggcccagattaaaatgcaagtgggccagatctgaggagctggagaagtagagtccaaattccttggttgccagatgagcaaataagtttacctaggaggtacaaacagagttaaagaaaagtaaaaaatatagcctccgatttcagattggagatgaaaggcaaatacagaaaaaacactggaaaaatacaagaatacatatattcaagtactaacacaaaaagatatgaaatatcaagaagacgataaaagtaagtgtaccagtaaaactgagaaatatttcaaaggaaatacgagagttcagctgctccacaaacaatgcataggacatgtataggattagaagtagcaacagcaaatttaaggaacaataggactgaagagttaaccacaattaccaggcagagattttctttaaaaaaaaaagtttctgaacacaatattagaacctaagtagagtcacttgttaaagctggaattcagagctttggtacgatcataaatacaaactttaattttaattttgaatatgtctcaaaaaaggagtatctcaccaacattaatcagaggtaatgtcctatacatcatcttcaaagtgcaaacatcctgctatattttaaccagataagttccagttccggtaagttttctttttttattttattttattattattatactttaagttttagggtacatgtgcacaatgtgcaggttagttacatatgtatacatgtgccatgctggtgtgctgcacccattaactcgtcatttagcattaggtatatcttctaatgctatccctccccctccccccaccccacaactgtccccagagtgtgatgttccccttcctgtgtccatgtgttctcattgttcaattcccacctatgagtgagaatatgcggtgtttggttttttgttcttagtagtgaatgccatggtattcccccagcccagagaggctatacactggtagatgtgttgtgtcctctctgcttatcagttagacatagccatgactaaaatatttttttttgtttgaaactatcaaaacctacaaaaccatggttttacccagtgctaggctaataagttatttaattcatctcacggtttagtaaattcatcaaccccaagggtaattctaaacattgaccacaagatggcagcaaatacatattataattaaactacatgctcaggacgacactgaaaatgagtgtcctccaaacagtctaaacagtagctgaatgatttacataaaaacttatagtaaaaacaaactctatgacttctgttggcaatctgttatatgcacatataagggtattcttttaaatggatgtatatgctgctgaacaccaggggttcagccaaggtctagttgcttgcagcacaaaaatgagtattgcccattgcctgggaagaaaggctttcatgagggtgatgtcagcctgactgtcaaatccctccctctccctaaccaaccaaagttaaaagtttatataggagggacagaaaacaagagggacaaggaagaggatttggtcaacaggcagcagctgtgtctccttgaccaggtgtggtgatcaggaaagcctcagttccctgctaccacctgcggggcccgatggtgggtttcctgacaaaggaactcagataagacaaatgttcataggctcagttctttgtaaaaattgggcagtttcatatacaccacaatgataggagactgttagggagatcatttatcacagagtgtcatacttacagatgcagaatttctccctttctgcattgggagaacagctgttacttagtcatacctgaccaaatgcttcaactcagcacagttgatgcacactgagagtcaagaacacatactctgaagccatcctaagtggattcaaattcttattttgtcagttatttatagtgtgaccccgaaaagttacttaacatctctgtgccttatttcccttatttacaaatggatataatattttttttttgtagagttgccatgaggttaaagtgagagaagatacacacagaattggtgacagattctggcatgtggtgttagcttttatttttgttattcataattttagatggaaatatgactctatacttgcttctaatcacagccagcatttattcaatacagaagatttgtcacatctcagttgtattccttggaatatcacatttgaacaaacctttgggcataaattacaggtaacagtttccagatggataaactgagattcaaagagataaaataacatgtctgagtttaaactacaaataaattactaagtaactctggtctgtttccctggaagcatttacttaaattctctactacatctgagagagaatctatctctgaatgtaattaccaagttttgaatttgtgaattcaagggccaacataataaattgaaattgttgtctttctctttctactagaacgtttaatagtaatctcattatttaaatttctagttgatacaattgaagatattatatctcgtggattattaaaaacaataaattagaatcttatgaaaatattaattggaacatgtgctttttttttctttccactacagagttggagtgaagaggctgcacaaaatgccagaattttttcaaagtattgtgatatgacagagagcaacccccttgagaggagacttccaagtaagtgtgtatctatatgacccgcctttggactaaaaaaaaaaaaaatagtaaaacagggattgttatgtaccctgatgaaagtaaattaagtcatctagatttcctcatttgcactgggtcatacaaggcagtgaattgtggactattacactgttttaactcattaatttttaaggtttatatctttaagttttcagattccaagttctggagttttcagattccaagttctgaccatcaggagaaatgaataaaaaatctcagtattgcagaagagtggagtgagcagctagaaacctaggtctccattctgtggagttactatagctactgaacaatagcaccatggggatctgcttagctttggaacgataatgcagttgagaaataagttatatgcagccctgctcagctgcccataagacaattttaggtgctcaaaaatgagcccatcttaaagcatataaattaggtaacttactgctagtttccaggaaataataaaaaaaaacattattgcttctgtgttacgctgtttttgtgttgctgtaaagaaatacctgagccttggtaatttattaagaagagatttcattagcttatgactctgcgggctgtacaggaagcatggcacccacatctacttggcttttggtgagaccttaggaagcttacaatcatggcagaaggtgaagggggagcaagtgtctcacatggtgagagagggagcaagagagagagagttggggggtgccacatacttttaaacaaccagatctcatgagaactcactcaccattatgaagacagcaccaagttctttgaggaatccactaccgtgaggtaaacgtctccggtcaggccccaccttcaacacggggattacatctcaacatgagatttggaggggacatccaaactatatcaccttcactcaggaataaacattatattttaacatgagaatctttttttaattaacatgttttaaaaatgctgattcacatttatatctacagattatttggaatcttagtccaatgctttttagcagtgaattagcaaagtggttcctgcctgccttaagaaaagacagatactcctgaataccatgttcaaccaaaagcccacaccatacatgaatggctaaataaacaaatgtttattcaacatctttgtattatgaacacctgtgtgtagcttcctttaagccatagaccctgttagcactcttatgcttctctgatttggtttcacctatctaaagcagcttggaagcagcagagactgaaatgttgatgatttgatttcaaaacttgttcatcacctactatcaacgtttcaccaaacttgagtaccacatgctcattcatcaatgagaaagattttcagtggggatacaacttattttactccctctcagaagatgttgtcaagatgatcagtgaaccattcataaaataaaaatgaggaaagtctccttgtatactatttcccatttgttcagagtatgacccagcccgttttctcatttcagataccttttgtggagaaaatatgcatatgacatcttatcctgtatcatggtcaagtgtaattggagtctggtacagtgagtctacaagtttcaaacatggagaatggacaacaacggatgatgacataactactgaccactacactcaggtaacctgtgtgctggcaaacacacacattgtttaagagataagcatgtgtgtggaaacgtaactaagaaacaactgaaaatcattctaccttcttatggcaatctttactcaatttactgagttcctcttataatttgaaatagaaggaagtgttctgttcaaaatacgacttagagaagatgcttaacctcttagtatccttctttactcactagatttttcaggaactcacaaaatcataagacatcaatctcatttgatattggtagtatttgtaaaagtgaaaataatggtaccttacaatacagagaaacccctgatttctaactttagttttattgtggtaagatatacatttaaaaaattaccattttaactattttaaatggtttcatgttcagcattaatgtggcatgaatgttcagtggcaataagtccactcaaatcgttgtgcaacgccatcgccagaatattttcattttcccaaaccgaaactctgtactcattaaacaataccttccattcctctccctacttccccagacctctggcaactaccactctactttctgtctctgtgaatttcactactcaaagtacctcataaatttggaaacatacaatatttgtccttttgtgtctgctttatttcactcagcatgatatattaaatccatgttcatccatgttgtagcatgtgtcagaattgtattcttttttttaaggctaaatgctatttcattgcatgtgtatatcaccttttgcttgtctgttctgatgggcatttgagttgtttccattttttttttttggctattgtgaataatactgctttaaatattggtgtgaaaatatctgtttgagtgcttgctttcaattgttttgggcatatgccaaggagaggaattactggatcatatgtgaatactgtgtttattatttgaaaaactggagtactattatattttctgttgcagctgcaccattttacgttcccaccagcaatttacaaaatttgcaatttcttcacatctttgctctattaatctgcttaggatgccataacaaaataccacagctgggtggattaaacaacagaactttattttcccacattttgtatcctagaagtctatgatcttaatagagcatagtttctagtgaaagctttctgcctgacaccttctcacaatgtcctaacatggcttctccccagtgcaaaagaggagccagagagagtcaaggatagagacagagacaagagagaccataagagcaagctgtctagcatctgttcatgtaaggacacaaatcctactggaacagggcccaagtcgtatgactttatttaatcttaattatttccttagaaactctattttcagatacagctacactggatggaagttagaggtacagaatacgaattttgggggaagaattcagctcataacattgtaccattgcccctccccaacaaatttattttttcctcacatgcaaaatagattcgttccatcccaagagccctcaaattcttaatttattccagtatcaactctaaagtctaaggcccaaagtcttacctaaatattatctaaatgcatgagattcaagatgtgattcatccagaggtaaaatttctcgccaggagtgaacctatgaaacaaaaaatgttatatgcttccatagtacaacagaaagacaggcataggatagacattctcatttcgaaagagagaaatagaaaaggaagcagcaatgggtcccaggcaaatccaaaaccaggcaaaagaaatttcatgtgatagtaaggcttgagaataattctctttggtttgatgctctgcactcttggccaacttggaggcagcatcacccatggctctgtgggcagccttttccctttagctcagtgaggcagcctcttccctttagctcagtgaggcagcctcatcaaatgactctcagaagaggccctgctaacatggctgttttcagagatcatctgcagggacaacactgtttgaagctaagcaggaagcagccttgctccctggacctgtagtgggcatgggagccctcatgatctctgaaacatttggggagtcattcttcccttttcttgaaagataaagcatgtttgaagtgaaatatctctatcatgtcattctgaagagtctaagaagtcggacagccttccttcacttgggtctgttttctctgtccactttagttcaaactggcagtacctccactgcataatcacacctctatttctgctgagatgtatgattaaatccataaatcatatccatggtgtctttatctaatggttgttcagcgacatccttaggattctcttttgaaaatactttctcattttctgcaatatagatgggctaatgattgtgtaaatcttcaagttctggttcttccttgcataaagatttcttcaattgcttgctctcctcttgtaggttactataagtgatgaggagaaaccaaaccactccttcaatcctttgctctgaaatctcctcagctaaatttctatgtttgttattcacaacttctgccttccacaaaacactagaagacaaggcagcagccattttgtttgctactttgtaacaaagattacctttcttccaatttccaagaacatgtccctcatttatatctgagaccacaacaaaatagactttaatgcccttatttctatcaacactcccctcaaggcaatctacactttttatagcatgcacttaagaacttccagtctctacccattatccaattccaaggctgcttccacatttttaggtatttgttgaagcagcatctcagttcttgataccaaaatctgttttagtgtgctcagtctaccataacaaaatatcacattcctgaatgacttaaaccacagaagtttattttattgaattcacaaaggctggaagtccaagattagagtgccagcatagttagtttcttgagaggattctccttctggcttaaagactgcttcctttcactatgttctcacatgtgcccattggtaagttacacaaaatctaaaataaaatccacttgaaataaagcctacttaaatttgatgttaaaagccaatgaagataaagcatataaaaaagaggcataatcacagaaattaatgcagaaatcctaaataaaacactagtaaatagcattttcttttaagattgatacacttagacacaaagggtatgtggcaggaatccaggagtatcttaacattaaactaatcatataatttaccttatcaaaggattaaaggataaaaatacaataaatatctagaaagctaaaaatctaagaaatttgtggcctggattcaaaccttctatttcctatataagtcaactaacacactaattttatcacaaaagcattatctcatcgctgtggtatattaactgaattccatcaccttcagataatcttgatttgtctccttcaaagtgaatcggtgtcactttcaaaatagaacacgttttatcaaaatgatttctctcatttcctgtttccaggaatgaagacaatgaaatcagagaaattcgctttcatttgcttaaaatttaacacagtagaatatagaaacattttacattccaccagttatggattcctctcatgactagcaaatggaggagctaggactagaacccagatctgaatcctagtcaagtggtctttacacagctcttaatctttcatatgcacttgagagatgggaacttcatttcacctaatgttctaaaaatcagaagcagctgagcgcagggaagggcaagtagcagaatacagggttccaagcagaatgaactgaacagcaagaacattaatgcgaaggtgagtaagcccatgacagcaggcccagtgggggaatataccacaaggcttttccagacattttccgacattttctgtagccttgtataaatacattagtatgttcatagaaaaattttgtaaaataaaagctctttttctacaatcatttgtgtctgaagacctaatgaaaaaagtttcattttcaatttttctttgctatgagttaaaagaataaatgaataaattaagttcaataatcttattaccaattaatatagagagagaacatagcaaaatagatgttcagctgcatttttattaaaatcatgtttcaggttatgtgctccattagattctgagttcaacagggtctcttacggaaaatactcattggtagaaaatgttagtaagaacctgcaaacaaagaatctacattataaaatttttatgcccagatagagcaatagttttagtaaaagcctaggttagccgcagataattaaaagccatatggtgtggagagattggcacccatgcatgactctctttgtaaagagaaaacaatattttatctaaaagagtcatacaaacatgttctctaatcaagaacatgaacagaaatgtgaggaaagtctctaggactgtgagaaagctacccaggctcacataaggcagggagggcgagtgagaacaatcacacttactgaaaacatctccttttgaaccacttaaatatttgaatgtttaatcctaccattcacttatgatgtagaggacagcgttgttgtatcccattttacagctgagaaaatgaaactcagaggcataaagcaaacttctaagtataccctacccaagaagtaaatgatggaatttaaacctggctcacttttcctcaaaaaccaactcagtactctacagtatgcctgttcactgaccgataagaaaagtttcttccaagctttgatttttatataaccaccaagcagccttcattatgtaaactgataagttatcttgtccacataaatttgatgagaaggggagaatgagccagcgttgatgacagccactcatgtttcgttccaatgagtcatggagaattgacacagagttttgatcatccctgagtatactggataagatcagagaaatgaatcccatgcacagtcatgtacggcccatgtacagaaaggcaacactcaagtcctctttgaacatcagcctgttcatagcaaaatgatcaacgctaccttttggacctttaccctctctctacccatctctcctatcccagagaaaatgaacattgggttttgttaaaattagaaattacatctagaagcccaacttactttcaaaaagaaaaactgacaaaaaatagagacaatgtcaatcatcaagtcatcctccccgtcagctgattttctccacctggtttccattgtgtgcagctatgtgcgtgtacatgcatgtgtggtatccagacacgtgggagtccttttgtttctatgacttcttattaagccatgcccaaagtaaacctaaaagcaacatgtttacttttaatcatggatgacaatatggatattatagtcatttagtaaaatatttaatctgtaataaaacaactctttatcattgcagattgtttgggccacatcttacctgattggctgtgccattgcatcttgccgccaacaaggatcacctcgatatctctacgtttgtcactattgtcatgagtatgtattattagtttttaaaatatatatccccctaaagtaacctaatctagtttttcaaacattgtttttttgtgtgcataaatgtttgtagcaactttattcataatagacaagagctggaaataacccagatgtccttcaaagatgaatggttacacaatctgtagtttgagtcttgactacttcctagttatgtgaaaacacatatttagttatatattattttattcctttgactgtattttctcttatttaaaaaaaactccaatatattttcagagcaatttaccagcagtcttcctatgtgtcattgattcttcaggtaattattatataagagaaacaaatttgattaagcaaagaaacaaggacatttacttcaacaaaacaagagtattgttagaccaaaaggacagacatgcagtggagtcttaacaaggaaacaaatagaaagagccaagtgtctttccctgtatttagctatctagtcaaaaagttgttgcatgtcttctctttaaaaattaaatatacatgttacagattctaccacagatactagtcacaattcctagaaaatttaatctgattgtttcagtaaggttctgctgcaccttcttctcctatcaactgtgattatgaagcaagatcaagtaagacaaggatgactgcagggcccaactgtgtggctccagtgacggttatcagaaaagtgaagattattcagagctggatagaactgcctgatatttgactacaaatgccagttcaatatcacttctgcacttctgctgataaaagtcagtgacgccatcatatatctccttcagctacatgtatttcttagattaacacataagtctttcctacataatgtgaactcaatgcatggtgcttaaccactgcctcccatgtatgtagcacaatacaaaatgttcagtataaatcaatgaacatgatttatttgaaaacacactgccatacttcacattttcagtggcgccaccactatcactattgattcagagtgtaatatcaccatataataactctatatgagttatatataaattgtgctgaagacaataaaatctctttgctgctacaacacatcatttgtgatacatgttttcaagggttggtagtctgcagtgaacttcaactgatccaaaaaagaaaagtacaaaacatggagatctatgatggggaattttcttggttgaagattagtccaagtctctcattaaatctcttactgaatttagtaataatcttcttttcaaagtgaaattttagcagctcagataaacaaatatcatatttaaaaaggctttttaaaaccagaacatttactttttaaagttgtatttagaagcagatattatctacattatgtttttagacatacatgggtaagaattgtcttttcttttttgtttttccttttgagatagggccttgttctgtcactcaggctggagtgcagaggtgtcaacatagctccctgtagtattgaccttctgggctccagctatcctcccacctcagccttccaagtatctggaactacaggcatacgccaccaggcctaactaatttttttttttttttttttttttttttgtagatatgaagatgctttttttttgcccaggcttttctcaaactttcgggctcaagcaatccttccactttgccctctcaaagtgctgggattacagggataagtcattgagccctgcccgtcttttctaaagtttcaaattagtccagaactagaacttctcatctactttctttcccacaccccagcactttagttttatccatgctgatgtactttcatcttttatatacaccatctctttcaataaaagacattaacatgtaaaaagtttcttataacatagtgcaagatggagttagaacctctctaacttgcctcacttgagattttcttcttaacattggtaagaatcatgcccttttaaatgatggtttaccaagtccttataggtattaatgaagaatgttctattgtaattggctctaaagccctcttgcttgtgagtccccttgcttgtacttgggagtacccaaagttcccaagtactgttaggacttgactgtccaacgagatgtgcacattgactgaaaaatattttcatgtcactcacatttattggttctacgtgctaaaaaatattatagctgtaagattggaaatctcacacccatcttaaaaattatcactgttctttacaagaatgtttacacaatttgtttttaaaattggttgtacactgtgagtaaagttttatgtgagtttttcaaagatgggttttatgaaatcacttttttttattcaaggggaaatgatcctgaaacaaagaatgaaccttataagacaggcgtcccatgtgaagcctgcccaagtaactgtgaagacaaactttgcagtaagtttgtttgcattctgtttgtttacagttaacccattgatctgggaaccatacatcctttaaattaagcattaaaaaacatcgcacttttctacaactttcatctcattcatgtacaaattatttctgcttacccctccccaattgccagagtgactgaaaaccattgatttaacctatggcaaaggaaattacaaagtctaggtctgagaactcgagttcccacccaacagattaaaatatttaattagggtcaacctagataaaatattgaggtaagtgtagatttttctctgctctctaaaaagttcttggacccccttactgcaacccataatttaggcccattgctttcagtttaccggtgttctccaattgcttgcccctccatgactacctacccaggttgcctgaccacttattgtggcatgcaatttttactgagtgatccttattcttctttggttcctgtgaaccatctaaaaagttagctgatgctcacattattccttaaagcctcttttttttttttaatttcttgaataaatcttacctaaggtaaagctttagccaaatgggtgccatttctgtttattcccttagatagccaaatttcactttttgaagcctacctgcaaacataatttcttaatttctaggaataatcttgattaagataaattatactagtaataagtctgtggagaaaaaaataaacctaagaaaaatatcctgtgacctccgacttgaaaggccacttatttttcttcacctaaccaggttactttattgtcttttaaagtaagaaagaaaatggattcttcttcctccttttacctttctctcgtttctcttctcttgtactcttttatttacttctctatctgtctccctctctctttctctgtatccacttcactttttataccccgtttctggaaaaaaatgtagatggagagagattcctccccaccgggaaaaaaaaaaaaaaatcaaccagttacctatgccttagcaggagaagggatggcaattgagtagatttttagaatctaggtgagaaaagcaatgtctgtggtggtataacaatttaatagaagtaaaagaagagtagggaagagaaatgttattcaagaagattgattatatcacatagatgatgtatatcataagccctttcttcacctgtaagtgtttgagaaagtgagagctattaaaggaatatatgaacttaagaattgaacatattgggcacaaacaatgctaaaaatgtaagacctagacatgcagatataattcatttaatgtaattcaaataaaatttataaaaataattcttacttataatattaggaaagtatataaattaagaacaacagataaaagaaaacaacggattacaacactttacagattcaaagaaaatatatgttactgctaaagaaaaaaaaatccactgatagtcatatttcaccagaatactacataagagaataaagtaggataaagataggtaattgattttttaaaaaaaatgagtaatgactttggcaaattactgattgtaggaaaaagaagcagagatacactatcaaatatacaattgctctggcagtaatatgacatccatatttcatctccttgttgcaccttgataaatctactgtagttattctccaagttcctggaaggtgaatcagtttaataatttaggaagaggaaaatgtgtatagcatagaaggatattcactaaaataataaacagtaagacataaatgtaaatttaaaatttgtaggccgggcgtggtggctcacgcttgtaatcccagcactttgggaggccgaggcgggcggatcacgaggtcaggagatcgtagaccaccctggctaacatggtgaaaccccgtctctactaaaaaataaaaaaaaaattagcagggcgtgatggcgggcgcctgtagtcccagctactcgggaggctgaggcaggagaatggcgtgaacccgggaggcagagcttgcagtgagccgagattgcaccactgcactcctgcctgggccacagagcgagactccgtctcaaaaaaaaaaaaataaaataaaaataaaaataaaatttataagattgttataaatttcatgcaatgatcaaactttataattgaaggataagagatataatgggaaaatttaaatttttccattgtcaagattcaaattcaggactgcataaaggtcagaaaatcttaaaagagagagggaattaaattattgttatttttgcctttatatagagacaaatagatacattggttagttgtgatagagaattcaggtcaaaaaatattttggtaagctttttggtgctattgccacaaatttaaaattttgggtatcttcatactgattggagaatttcgtgtgcatttctgcctctgtatgtaccaggatgtaggtgcgtgcacatccatgggatagagcaaggtgagaaaaatcactagaatgttagttgagataacctctgggtggatggagagattatatatgccatcctatatgtgctttttaattccattttccattggctatacattacttttaataatccaaagcaaatctttaaccattaaataatgcagcattagataattagacaaaaaattatgaatattttatattgcaatggcatagttaatactttcaaaatgacagtgtaattaaaaatatgattcctctccaatctgtttatattggacttaaaaaattgtgataaaaacctgttttacacaaagacaaaaattttacctttttcttttcatacatgatcttatcacctgttttgcattcagatttagttagcttatgctaattaaatttagttagcaattgttaataaaaatttctctttttgtctttaataagatggtctctttcctcagcaaatgcgatttttaaaagactgtgttgtaaaaccatactattttctttcagctaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaacagagttcagtctcatcttgcaaggtaaatatcatttaattggaagtagtttaaatgtctcattgttttattgacacatctatatatacatttgtgaagcaagaaacaataaaaaagcttcgtatgccattaatttaacaaaatatgtattcagtactgattgcatacaagatgcatgtttatatatatggaaggaatatagtttcatttcattgcaaaggcagtataaaagatatataaaatagcataatatgagaaattaagtccctaaagacatataggtcacatattattattgccagatgagcataaatagcttctgtttggagattcaggaaagccttagggtggaatgaggaacatcttctgagtaaacagggttgcaaaggttatgattatttcaacacaatggaagagcacagttaaggccaactaacgtaaaatgcactgaagccttagggaatattgaagggcctgacatggggaaagggaaggctagaaatacttggtcaaattttaacattataccaaagttatacccagttctacctacttgtatatttctttactcatttcaataaagtgtttgaaaaaaaaaaaaaagacatcacccactttccaaaagtaaacaggtaagccatacctcaaacccattctgcatcatacagaggttctcgtcacaggtacaaaaattctgtgtggctccaagaaaagaggacaatttgagaatgacgccctcttgacatgacccatgtctttccatttagatctatgggcatttctcccatgtaaatccttcagacccattctcactttttacttaaactacatatgttagatctatccacttgattgtatctatcttttgagtaattgtcattagcacaatcatggacatattaacatcaggagaacagtgactcatcctgggacacagtaagtaggctggtactttatagccgaaatatttaataaatggaactcattacaaaaatcaaagtaataatttactctaagaaaattaaatgtgtgtgctgtagaaaatctttactcatttttgcattaccaggtattgtgatttctcttacctcaccaaggtagcattagattttagaataattaaattagagccctgagttctgaattttgcatgctagataaccaactaatcctgcagtctactgtaacatattggcaggcagtgttactgtattcttacactacaatatgctctttctagaaattaacatgatacttctcaaaatttgcattccaatcacatctcttcccactttgcataagagtaagcatattcaaatatttcttaagggttggggaaggaggcggaagggtatgcctacgtctaaggaaaatcaaataagcaagtaacaaaactttgacctcatttgtctacattacccaaatttaaataatatgttggcttatctcacaataaattgtatttgttaaatataaaaagtattccccccaaaaaatatctcagagcaaactgactgtgtgaaaagtaccctgtaatgaagaaggttgggggcggtggatgacctcatgtacaccattcttctattatctcaaaagctttcagaatcacacatattgtttggaaaatcattaaaaaagctattttagatgacagagaaaaaactcttatttaccatgcaacatctttctaaaaaatggaaacagtcttacacctctttccaaatgttattgaatatagaataaataataacaaataattctgaagcagaaacaatatccagtggcagtctgtactttcacagtagtaaaagaaaaaaaatagttctaagtgtgtaatacaaagattaagagcatgagcagaggtgtcacccagctggtttgaattcaggacacaacatgtgcttgctctgtgactttgaaaaagattatttttctttgtcctcatctataagttatagtaagagatagaacctacttcataagtttgttttaaggattg

SEQ ID NO: 13361 - DNA, 25199 bp, Human
ggaattgttaccacacttatttttgctgccatcaatttctcagctctgtaaatcaccccatgcagtgagatcaggtggcttttatgaaacattcttttgatcaaagaatttcccaaccctccaaaatgtcaatgaaattactttcccatgttatacagagaagcaaatctccttagacttctatacaaagtttccccaaccttttcaacagtctttctgtcttgaatatgccttgtgatataatgatttatctgcttttgttcttcaactctttctcccttcaaatcaagccatacgcattattcaataacagttcaaatgtcaaaactttcctaggttttacccagatcatatcaactcacagaactctcaattactgtatatatttttggtcgccctacttagcattaaactacactacctaatagtattctttacttattcatatacatactcctttctctcatagtactatgagtcttagaagaaagagattttatgtccttttttctgtattttctaagaatctatgtcgggtcaatatttactcacttaacaaatatttacaaactaccacctatatttggtattgtgttagttttggagatacagcaataatcaagacagacatagccaatttctgaaattcaggttcaccaacaatatctggcaccacagcgctcaagttgctctcattctgatatcatcaatgtgaatatgggaacaagtaataattacaggaatgactcttctccaaaaatgaaaaataagatattcacagtaaatgatagactattatagtgctgagaatgaattgttcggcactagaaagaaagaacaaataggtaggcagagattttgtgcatataggtatttgaaatgtccaattaataacttaagcaagatatggtgaaaacatgaatatagaagtgagggacagattgaggactagatttcataaatatttagaaaggcaaactgtcagtaatgaattttgatattggatgtagatataagcgttaagcagtctaaattccaaaatttttagtcagtgctgcatgaactgaaataagcagcaaaagaaaactaaaacaatgtctgtgtgctgatcccttgaaattaccttgtaacactgccaaaggaaaatggcactgagcaccaagtttgttatagtttcagttgtgcccaagtgagtctccagagttggtgaaatctcaagcctcttattgcatggcttacagagaaccaaggtatgacggatattaatccttggcttgacatcttttgacccatctctcttcctctaggtcataagcgaattcactccttttcgctttgaaaacaactgtgaatagaagaaaatgcacctattactcatccgccttctgagagagaaaacatgtctttaacccatgcttgatacgtatgataaacttgcagccagtagccttgggtcaggagttctgcgtattttcataagagttgttcctgttactcttcgtgaattttctcaccataaaactgttgccaacggggaagagggacaagaacatgaagtgtttatgagggagcctgaaactgacaacctgtgtaactggagtgcgtcgttggcatgacactggcagcgcactgcaaacttaagcacctgtggactcctaattagctctttaaattgaactacattaattcaggcattcttgtttgaatgcgaacgcctcctttttcaagccaccccctgggcaacccgaatccttatatgacctccctcctcctcctagtacggcgcaggtatgcgaacagacattttctttcctcatcaactggtggtaatgagaaaaagagaactctgcttttcacaagggaaaacgtgcaagattttctccgtagtaggggaggcgggggcgatgggaggagagcagctcacgtaggcagatagcggcgatgaaagcataaagcccagtgacgtcgcccacacgtggcgcctggcaagtgaacaatcgcggtgagaggggcgcgccgcagctcctcaacgccgcaacgcgccggcccaactgcaggaaggtctgtgctctggagccagggtaaatgtaagacccggattggagactagaaatggctagggacggggaggtggggtgaagcacaggggagagaaccatcgttgaggtgagggggtttctgatcctccttcgctcctcttccggcatctggagggcacatagctaatgccgggcagactgagagttcaattttgttgcttagcgccgacctaccataactttcaacatgcttctctatgtttagtctattgaaactctttacctaccttaaaagagaaatcattctaagtacataagacccattgaatcatagtagaagcctgaagtcatttctcaatctgctttttacgaagtcaaattaagactcttagtttctaattgatgttttgaatgtacagttattagaaactgtaataacaattagagttggggtcattgactctgctggactttatatcatctattggcttccagaatttaaaaaaaaaatgaagagacaaagctgttacccccaaatccacgtagttaatacttaccatgtgggacactgcttatggaaatgatcttttaaagaatgggttgaagtcctagataaggggttgggagtcttgaaaaaaggttgcaattttccaagcaagttagccaactagtagttactgaacttcaagaagtccacttttttgttagtgtttgaaggaaatatcagggcgttgaaatacaatctgacctcagaaggacaatatggtcttaacgctgaaatcaaataaatacagtaaattattagaaacaatactaaacaattgagtcaaaatttaagtttgtgacaaagattatagataccatctataagggtattcttcacatctttattttaaatattttgtttccttgttctagggttataaaattatacaccatggccctcctaaagacactctaggaaaaccatgtcatcctgatcttaaaacacctgcaagaaagagcacagtacttcaccattagtaagtagcaaagaaaaaaaatggtagccaacttttcaactatatatcaatatgggtttaaaggaataaaatgtaattatatggaatagaaaaaaatatttttccttgaatatactctcaccaacagtgacattgctttcattgactcaatgaagatgagtataggttagatggttgaggttatgagagagaagagcagcaaagaggagagtatggcatcatggcctattatagaattctggctcatcagatgcatacactgggtgattgagctatacaaaactcttcaggctcctgtgtatggctttcaatgagctgatgaggatacaacagcccagatgttagagcattttcctaaagtcagccagaaggtgtctaatagaaccaggccttgaacatgtgaatctcgaattagattatactgattgtattttcctataacacctggaaggaaacacatgtctcttaaacacttagtaattagcaattcaatcaaacagcatatgtttatagaaagctcttatgagctcaacaaactagcagacattgcaaaagataataaaaacatgaataatttccgtttatttgtattatgtgcataatgtgtttattgtattagaggtgttacatacattgtcccttccagtcttcaaagcaaaaacctgtgatataaaaatctacattttacataagaaaaacactgaagcttggcatagatttcccagacctgatggtttccaaagaatgcacccgtaaccaataagctacaggtagttgataattagaaagtaaaaatcatagacagctgaactatgagagttcagctataaggcagaatcctggtaaccttcacagtagttaacctgtcttgggttgtcaatatagaaatactagtccaaaaaggccacatgcagattatcgtgtgcctaaggagaagggagaactgattagaaagggagggcatgatttacttactcatgttaaaaactatgtgggaagcaaataatgtcaaaagcattatcagacaactgacaatgaagtttaaggttactggtatgaaaaatactacttcagaactttgttgacttagatttatttaacaaaaccagagtttgacaaaacaggaatatgtgtaatatatatgctgctctaaaccttccaccttctttctttctaaagataaagtagatatttcatcctgctcagaaaaccaacagtaagtgttaaatcattgattttaatgtgaatattttatcatgccaatcatttttatgttgtcaagggtaaaatgattaatgagtttgcccatgattttatttttttgttttttgtttgtctgtttgtttgtttgttttagagacagggtctctttctgtcacccaggctggaatgcagtgctgtgatcatagttcactgctgcctcaaactcctaggctcaaatgatcatcccacctcagcctcctgagtagctgggactacaggcacttgccaccatgcccagctaattatgttttgtttttgtttgtttgtttttagtagagatgaggtctcactgtgctttccaggctgatcttgaactcctgggctcaagttatgtgctctcacctcagtctcccaaaatgttaggattataggaatgagccactgtgcctggcctatccatgattttcaaaactttaataaatttgtattgagaatgacctcaagttaattttattcttttacagttaagaaggtaaattacagcaatattacgcacacacacacaaaaatttgatatgtaaaaattttttacattttattctaaaaataagtaatggaattaattctcatgtttgtgacttgaaacaattatactagaactacctttaataggaaaatggaaaagtatggctgtttaagtatattgtataagctggcatattaatgattttactattaacatatacagttatgtattaataagggaattattaaagtaaaaataaagggtctccattgtgctgcaacaatgtctgccttttcccaattaaaactgtgtctctttcaatgagtcaatgtctctttcaaagtcattgacttcgaagtcataattggatgaagactaatttctgacattacctaagaacgtagcattggcataggttaattaactgtcttaagcctcaattacatcatccatacaatataaatagtaatacccagtaaggtatgggagtgaaattgtatatcattttccatgaaccgtcaataattgttcatccctcatcccttttttgcacataattgagcataaaggcaatggatggaacaagtatcaatgatacactatttacagtaagtgaagcctgagaagcatcacagataaattgttcggaattttctttctttccaagaatttgggagtgacagtctcacacacaagaaacaaatctaggcagcataactttaatttacaaattaaacaatttatatgactaatgacagaaaggtgagtgtttccaaaactaagtggtcttgttgtttcatctgaaggacgtgagactttttgacatattgagaaaggacaacatgggtaacaaaatgctgagtgtctttttaggagataatgaaaatacgaaacaatcttcttaccaaataatggattgagtaaacttgaataagctatatcttcaatgcattaattgtattttttgtatacagagaaatttgaaaatattcacaagtataaggaagaaaataaacataacttctagttactccattagggaaataacagctaataaagtatttgcacaaccatatctgtgtaatcacaaccttgtcatcttaattagagtctggtataaataaaaggacaaaccgttttacttttcgtatagaatagccaattgagagatggtacatattgaaaataaactttcctccaaaaattgagatgaagaatgaatgtcagtactataattaactattaaggaatctattttctttttgatggcgtaagggtaacagaagtaggcagaaagaagggagtaggtctctctcttttatagatgtacctcaagggcatcagtagagttcttcagctttttctttattgtcactatcaaagacaaggttggcctcattatgattctactagtaccatagggcaattcttcttttgttccattgttaatgaatctgggaatcacagttcctttgagataatcgagatcattatattggtattccccctcttagaagttttttaaactacatatttcaatgcagacctttgtttttcttgacttagtttccagcaatggctttactaccggtgttgtttctggttactgtgctgcttccatctttacctgcagaaggaaaggtaaggttaaaatggaaaatcttttcagagctatccagcaactttgtggtatggcaggctattctgaaagtaaaggggggtaagagagtttggtatgtcagagtttccactggttcagagttctcagagcacttaacacaattattgagatgaaaggccaaggttatgctgtatgtgttctgcatgtgtatgctagccaccggtcacatgtgactactgaacacttgaaatgaggtttgaacaggcaaaatgtactctgatggtaagaaactcactagatttcaaacatttagaacaaagaaagaagaaaatatctcatttttttaatattgcatccatgatgaaatgataatattttggatattccattaaataatatattaggttcttagggtggttgcaacaaattatcacaagctaagtggcttataacaacaaaaacttattctctcacagttatggaggccagaaatctaaaatcaaattatctcctgggctgagctccctctggaggatctaagagggacctgttccatgcctttccccaccttctggtggtctctgccactgcttggcattccttggcttgtggctgcatcactccaatctctgcctccatctttacattatcttcccttctctgtatgtctcataaaggcacttgtcattatattcagaggcaactggataatcaaggctaatctcatcctgagatcctgaacttaattacatctgcgaagactttttccaaataagaacacattcacagtttctgagcattaggatatggacatgtctttttggagtctaccacctaactcattacaaataaaatgtattatttaaattaatatcacttaaaaattaaaattgcatatcatgtttaaattatttttctagtaaacactggtctatggggttagaaagctgatgatagtcctcttgctccaatctattttctgatttccttaattttatttctttttaatgagatccctatacaaaattaacaatatacttatataatattaaattagcacaatttctccactatattaacacatttaatttgtatagttagggtataagaataattagatttatatttttaattaagaaaacaaaaaccctaactctaaaagccttagtgctttgtttagtagtgataatagagttagtatgtgaagggccaagaggattttgaattcaggtcctagagttatttctaatatgctactttgttgaattgaccccataatatggtcagcaatcttcaatgataaaatgtgcagtgctcacgtgcagtgtgtatctcctgagcaggtagcctctgaaacagctttggcattgctgtttcttgtcatatcttccattaactctgtgcacattagactcgctaggacttttcagactggaggactctgacactcagttcaaacttcatttggcattcagaaatatagtcattgtattactgtaattagattatcaatgtgcagataattcattcatcatctagggcctcattcaaataatttgctgttcttttcatttctttccctgaaagattttctttcatacctgtttccaatcccctgtaacatctcagctcatctcctggtcttcatttataaaattattaaaaagtgagatgtcattttgtctttggcaccactaaatgtttgaaatcagatgctctataaacactctgcccagtatgattttctgatgttttcaagatgcctagaaaactctgttcatctttcagaaccccagaatcacattttatgaagctttctctgacttcaaagaaaaattgatccctccttcctccctatcttgtagatcattaagatcagttttgttatcatgtgtattgtaatttttacttatgtcacgtcacttattcaatataaactctttaaggatagataccatatttattttattctcgatatgtttaatatttctagtcatgtaataactttattaacacatttaaaaatacatctctttttcagtacaatttttatctacaaagcaaaaaggtgtaagaagcaggaaataatttagaaattaactttttatgtgttttgagatgaaaccacaaaaaccagatttttttaggtcgagagaaaatatccagggatgttattttatgctttgatgtgatttagaaatctgcctttactgatattttatatgcacatcctttctaacttatgagtcagtaactttgccatatttattggtacagtggcgtccacgatcagtccctgttcttaggaacataaaagcaggaaagagaaatgtatatattgtagataatggcaataagatgctcagaccaatggtgtaagtattttgagagacttaaatgaactcagtatgggaggagaggaggataacttattgcaaggtgtcagaaaaaatccatgaggagccctgttcctttcagacttatacttcaaaatcttgcccattcctatataacatcatattcttgtgtaaatttaggtcatcaaatgcttggacctttacccaggaattttcacatcctattccacctccaggcttagcaggccccataccatacacacagacaaatatacaaccacaaagataaaccaaacatattagcacccaatttaataccttatcagttatgtttctgttactaaaaggaacaaagtcagcaatagtccattcattagatagatttgatccctccaaattgctttaaattttttttagttttacaaagttatcttttaagcaacccataaaatttgctacataataggtataatggtttcactatagtactgaatgcagacatgcacttcaactgggcctaaacatttttccttaaaggcagataccatgtcaaggaaaactgccccataaaatttaagatgaatcatgggctccagctttaccctaccttgcagcctgatcaaatgtgaatgaatatatctcaaggttttaaatttgtatgcttgtagttataaaatattattattcatatgtctatacaaatcatattaaaagttcccttgctgggggaaatggcagataggaggcaggactaacttgcagttgccacttggataaacagaacaatatgtggagattcacatcatgaacttttgtgccaagaaccactgcaggagcatggcaggaaaactgaaagaattcacagaccatttgaaagaagtggcttgacgctacaaactctgtgagatagctgaaacactatgagggcccaaagcgtgagggaagaaaatctgcctctaaacacacatcctcactgaggaagctgaaaatccagatcatgggagaaggatttaaccttacttaaggctgaaatgaatttagagagccatgcaaaataaaaaagaagaagaagcagtgagaagagccctgtaggcactcccagttcccacagaagcccagggaagccatttctgactttatctcacagagatcctcaaagaggaaagccagtggaattagagaagggccacagggaggagacttccagctgaactttgtaataattttgaccaagtgcaaatttttctgggcagatctgggattctgaatgggaagtacggatatgagtacagaagctgcagtaggtgggaagtggggaaaggcctgaaagccctccttagtctctccttggggagggttgtagcctggaccaagatctcagacttgcacaacagaggcttggatataaattcagctctattggccattgagggagcacagcaggggtgagattggccttgctggctgactaggagcttagtgaagcctgtcacttctggctttccaccacttccctggtgacctctatgaagcagccgaggcagccatagcccccttggaacataactccattggcctgagaaccacacccccatcttgcacagtggctgcagtaagcccccaccaaggagagtcagagttcagatatgcctaatcctgcccacacatgatggtctttctctacccaacctggtagccaaagacaaaagacataaactcttgggagctctatagccctacccatcacctgaaaaacctgaatacttatccaggtgaccttagggcaaacttgtatccccccatactaccacagcttacactgtcttgaaaccaactcgagctgttacagcaactcagaacaactctactccaaggaaagacaaaacagcagttaattccactgcctgtaacatcctggctaaccagaggtcctgagactgtccacatgacaacttcactattagcataaccaacattcaagaaaaccagtgcactaaacaaaactacagccaaggactctcacagagtccacttcactcccctgctacctccactggaacaggtgccagtatctatggctgagatacctgaagatggatcacatcacaggactctttgcaggcattctccagtaccagcctggagcccagtagctctgctgggtcgctagaccccgaagagcaataacaatcactgcagtctggctctcaggaagccccatctctaggagaagggggagagtaccacatcaagggttcaaggcaaaagaacctgaacagcagcccttgagccccagatccttccttggacatagtctacctgatgagaaggaaccagaaaaaaattctggtaatatgacaaaacaacgttctataacatccccaaaagatcacactagctcaccataaatggattgaaaccaagaagaaatctctgaattgctggaaaaagaattcagaaggttaattattaagcttctcaaggaggaaccagagaaaggtgaaaaccaactcaaaaaaatttaaaaagtaatacaagtatgaatgaaaaaatttccagaaaaataaatatcacaaataaaaaaacaatcacaactcctggaaatgagacacacttagagaaatgcaaaaaatactggaaagtttcaacaataaaatgtaacaagtagaagaaagaacttcagagcttgaagatatggcttttgaattaacccattctaacaaagacaaaaaaatgataaaaagaaaatgaacaaagcctccaagaagtttgggattacattaaatcaccaaagctaagaataattgatgttcctggggaagaagagacatctaaaagtttggaaaacttatttgagggaataattgaggaaaactttcctggcctctctagagacctacacattcaaataaaagaagctcaaagaacacctgggaaattaatcacaaaaagatcatgacctgggtacatagtcatcaggttatctgaagtcaagatcaagaaaagaatattacgagctgtgaggcaaaagcatcaggtaacctataaaggaaaacctatcagattaaccacagatttatctgcagaaatcctgtaagccagaacagattgtagtcctatctttagccatcaatgtacacaaatcagtagtactgctatacaccaacagcaaccaagatgagaattaaatcaagaactcagtaccttttacaacagctgaaaaaacaataaaatactttggagtatacctaaccaaggaggtgaaagacctctacaagaaaactgcagaacactgctgaaagaaattataaatgacacaaacaaatggaaacacatcccatgcttatggatggataaaatcaacattgtaagaatgaccatactgccaaaagcaatctacaaatttaatgcaattcccatcaaaataccatcatcatttttcaaagaactagaaaatacaattctaaaattgatatggagccaaaaaaaaagcctgcatagccaaagcaaaacaaaacaaaaagaacaagtctggaagcatcgcataaccccactttaaactatactacatggctatagtcaccaaaacagcatggtactggtataaaaataggcacatagaccaatggaacagaatagagaactcagaaataaggccaaatacttacagccaactgaccttcaacaaagcaaacaaaaacataaagtgggaaaaggacaccttattcaacaaatggtggtgggatagttggcaagatccacgtagaagaatgaaactgaatctttatctctcaccttatacaaaaatcaactcaagatggatcaaatacttaaatctaagaccaaaccatgtaaactctagaagataacatcagaaaaactcttttagacattggcttaaggcaaatgtctaagaccaaggcaaatgtcttatgaccaagaacgcaaaagcaaatgcaacaaaaagaaagataaaaaatgggacttcattaaactaaaaagcttcctcacagcaaaacaaataatcagcagagtaaacataaaacccacagaatgggagaaaatcttcgcaaactagttatccaactaaggactaatatccagaatctacaaggaactaaaacaaatcagaagaaaaaaatcccatcaaaaagtgggctaagggcatgagtagacaattctcaaaataaaatagaaaaatggctgaccaacatacgaaaagctgctcaacattattaattatcagggaaatgcaaatcgaaaccacaatgaggctaacactttattcctgaaagaaaggccataatttaattaaaaaaataatagataccggtgtggatgtggaaaagggaacacttttgtactgctggtgggaatgtaagctattacaagcactatggaaaacagtatagaaattccttaaagaactaaatgtaaatctaccatttgatccagcaatttcactactgagtatctactcagaggaaaagaagtcattatatgaaaaaaagacacttgcacacgcatgtttatagcagtacaattcacaattgcaaaaatatagaaccagcccgagtgcccattaatcaatgagtggataaagaaaatgttatatatatatatatatatatatatatatatatatatatatatagtacacatatatataatgtatacatatataagtatacatatataatatatataatatatattacattatattaatgtatacatatataatataaacttatatatgtatacatatataatgtatacattaatatgtataatataatatattatattatatatattatatattatgtataatataatatattatattacatatattatatattatatataatataatatataatacataatatataataatatataatatataatacataatatataataatatatattatataatatatattattattaatgtatacattatatatgtatacatatataatgtgtacatacatacatatataatgcatacatatataatgtatacattatatatataccgtgtatatatacattatatatacattatatatgtatacataatgtatacatatataatgtatacatatataatgtatacatatataatgtatacatatataatgtatacatatataatgtatatatatataccgtgtgtgtgtgtatatatatacacacacacgtaatactcagccataaaagccatatatatatactgtgtgtgtgtgtgtgtgtatatatatatatatatatatatatacacacacacacacacgtaatactgctcagccataaaaagaaatgaaataatggcatttgcagcaacctggatggagttggagaccattattccaagtgacgtaactcagaaatggaaaaaccaaacatcatatgtcctcactaataagtgggagctaagctatgaggatgcacaggcataagaatgatacaattgactttggggacttgggagaaaatgtgggagggtggcgtgggataaaagactacacattggatacagtgtacactgctggggtgatgggtgcaccaaaatctcaggaatcaccagtaaagaacttattcatgcaacaatttaccacctgttcccccaaaattattttttgaaaagttcccttgaaaccagaaatcggcatttgtggcctcagaggggtttttagtttgtcatgccatgagttactcacaattcccaaagctttaatctactactttcctatttaaatgtttcagtctactactttactatttaaaagttatatcttcaactcagatttagtggcaatgcttaacaactaatattggcttttattatttaaataactttagtatttaatatatgtacatgataactattttgcactttttaaagtgacctttgttctcttgaattaacttattcactattatatgaaatttacaatattgttaaataataattccaattttattttcttttaggatcccgcttttactgctttgttaaccacccagttgcaagtgcaaagggagattgtaaataaacacaatgaactaaggaaagcagtctctccacctgccagtaacatgctaaagatggtaagaggcagtgctgtaaggagatgggtgtgaatcagctgtggaaggagccgacggctggccactggcatctcttaagaactttgtggtttacaaagttgtgtctctgttttgttattttatttgaaccattatatggagaggattgtattcttgtttttgttttaaagctggttaaaaaaactcaattatacagagtttttaaatttggaaggcataattggaagtcaaatattcaggcattcagtgttaagccattacactttttgttaattctcttttctggtttacaatcaagaaatcccccttccttcaggatatgtgtcagctgttgtgagtaaaagcccacttcccagggcacagtccctgaaagactggtatctccgatatgaaagcaatggcttacatatgaaaacaaatggaattggaaataacgttggccatcttattactattaaaatataattagaatatttcacatgcttatcaatatttagactagcatcattaataaatatcctaggtatggctgctttgctatcataaataatcacatattattgtcttattttgctttttagatatattacctatggactacccatcatgtgtaaactggcaccagaagagataaaaacacttaaaaacattttaataacagtagtattagagaatacatctacagaaattttaaagtatttacaaatcagattataaagtgtatgtttcattgtggctgaatcattaagtgtattttgttttcttgtgacgtttaggaatggagcagagaggtaacaacgaatgcccaaaggtgggcaaacaagtgcactttacaacatagtgatccagaggaccgcaaaaccagtatgtaaattagtaaatatttgttgaataaataaatgaataaaataataatagagcattgtaggatgctctataataagaagactttgaaaataaatgttacttatactgctgtctttttgaagtcaaagtatctgtatacagaggggtatttacaataagaacaattttgtgtttttttattgtgtacattatgcaaataattttgcttcttgcaaccagctcatgagtacagcagattttatatcatctttctttttgtaagtttaaagattagaaagccagaatttgaaagaaaagtgacttacccaagaacataatctgaaacagtgtcatactagaaatttttaaccaagctttctgatttctaacccactgccctttttgttaatttatgtagctgtctgatgttttgaaatctattttttgtatccataaaatatattgaacttatgatgaattattcctaagttttgctctaaagtggataaaagtggataaagtggatttaaatttatcgtattcaaaatttctataaaaatgaatatttttgaatatattaatatattaatttttaatatcagactagcaagtattttgtgtggactggatacctacaatgcacagaatactatattcgagttttaaaaagacatatcaaggattataaaaactagtaaatgcccaaataatttatgaagtgtttctgggctgtaaggcacttcttgacaaactcacaaggatttcagcttgtgatatctgatttcctggttaagagaaaacccataaattttgaaaactgttatccttcctggtgtcagttttctcttgattgggactcttaaagacagcctataaagtctttttttcagatttcacacaaagtcttatacatttatttggggtcctatatttgaaaaatctctgttgagggttactagagcagaaaacagaatataagagttggtcactgcctttagcaagcttaccatatacagctgggaacactcaaggcatacacatgtggaaaatttagcatgcaagggcatttttaaggagcagagtgttaacctactcaaagttttatgtggtcaggccaacctcagtgtgtcaggcagttaagtgttctaatcagctttatagctgataaggaactgaggcactcctttatgtattaatcaacagttagcatctgctggaccctgggtttgaaaggcaacatctttgtgtttgtgtagtcaatttcttttaccattgcatgtttattaccttgctcatgaatgatctgccccttaggtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcaggtaagaagaatgcatgaaaatacctatgtcacagatgttctaatagaggaaagcttctccaaattatgaccactgtaatgttcaatttaggagaacagtccgagtgggtagaatacagtcttggcatttggctgttgtagagctgtcatttttgtccatggtcagccaaactcttagtaggaaagcagactctgtattgttcctacattataaattttaaagtgatgaatgtacatgaaaattaaatatttttaaagtttatgactttggttcaataatttaaatatttttatggtatatgtctataaaactaacatttttcagttttatatttgctacttttttaaatatttttcatcttctctaatgtacttttatatatttattccattgttaatttgcagcttgtttggtactcgacttaccaggtaggctgtggaattgcctactgtcccaatcaagatagtctaaaatactactatgtttgccaatattgtcctgcgtaagtagactgtttagagtttaatggcaataattctatctgcaatttattttttaataattctcatatcttaaaccagaatgaaaacatatctcaataaaagggaggggataaacgtttggaaatgttttttaaggttgagacactttcaacttctcagaggagaacaacttctcactttcaggtataaaaactgaagctctcattcctcattaacagaataatgtcttttctttcaattggccttccctcagcttagggttactctgtgagcatgtgtaatatgtatttctctagaattggtatcatcacatcttgctaatttcatactctaggagtatagatgctttagggtgctggtgagattgcaaatggaagatggattgtgattttggccctttctgctcaaatattcctacttctgcttatgtaaaacacacacacacacaccaccacacacaattaccattacaaattattcattcatttggatttcaatggcttttcaggacatctttatttcagaatacagaaaagataacatcttaagtctctgattctcagaattgttcacagaaagctctttaaccatcttgtaaggtttgatttgtagcagtaaacatgcttcttcattaaacaatatgtttagagttatccacaataaatcctatggatattttaagaagatattcacaatatcaaatttaatgtttgaaattctttactactggaggctgcggtggggggcacagctacaggatttgtttcgagactgtagatagcgaagatgatgtacgattccagtttgagaagtataacctccaaagtcattttctttaaagtacctattaggattcaagtagagagaattgaaaggccctgggagaatgtatccaaactcacttactggccctcagagggaagcatcagcagccaggtgtcagaagtgacagttggaatagatcatgagggaagccaagggaactagaacttttaaaatccttttatatctgtttcacaattttccaagagctcatacacacacagctatattctaggcaaagagactgagattcagctgcacttccttgggtccttaccccacttggtctattgagatttggactcccacataattttaaatgaatttaatggccaatagaataatgatcatcattatcctatggttaatcattgcaaaactattatatcctggatatcagtatttatcaaaacttttctttaatctttttttcttttttttttttttaagttctgggataacaaaaactaatattccattttggtaaatgtaaaaatctcatacatgccacctctagaagctcacaaaccttcctaagcacactcctacaaacacacacaccactaactactgaaaaatcgcaacctccatctggaagaaaaaaatactctggagctatatttttcatagtttctgttagagatactatggagttttttccatttttcaaatggaaaatgatattttaacattgcatattcatttcctgccacaacctgctactcctaggatcttctcctttccctctacaggatgttttacccctaattggcaccttggggtacactgccttagtaatttgactaaatataatgggagataaagatagtgttgccacactgaatatactctcaaaatttcagactcttgtcatcaaatttagttacccagcctgtgaaattatggtcaagaagatatgtccatgtgtgaagcattttcttaatttggattgttatctgaaatacacattgggaattgtaatttttcagttttgttaacatactaaaaaccctgaataactatttatgtatatttgatgactgatactgcccttagagtataaacagtaaagtgaaaaatatttgacatgtatttcaaatttcagtggtaataatatgaatagaaagaataccccgtaccaacaaggaacaccttgtgccggttgccctgatgactgtgacaaaggactatgcagtaagtttgaagtgattagcttgctattatttattatagaattgatattatcttttctttatataatttaacaaatctcctaacgtaatgaattgaaataatgtattggtgaaaaaacccaaaattattcaacaaagtatgcttaaacaaacattttacacactgcaggagctacatattatttgtaatgaaaagcatattgccgtatgtaacataatggaatatttatcatcaatgtgtttttgtggctcttcagagccatttaatattaaccatataccattttggtaaatagttcaattctcaaagttcatatcactataccaaaagtggtattttaaaggaatcaaaatgtataaatctaaagtgtgagaccacattatggctcagtctagacaggcacgccaaatattactgtttatttgtgctaatgtgtttgtcatgctgatttcctcacttcttttttatagtataattaggatcatagtgtttgccttaataaatgattacttgccctataatttcataattgttttgtgtacatttttatgacaaaactcaatctatatacaatattggctcatagaaactgtgcacatatttttgcaaaaggagaaaatgaaataaataccatatatctcatttaataaattgccatgaatagaagtaaaaatagctgctggctttctgtagttgggatacttttattaaaattattatgaatgataaagttgacaccatcactgaaatttttacctcttcaatgcattcacctttactaagcattttttctgactcagttatatagctatatttcagaatattaatgataccaaagctataaatcaggcagaggtgggcggatcacaaggtcaggagttcgagaccaacctggccaatacagtgaaactgcatctctactaaaaatacaaaaatgagccaggtgtggtggtggatgcctgtagtcccagctactcaggaggctgaggcaggagaatcgcttgaacccaggaggcggagattgcagtgagccgagttcggccactgcactccagccagggcaacagagcgagactgtctcaaaaaaaaaaaaaaagaaaaaaatagttgaatacttatacattttgctgaatgctatttgctaacaagtctggaattcatctgtcatggtatcagctggtatcagctgctgtgtccatgggattgcctgcatcacccctctcataaaccctaggtaacacagaggggagagagacactgtccacttgggggaaagagaaggaagtgtgtggggtactctgccttggatttagtactgagcctgccacaacaaaacacacaccagtaagaaacccacagctcctaaatccagattggtatgcagattggtatccagattggtgggcctctagacccaccatagcaccaaaaaggaatccactgccccagtgggacagactcaagtcccagtactactggtcaactaaaatggcctcagaccccaaatgaattgtagtagctggaaagtcataacagctgctggccttgggcaagccctggttctgtcctggtctgagagtccatgggcttcagatgcatcaaggcacagtgccagctgtggcatccagggaattgtccatgtcacccttctcgtaaccaagtttgcagcaaacctgggtttagaacatcatctaataatgaaataactgccatcttaggagacttattcgctcctttaaattcttggaaggccttctgaagaaaaacaggtacaaacaagcccagactgcaaagactaggataattaattctttagtgcctagatattgagatagtaatccacaagtttcaagaacattcaggaaaatatgacctcatcaagagaactaagtaaagtaccagtgaccagccctcgaaagatggaaatgtgtaatctttagggtacagaattcaaaatagctgtttggaggaagcccaacaaacttcaataaaacacagagaaacaatttagaaatttatcagagaaatttgaagaagagattgacatttagaaaaacagaaatcctgaagctgaaaaatacgataaataaactgaaaaaaacattagatggtctcaacagcagaattcattaaacagaagaatcagtgagcttgaagacaggctatatgaaaaagagaaggaaaaagaatgaactttcttcatttcccttagattgtgggtggtgcagggagatcactgctgagaattgtcagccttttagctaatacaaggagtttaatttgagttttattgagtttgaggtccctagggaacatccaagtagaaacatcaaaaggaaaagggcgtattgtccttgttttacacttttatccacccataaagattatttactcaaaaaaagcattggagtgtaatgccatgctgcccaatattatgatatgatggaaagagtctctatcaacatgtgctactaatcacactttgaacacttgaaatgtggctaacaagattaagaaaccaaaattttaattttaatttaaatacctctgtgtggctaatggctcccatatttggctgtgcaggcatagaaagatttaattacattcatattattctgcttgctgagggggaaaaataggtcaatttattttagaaacatatcactaaatgtggaatttaaagagtgatggatttatcagtgagctcaactaagacacctcatatgtccctggatccagatagactggattaagaaaatgtggcacatatacaccatggaatactatgcagccataaagacatgaaagacccattgtagtgtaagcgatgctaacttgtttgttccctcctaccccctccccacacactttgaatgtatggttttgctcttactgaggaaaacgataatgagttaactaatctgtttttgttacagccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgccgttgtcttaatgacctttcttttaaacaaaagtaatcagcttttcgaacaaagaacttttctaagcaaccatatgatatgattcttatgcaatatttataccattcataattaactccagctagattcatctgagataaatgataaaacagcaacattttcaaaatagttgtctataaagttaaattttaacaaaaaattaatcagttctactcttacttgctttctcctttttgatattttgatctccctactggtttagttgatttttttaaagccaacgaaaagaggacataatttaaccaaatatacaaatacagccttccaagaaaacaaacaagtggaataatcaatattaggttggtaacgacagggtaaagtaagcccatcttatagatgagaaaacatatactaaaactttttttaaaagtggaaaggttattgaaaaccagaaagtagatctggctagacagatggtgaaatagcatgagctactaatgcctacagaattaaacagattatctgaatcatcctataaccattaaggaaattgaattaataatcttaaagcttccaaaaaggaaatttctaggcccccaaatggtttcaccacataattctgtcaaatacttaaaagaataattaatagcaattttacagtttcttccagaaaattacatgggagaaaatacttcttaattcagtctttaagatagtattatcttagtactaaaactaaagacatttcaacggaaaaaatatatagagagagatctatcgctatcatgagcatagatgaaaaaattttaaacaaacatttagtaaatgtatcagcaatatagtaaaaggaaaacataccctgacacagacttgaaacaaattacaagaataaatcaaaattaaactgtgtctagaagataaattgcctattatagaatatattcattgtatatatagctccccaagaatttctttggaaattgattttttgacaagatgagcgtttcttcatcctaatcttaataattcaagtgtcttacaaactatgttttaaaatatttaagcctattttaggagagaaaaggaatatttatatttgtaactgcaagagcactgaggtagtgtgacaatgtgagagagaagcaaacagaatattccacttgagtggttctcatatgaagcactccgttattggggtggcatttgaaaggttttaaatacagagttttctttaaaattttaagattagagttagctttgtgggtggaagatctgatctggtccttaacagaagtgactaaaaaataacctttataaatactttcaggtagtaggaaaatctttgctattctcatagcattcttaaaatttatctaactctagtgactggttaaaaaaaaaaaccctctataccagaatctttaaaatttaattgctaattaagagttacactcaaaacactttttctcccactaaactgaacagttgttttagtgtaatgtatgttttgtcttatataattgaatttgtatcactaagcttaccttcattctacaataataatagtaaattcttagatactgtatagttatttaatttttcaaaatgttaatgacgattttgatatatacctttttaaccaacgaaaatgtccaaatctaaagtaaaatgtcttcagaaatactccaaatacccacaaacatttgattttatagattttgctgaatcttttccaaaatgaacattttcagtgaacattatgatatcattgctaactcaagttcctccttcatttggtcatgtattaactattaatctgtgtttccttctacattcatgctcccataattcattgatttctgtcatttgattgtgcctcagcctatttcttttcatacttccttgcttttgtttatcttagtttttcttacttaatctggtcagaatcgtatttaattttaatttcagtcaaatgtttcatatgaaattactccttcctctt

SEQ ID NO: 13362 - DNA, 285478 bp, Human
  misc_feature (1)...(285478): n = A,T,C or G
tattggtcacacagacaagccttattcgatgtaggagggattacacatggatacataaatgaataccaggcaaagaggatcactgggggtcaaaagcaaggatcactcagggtcaaatcagaatggctaccacctgtacatatttccagtgcctagaacaatgcctggtacaatatgttaaaaaaaagtttgataagtacatgagtccttccttctttcctttttcccttcctccttctctccttcctttgaaggttatgggggtggtcacagcattaaagaaagattagaacagcaaaggcttaggaaaggcaggattactggaaccggggattttaatatcctcaggatattctccatctcatttagcttctctgagtatagccaggatctccttagagtttcatccttagagctttataatgagagggcacagggcttttacttttccagctctggtttgaaaaaccccagggcaggattctcccaggcataaccccttgaatcaatcagtatgatcagggagttaaggtaatgtgactggctttgtttgagtcaggcatctatacctgttaatggaaaaagatggaagggggtattgacaataaaaatagtacaactcagccatgctaggtactcccctttctctatgttcccaccattatatcttggtacaacagaacatataatgttattgttcatttacttgttcatatgtttgtcttctatactagactacacattcttacactagaatgtgaacacaggtaccacatttttgtagctccaaatgatataggttttgtagtcaagagagactcatggttgcatttttgctttttccttctactaacaatgtgactttggaccaggcatagcttccctgtcttttaaatgggccaaataatagttgtgtcatgtggaagcacataacattatttctgacatgctgtaggagctgaaaatgttagttactgtccttcctcttaggaaagtagctgacatagttgaataattttaatatatttgtgaataaatgaaggagtaaataaattcagcattcttggcgactggcttggggattcacttgtaaatggggataacaataggattatgataaagattaagtgagatgatagatgaaaagcgcttccacagtgcccagctatggtaagtgctttaaaagcataagccatcagcaacttgggggtgttcacctacagtcccagccattcaggaggctgaggcaggagggtcactggagcctaggagttcaaggccagcctgagaaacatagcgagaccctgtctttaaaaaatgaaacaaaatgggagccatcatgagagaggtaatcctttaaaaccaatatatcagatctcctagaaaagaattggagaagtggctttctctctatttaggtacctctcacaagctatatcacttgcttctgtactgcatagtaaactctcaatagcccctgagtaacaaactgcaatatccattaatagaacacaacatagcctgcagaattccaaaacctcaggtaaagaatgagaaaaaaaaaaaaagacaaagaggaaagttctaccaaattaataattttgtctagtgtcagaaaacacctaattatagaagtttctagccaatgcctcagcgtcggcactcaaacacaataacaattgtaacgtcattctgagataagtcatagaaggaaggaaggagggacagaagaaggaagatggaagagggaaggaaggaaggaagggagggaggaaggggagaaaagaaggaaagaaggaatgaaaaaccaaaatcaattagcatacctaagacaaaaaggctttggtttcagcattcctaatcctccacattcccagctccctactacctaacaagtgtataaggtggaactgaaagggtgttaaatgggtggatcccagtggcaatgtctttgttaacactgcctatgagtcagctataaattcaattcaaatccccagtctctctgtcttctctgcttatcatggttaccaacaaaatgactgctgcctttagaaaccctagtgggaaacaggtaaatgtgtaaaacgatgtttgattttatattaaaacttataaaaatgtaattgctgtaacagaaagtaatttgttattgagttaggatttgtatatttcgcttaatcttcaaaacacaggaacagcttgttaacatttcttcagttttattttaagactgttatctcattgtactgcagccattcgagtgatgaacaaaatttatgaagtgttaggtttaattccatacctgcaagaaaggtattttagtaattggctttttgtaattcaacacttgccgcaattctctcctagctgtaattggctgctgtttacgtttctttgaatatacacattcacagaggagacctagcatgtctgtatgggcttcacatttctcatatggagaagaagaaaatgactggttaccatagcatttgttcacaaactctatttggtgacagtgttgatggttgcatggcctctcaatgatttcagaagtgttgcctcccgtcgtgtttgggaacacagttcataataaaagccacataaatttttctgtaaagtatcatgttcctaaaatagtttcctcacctcatcctttttttttttttggtggaggtgggagaaactgctaattaacattagctaatgtttgtacctggctttaattagacaatttcacacgaaatcaaaacacatctcacgtcgcatctatgattgggactcttatttttatttgcttgatgaagagactgaagcttacagaggttaaaagccagactattagcaggtgtcaaaatcaggattcttctaattcagtcttttttatttgtctttttgtttttgcacattggtgttttgtggctttggaaaatagcaattacaatagctattatttttgaatatttgttatacacatggcatatattattccacttaactgtcacttcagtgcttaagtagatattattatctccagtttatgaatgagaagattggagcttgaagagctcaaaggggttgatcacgtttttggcaagaacacttgaaattttaggtcacagtctagtcacttgcatgaatgtagaagttactagttcctagataattggatagtttaagtggagttactacctctagttccaccaaattttctcttgctttaaaacaagtattttgcaaagtcaagaaatgaatgaatttctccttttggtgggtaggctagaaactggcacactattgatgtcccattctggtgactcaatttcgaaagttttttgggctgacagtgttaatgtgtagtatcacatatagaaatgatgtctgagctgtagatccagagagcttgttctttcccatagtcatggcagatctagtctccacctgtgcacaagtatcaagagataaacagaattgtgtgtctcttaataatgttctttcctaagatgatgtcagagtcttctaaagaatgcatacggtggaggtaaagtggtaaagtggtgaggttaaagctattctttccttttttttttttttgagacaggatcttgctctgttgcccagggtgcagtgcagtgcagtggcgtgatgtcagctcactgcaacctccacctcctgggctcaagtgatcttcccaccttagcctccctagttgctgggactacaggtgcacgccaccatgccctgctaagttaaagctattcttataactccagtgcatggaggccatagctttttatttgagtacctttcagattcatattgtagaaagtaatgagcctagtaatgaatagctgtcactatttcattgtgagccttcatttaaaaaaaaaaaccaaaaaaaaaaaccagttttgaacattagtaggagttgaaatggagtgttatgtctcctttttctttaatagtgctaccaataggactttctgatgagtggaaatgttctatatttgtgctgtcagacagtagccactagccacatgtgctattattgagcacttgaactatgtgagtgtgactatgaaactgaacttttaagtttatttatttttgagacagggccccactctggcacacaggctggagtgcaggggtgtgatcttaactcactgcaacctccacctcttgggctcaagtgaccctcccacttcagtctccagaatagctacagttgtgccaacatacctagctaatttttttatttttatttttgtacagatagggtctgactatgttgctcaggctggcctcaaactcttggcctcaagtgatcctcctgtcttggcctcccaaagtgctgggattacaggcatgagccaccatgcctggcttaatttaagtttaaatgtaaatagtcacatgttgctagtatctctagtggttgctgtattggacagtgcaaacctagaatgtaactgagatggtctagttctctaaaaagctcccagggtgagggaggaatattgttcacagtgggtttgacttctctggtgagttccttctttgtaccttgggttgttttttgcctttcagaggactgtctcccttgcatttcctttctgtgaacaatggagctaacatgactgacttaaacacctttggcagtttagagcacggtgttccagggtttaacccttgccaagtttagaggggttcccctcccagacagtgacccaaatcaatgctaaggctgtacagtatcagaacatagaaaactttgaattgctcactgaatttaccgcaaataaaactatctgaaggccaggcgcggtggttcatgcctgtaatctcagcactttgggaggctgaggtgggcggatcacaaggtcaggagattgagaccgtcctggctaacatggtgaaaccccgtttctactaaaaatacaaaaaattagccaggtgtggtggcaggcgcctgtagtcccagctgctcgggaggctgaggcaggagaatggcgtgaacccaggaggcagagcttgcagtgagtcaagatcttgccactgcactccagcctgggcgacggagcgagaaaaaaaaaagaagaagaagctgaggcaggaggatggcttgaactcaggagtccaagtccagcctgagcaacatagtgagacccagtcttttaaattaataaaataaaatgaaaccacaaacctcaaacaaacaaaaagacaaaacaggatttcaatcattgtgaagctctcgatctagtagatgagtaatgtatataaaccaaaatattacaatttcagagaagtgctacagggcctaatgtttaaccacttctggcattcaactgactgtgttaaaaactctgccaccactttccaggggtataaattgaggtaagttatttggtatttattaaatttcagcttcttcatatgcaagggggttatgataataatacctaccccatgaggacaatatgaggattaaacgaaatagtgtatgtatacagccttagccaatacccatacatgttgagtgctcaaccaggtgttagctattagattttaaaattttatttaatttttatggggttttttttgttgttgttgttgctgttgagacagagtcttgctctgttgcccaggctggagagcagtggcgcgatctcggctcactgcaagctccacctcttgggttcaagcagttctcctgcctcagcctcccgagcagctgggactacaggcacacaccaccacgcccagctaatttctgtatttttagtagagatggggtttcaccatgttggccaggttggtcttgaactcccgaccttgtgatccaccacctcggcctcccaaagtgctgggattacaggcatgagccatcatgtcctgcctagttttttttttgttttgttttgttttgttttgtttttgagatggagtctctcactctgtcacctaggctggagtgcaatggtgcaatctcggctcactgcaacctccgccccccgggttcaagtgattctcctgtctcagtctcccgagtagctgagattacaggcacacgccaccatgcccggctaattttttttttgtatttcagtagagatggggtttcactgtgttgtccaggctggtcttgaactcttccgctcgggcaatccacccaccttggcctcccaaagtgctaggattacaggtgtgagccactacgcccggccactattttttatagtttttaaggtaaaatttacattcactgaaatgttacctgcatattttttgataagtgaatatacctatgtaactcacatccctatcaagatagagaccatttttaccacccagaaatttcactcatgtaccatcccagtcaatcccctgccacagggaaccactgttatgattttttttcaccacagattaattttcttttctagaatttcaaataaatggaacagtatgacactcttttgtgtcatttatttatcttcacatagataattcacatactttgtgtcatttatcttcacatagataattcacatactttaagataaaaaaggtacaattttaaaccttttgggcatgcagtaaaaatctccttcccactggtacccaccagtcacccagtcttcctctctctttctctctcttttttttttttttgagacaagatctttctctgtcgcccaggctggagtgcagtggcacgatcatggctcacttcggcctcacccttccaggctcaagcaatcctcctgcctcaggctcccaagtagcaggactacaggtgcctaccaccacacctgtctaaatttttttttgtattttttttttgtaaagatagggttttgccatattgctcaggctagtcttaaactcctgatcttaaatgatccgccggcctcagccttccaaagtgtttagattataggcgtgagccaccgtgcttggctcagtcttcctctcttgaagcaatcaatgttattagttttatgtgggccatcccatgtcttatcattattaattcaggtgcttacaaaaggctctttgagaactgttttaaaggttacccaaagaatcttgtgacaacccagctaaaatgatataaaatcagttttaacataactgaagtttttagattctgattccaaatgtcagatggtgacattttacctttctctgactttatgccaaatttagtttaagttttagcatctataattttcatttactgaacaaatatatatttaacaaatatgaaaatacaaccatgaaacaaacaaaatcaaatcctggacttaaggagctaatagtaaaaaattcaccaatataactacccaattacagtttcatgcgatgtgaaaggagtaagagaccaccatagggaggtcagaagatgcttctcagaggtggatactagagccgttgtcaaaggatgaggactgggagaactttctgggcacagagcaaagcatgagtaaaagctctgttgaggccaggaagccggtaaatagggaataaaagaggctagcgtggctggagcacagacagcagggtggaattggtctgagcagtgagaagaggtggagaggtgggcaaggcacctggccattcagggcttggttagttaggagggttttttctaagagaatgggaaagtgtttaagtggtttaggctgggaagtgacagggtcacactgttattttgaaaaagtcactctgcctgttgtgttgagattagagaggggataaagggaatatgggtaaaccacaagaagactaggtcagtaatccctccacccccactccccaggtgaaggtagcctagactagggtggtgatggaggaaataggagaggacagattcaaggaccatttgtaagggaaaaaccaatagaatttgctgacggatggaatataagaggggagaggtacattatcaaggatgtagcttagttttcttatacaaggattgagttgcaataaaattgttaattgaaatttctttaaataatggcacaacctaaagttatgcaaacatatgcctcagataaaagttcaagttttcaaagtttttagctgggtggagggcatggctttacttcctatttcttggtatttcctaatcttgttgaaaaaaaagtaaggtttttttttttttttttttctgaaatgcttagttcagtggaaacccatctgcgaattctgtcttataaatttaaatttaaaaatagggatactaatttctagacaaataattccggagtttcttgtgctgctaattattataatttttgtccctttttttttttgagacagagtatcgttctgtcgcccaggctggagtgcagtggcgcgatcttggctcactgcaacctccacctccgtggttcaagcaattcccctgcctcagcctccagagtagcttggctgggagtacaggcgcacgccacgacgccgggctatttttttttttttgtatttttagtagagacggggtttcaccatgttggccagattggtctccaactcctgacctcaggcaatccgcccgcctcggcctcccaaagtgttgggattacaggtgtgagccaccgcgcccggctgtcacttctaaacatataatgaaagtaatctgtattgcctttttactttttcttgcctgcttttcctggaccagaaattaataggctgtttccgtcccaaacaaagtactttccttctaagaatgtcttcgttgacgctggagggctgcccggctgaatcttacgtattcgtgcccatgttctgccccctgcagtagtctgcataaacccaatgcgaagacacgtgtaagagtacattacaattacaagtgtcatttacgcgttgattattgtttttgcgagtgccctaaggccacctctgggggagctcggggctgccttccgaagcatgcgcgtcagcaccgcgtgccagggccctgaaagtcaggctccgcgtcggtgcggcagcgcgaggcctgcagtcctaagctcggggtcgcttcgggcccccgagggggtgtgtcttctaccgttttaacatggaaggggcggttccagtggccggggaagtcggcgacttgcaggactgaaggctggtgctttgaaagagaggcggagggcgagagcgatttccccgcctcctctgcactccgtccaatcccttcgccttctccttttctcggccggcccgcccggcccctaacctgctccaacccattctgcggtagaggctgccgggtctctttaaggccctcccgcgcctgcgccttgggctctcctgacgcggccgggccggaccccggaggaaccagctggccagctggcaaggggctggctgcagttccgacagcggcggtgccgggaggggtaggtgagggtcgcgaggcggccctgagcttctgagtgagcgtggtgcttttgggaactcgggacgggcgacccgtggagccaggagcggggccgaggcgctgagacgcggcggcgcggctgccggctggatgggaagttaatgtttacggcgaagtctactcaacgtttccaaggtgaggggcgctgcgccaggccgggcgggccgggaggccgggcgggcggtgagtccgtgttccgctggcgcacagctgggccgaggcgcggcgggcgggggccgccgcaagttttgctgtgggagcggggcgggcgcgcctggccccgccagggcctaagttccctgcactcgcttcctcgcctgtcgccgccgccgccgcccgcagccctccttctcgtgggcgctggggaagaaactcgtcggcgggtctaactgtggcgtcccagggcggtggagggacggagcagcttcgggggcacgtcctcgtaaatcccgtggaggacactgaccctgcaccccaccctcgaggccagaagtcggttccctttggggacctgaggggcgagagcactcgcccccctgacttgcaaagttggcgtctttacttggcctccgggattctgcgcatggcgtgtctccaggctgctgatgggcaagacagatgtgccaggtccagaatgaacttgagaagagtttgtagccattcctgaatcaccttatgactagtggggcaagcctcaaattaacctcaggatttccggtaggttggattgtggtgttggtgtttccactcaaaagagttgctgtgatttccctgtgtctgtctgtctgtctgtctttggggcttcttagatcatctcatttggcatcctttcacccaagagttaaaccaagccttttggaatggtttcctcgctttcctcctatctattgctggtagagctgctttcgaaaagaagtattttcttgaagtggtatcttttctttgggttacagtgttgaataataaactcctttctttgccgaaagaatgaattccagtgcttactgaagttaaagaaaagtgatctgctggtagtttttaatctttgttctgagctgatgtaagtaactttttttgttttaaaattttgttagtagaatttcaccagtgtaccagaagctctttttctttttcttttcttttcttttttttttttttttttgacagggagtctcgctctgtcgccagactggagtgcagtggcgacgttggttcactgcaacctccacctcctgcgtttaagcaattctcctgcctcagccccgcgagtagctgggactacaggcgcgcgccaccactcccagctaatttttgtatttttagtagagatgaggtttcaccatgttggccacgatggtcttgatctcttgacctcgtgttccacccgcctcagcctcccaaagtgttggggttacaggcgtgagccaccgtgcccggccttctttttcttttcttttcttttcttttttttttttttttttttttaaggctgagtctcactctgttgcctaggctggatatattctcctgcctcagcctcccgagtagctgggattacaggcgtacatcaccacgcccggctaatttttttttttttgtatttttagtagaaacggggtttcaccgtgttggtcaggctggtctcgaactcctgacctcaaatgatctgcccgcctcggccttcgaaagtgctgggattacaggcgtgagccagcgcacctggcccaggtggtcttttttctgttctaaaatgataactacgatttccgagaactttgtgtcaaataaatcttagaactaagttattgaagtatagagaaaaagttcacaattctaaatgtgcaggtggtctgggtgcggtggctcacgcatgtgatcctagcattttgggaggcagaggcaggtggatcacttgagcccaggagtttgagaccagccagggcaacgtggcaaaaccccattttctactaaaaatacaaaaattagctgggtgtggttgtgtgcgctggtagtccgagctacccaggaggctgaggtgggaggatcaccaaagccggggaggtcgaagttgcagtgagccttgatcatgccactgcactccagcctgagcggcagagtgagaccgtctttcaaaaaaaacaaaaacaaaaaacatcgcaggtaatgaatttttactaagtgaaccaccaaagatcaagaaataggacattactagattggagtatgtacgtaggagtggcattgttggttttataggtacgtgggtgataaaactctagtattagaaattgttgaacgttttcccaaagtggttctaccaattagcagggaatgttccggttaccccacatccttgctggtgcttgtcagttgaaattttttttgctagtctagtagaggtacagtaatatatcagtgtggtttcattttgcattttcctggtactgaggttgagtatcttttgttgaccatttatatttcctcttgtgaagtgcctgttaagtctttttgcccagttttcgttgatatgcttatttttctctcatttataatgctttattctggatatgagtcctttctaggatatatatgtattgcatttttatttttttcagtctgtattttgccttttcagtcttttaatggtgttttttttcatgcctggagattcttaatttgtgtgtgtgtgtgttttttgtttgtttgttttgtaagatggagtctcactctgttgccaggctagagtgcagtggcgcgatctcggctcactgcaccctcgcctcccgggttcaagcaattctcctgcctcagcctactgagtagctgggactataggtgtgtgccaccatgcccggctaatttttgtatttttagtagagacagggcttcaccatgttggccagggtggtcttgatttcttgacctcatgatccatccacctcggcctcctaaagtgctgggattacaggtgtgagccaccgtgcctggcctttttttttttttttttttttttgagacagaatctcactctgttgcccaggttggagtgcagtggcacgatcacggctcactgcaatcttgatctcccaaggctcaggtattcctcctgccttaacccccaagtagctggaactacagatgagcaccaccatgcccagctaatttttgtatctttagtggaaatggggttttgccatgttgcataggctggtctcgaactcctgggctcaagtcatacacctacaccagcctcagcctcccaaagtgttgtgattacaggcatgaaccactgcacccagcctgagattcttaattttaatgaagtatactttatcaatcttgtcctttatggttactgctttttgtgtcctatttaagaaatcaatgcctaacctgagaatatgaacatatttttctgtgttgtcttatagcaattttattttactttttgcaaaaaaaatttttttttttttcagacagggtctgaagtgcagtggtgcagtctcagaacactgcaacctccgcctcctgtgctcaagcattcctcccacctcagcctcctgagtagctgtgactacgactacaggcatatgccaccatgcctggctaatttttgtatgttttgtagagtcagggtttcaacatattacccaggctggtctcaaactcttgggctcaagcaatctgccctcttcggcttcccaaagtgctgggattacaggtgtgagccactgtacccatcccctactttttgcatttaaggtatataatttagagtaaattcttgatgaatcgcaggggtcaagattcactttttaggccgggcgtggtggctcatgcctgaaatcccagcactttgggaggccgaggcgagcggatcatgaggtcaggagtttgagaccagcctagccaacatggcgaaaccctgtctctactaaaaatacaaaaattagctgggcgtggtggcgggtgcctgtaatcccagctactcaggaggctgaggcaggagaatcgcttgaacctaggaggcagaggttgcagtgagccgagattgtgccattgcactctagcctgggcgacagagtgagactcggtctcaaaaaaaaaaaaaaaaatttacttttttttttctttgagacaaggtctcactgtatcacccaggctggagtgcagtaacatgatctccacctgctttgacctcccaaagtgctgggatttaggcatgacccactgcaccgggccaagattcacttttttctatatagacgtctgtttgatccagcaccatttattgcaaataccatccttgtccatctgcactgtgtggcactttttttcataaattagataacagtatggtcagctaatttatgaaattagtgtgggtctgtttctggatactttgttctatttgtatatttgtcatccttgcactaatatcactgtattaatgtaactttataataagctttgatatgtggtaatataagctctccaactttgagaggtgggcaaagaaagtgggctgtgggcaggggctgcttttcatcaaacacacttctgtttaaccccttggctttcagccttgagccttactttacttttcttgagtctggagtctcacaggtgtattagtctgttctcatgctgctatgaagaatacccaagacggggtaatttataaagaaaagaggtgtaattgacttacagtgccatatggctggggaggcatcaggaaacttacaaccatggtggaaagcacctcttcacaggggaacaggagagcgaatgaatgcccagcaaagggtgaagccccctgtaaaaccatcagatctcgtgagaactcactcactatcacaataacagggtgggggaaattgcccctttgattcatttatctccacctggtcctgcccttgacatgtggggattattaacaatttaaggtgagatttgggtggggacacagagccaaatcgtatcaccaggtcagagtttctagaaaataaatttatgagataggaatggtggcagaggagggaacctagactagagtccaactgtaccttacataaactttaaaccatttactttctctttagccccatgcctctccactgaccctatacctgggaactcctaggctcctagattctgagcctttctgtgattctgtgagttagccaaatcagcttgcttctttttattttttaaattaaaaaaatttttatatcactttatctggcagccttcttctgagccagaataggctcagagagactcctcagcttgtttcttgattgtattcccttttgcaggccagtaggttcagcctcctctactcagtcacttatttctccatctcttcttgtttcatgggtgccatatctgttcttatctctctgagaatgttaaaaatcgttttcttaagcctttcttttttttttttttgagacggagtctcagccacccaggctagagtgcagtggcgtgatctcggctcactgcagccaccatcttccgggtacaagcgattccccgtctcggccctccaagtagctggtattacaggcatctgccatcatgcccagctaatttttgtatttttagtagagccgggttttcaccatgttggccaggctggtcttgaactccttacctcaggtgatccgtccaccttggcctcccaaagtgctaggactacagctgtgaggcactgcacctggcctagaccttcttttccttgcatagtttcttccaagttactttttttcctatttggtatagtcttattagtagaggccctcctcggaagactggtaatccttggttgtctgttcatgattaacagtgggctactgaaagctgatgggaagtcctgaacttgtaagtaggacttaaggacatgttgttttaccctatattctagagtctaaagcagtgattctcagcttcggctgcacattataatcacatggagaattaaaaaaaaaaatccctgctgctaatacgtcagaatctctgagactaggtcccaggtagggatagttaaaaaaattaggtgtggctacatacagtaaaatgcacagaatttaagtgtatagtttgatttttaccatgtaaccgatataagatgtagagcatggcaaaaaattctagaaaattccttcatatccctttcttctgttgtctcactcccagcctagaggtgaccactattctgatttctatctccgaagattagcaccagtattttttaaagctgccaagataattccagtgtgtagccaagattgaaataattgatctgggtggattgtttgaggctgtctccactgtatttatctttccttttgtcccagtcatattttccagagagtatcttccagttttctgcttggagagttgaggtctggttgtcagtatctgggaactcaggaaaagagggttgggtaaggagccaaagaacatttagtatattgggctcacacaatctgtctctgttaggatgcctatgtcttccaccttgtatggtttaccctcttgagaagagaaatctgtcacctgccacattgagggtggggccactcagcagcttggaagaaatctgggattctaactgttcagcattcacttgctcctttcttttagtcccccttccactctttgttctggcagttcctgagccttttgaggaatctatggcataaaccggtttgttcttagttgtcagcattgctggcttagaatttggccatctttggcggggtgcagtggctcacccctgtaatcccagccctttgggaggctgaggcaggcagatcatgaggtcaagagatcgagaccatcctggccaacatggtgaaaccccgtctctactaaaaatacaaaaattagctgtgcgtggtggcgtgcgcctgtagtcccagctactcaggaggctgaggcaggaggattgcttgaacccaggaggtggaggtagcagtgagctgagattgcgccactgcacctccagcctggcgacagagtgacactccgtcacaaaaaaaaaaaaaaaagattttggcatctttgactaggtcagttatccagctgctttccagcttccaaaattttgttgctattgtctcattctccctgtcataatggcttgtgtcctaaaaacagaacaaacaacaataacacaactttctttatccttgttttagtaacgttttgggaggaagcaaaattagatgtgtgtgtgttcaatctgccatctcaccttggaagtccactgtctgctttccattatacagaaacttgttgccacctgtcctccattgttgtctcctccttatggggttataccttttaaatttcttcatagttgtctgaaaagagtgtcaggaggtagaggacctaaatattggtcaagatatcatttctttaggagtctcaaaattctttttagaagtactcgttgtcccaggatcttataatctcaagattggaagtgattttgaagataatccggtttaacgagctatttgataccttctctaaaggaattgtccagcctaaaatgtgagaaacttgtggtaggaggagatgagtgcctggagaaatggattgggctgtagatctctgcaaggggtctggaaatccatgtgtacattaaatgttgcatgaataatagttcttgcatatttgtaatatataataaaatttattaaaaagtcataatgggccgggcgtggtggtggctcacgcctgtaatcccagcactttgggagtctgaggcagctggatcacctgaggtcaggagtttaagaccagcctggccaacatagtgaaaccccatctctactaaaaatacaaaaaattggctgggtgcagtggttcacacctgtaatcccagcactttgggaggccaaggcgggtggatcacgaggtcaggagattgagaccatcttggctaacatggtgaaaccccgtctctactaaaaatacaaaaaattagccaggcgtggtggcgggcgtctgtagtcccagctactcgggaggctgaggcaggagaatggcgtgaacccgggaggcggagcttgcagtgagctgagatcttgccactgcactccagcctgggcgacgagcgagactctgtctcaaaaaaaaaaaaaaaaaagttagctggctatggtggtgtgcacctgtagtcccagctacttggtaggctgaggcaggagaatcacttgaacatgagaggcagaggctgcagtgagtcgagatcataccactgcactccagcttgggtgacagtgagtgaaactccatctcaaaaaaaaaaaaaaaagtcatgatggtgttatcatttcatttagtaatgcttaaatccaatcatggggagaggtagtactcagaattttttattttgaaaaaagcttctagactagaaaaagttatgagctattactaaagattaataaagttgtggagattttagtgtatagttaacataaagtgaatgataaaaccacccattaaagtctctattttaaatatctctaatagctttgttattctttgacattctatatttttattttctttaaaacactaagtcagtagcttcccaaatgttgctctttgagttagaatttttaccatgaagttcatgatgaaatagaaatgttatcaatgtttatacaatttattcacctttaaattatatccatcctttttctgtgttaaaatgccctttttcttatgaagttgtgattctagatagtagatagattttttccttctaatatttggcaaaaaataaaaacctgcgagctctacatattgctcttcaaattaattttttttttttttttttgagatggagtcttgctctgtcgcccaggctggagtgcagtggcgcaattttggctcactgcaacctccgcctcccgggttcacgccattctcctgcctcagcctcccaagtagctgggactacaggcgcccaccaccacgcccggctaatttttgatatttttagtagaatcagggtttcaccgtgttagccaggatggtcttgatctcctgacctcgtgatccacctgcctcggcctcccaaagtgctgggattacaggcgtgagccaccgtgcccggcctcaaattaatttttaacaagttttataaaatacagaagcctgcttctcaactgcacaaaatccccattggccttttctttctaccacaagttagtaacagtcagtcatgtgttgcttaacaatggggatatgttctgagaaatgagttgttagacaatttcactgttgcatgaacatcgtagaatacacttagacaaagctagataatagagcctactatacacacctaggctatatggtatagccttttgctcctaggctacaaacctgtacagtatgttattgtatggaatactgtaggcagttgtaacacagtggtacttgtgtatctaaacagcaaagatacaccaaaagtactatattataatctcatgagaccaccctctttttttttttttttgaaatgcagtctcgctgtgtctcgcaggctggagtgcagtggcgctatctcagctcactgcaacttctgcctcctgggttcaaactattctcctgcctgagcctcccagtagctgggattataggcacacaccactacacatggctaatttctacatttttattagagatggagtttcaccacgttggccaggttggtcttgaactcctgacctcaaatgatccacctgcctcagtctcccaaagtgctgggattacaggcgtgagccactatgctcaggcagggactaccctcttatatgtggtatccattgactgaaatgttcttatgcggtgcatgactgtattttacttttgtgtttgtatataaaattcaagatatcaatcagatgacatggggaatttttactatctctcatggtgttacgatagtccttcctcattggaagaatgtagattgattaattgttgttagaacctgttgattgtgaccccctaagtttgcttgcaaagtgtcatctcatttctcactaggtattgctactagcctggtatgtttattttgcatttttagctgtttccttcaagagagctttctctgcttgtactgtttgcagtttatccttttaagtggccaaaaccaatgtgggtttagtgccttgttcattgttctttgtgctcatccaactcacacagttaaactctctgaaaagtgttccctaaagttagttaaactggctattatctgggtttttgttgttgtttttgctatttagtgtcttgtaagtttgttatcaggactcctcttaagtaactgctagctcctttgttcttgaaagggaccttgatgagagataggaacaaaacttgctttattatggataatgctttttttgtttgttcataggaaagcgtaagcactgagatagaaggaaggatggggattttgtctgagttggtgctcaaatgattatttgctgttgtctttggcctgaatcttttgtatgtcagaaatgaatccagtatgctcataaattatgctagtgactttatcagaacagcgttagcagatactgtataaaagtgtagctttaatgattaattatataatatatttgaatgaaatacatgagaaaggtagaagaaaaatgtaatatcttcaggcataccagaaatcaggatagtttggaaaactgagcataatttgatggtgaaaagaccttgaagtaaattgaaaatgaattttggggataagtcatgaataatgtaatgtctttgaatacagtagtcctcccttatctgcagttttacttaactgtggtcaattacagtctgaaaatattaaatggaaaattccagaaataatttgtaagtttttttttgtttttttttttttggagacagggtcttgctctgttgcccagactgtagtgcagtggggtgatcatggcttactgcaaccttgacctcctgggctcaagcaatcctcccacctcagcctcctgagtagctgggattacaggtatgtgctgccacacctggctaattaaaaaatttttttttctcatagagatggggtcttgttatgttgtccaggctagtctcgaattcctgggcttcagtgatccttctgcctcaggctcccaaagtgttgggattacaggcgtcagccactgcacctgaccaatttaatgagttttgataaagttatacacctatgtgaatcattcctattgtggttgctgtagttaatccccattgttgtgatttttttgttttattttcagagatgaggtcttgccctgtttcccaggctggagtgcagtagtgtgatcatagctcagtgcagccttgagctcctgggctcaagcgatcttcctgcctcagctttctaagtagtggggacaacagggtttgtgccaccgcacttggctaatttttgggggtcttgctctgttgcccagtctggaattgtgatatcttttaccatagattagtttttcttgttcttgaacttcacataagtagaataacagtgtgttttcttttgtgtctgcttcttttggtcaaaataatgtttttgaaattcatccgtgatcttgtacatatcagtagttctttttaatccatgcatattaatacattgtatgaatataatacagtttatttgtcctatctcctatttggctattatgaataaagtagctatgaagtttttttttttttttttgagacagcctgttgctcaggctggagtgcaatggcacgatctcggctcactgcaacctctgcctcctgggttcaagagattctcctggctcagcctcccgagtgctgggattacaggcatgtgccaccacatccggctaattttgcatttttagtagagatggggtttctccatgttggtcaggctggtcttgaactcctgacctcaggtgatctgcccacctcgggctccgaaagtgctgggattacaagtgtgagccgccatgcctggccctttttttttttttttttttaagatggggtttctctcttgtcgcccaggctggagtgcaatggtgcaatctcggctcagtacaacctccacctcccaggttcaagtgattctcctgcctcagcctcccgagtagctgggattacaggtgcctgacaccatgcctagctaatgtttgtatttttagtagagacagggtttcaccatctttggcaggctggtcttgaactcctcctgtcctcaggtgatccacctgcctcgccctcccaaagtgctgggattacaggcatgagctactgcacccagccgctatgaagttttggctgtgagtctttttgtagacatacactttcatttattttggataaatgaatagtggtggaattactgagttgtagggaagatgtatgtttaactttagaagacaatgctaaacaattttccccaagaaattacaggcacccgccaccaagcccggctaatttttggtatttttagtagaatcagggtttcactgtgttagccaggatggtcttgatctcctgacctcgtgatcagcccgccttggcctcccaaagtgctgggattacaggcgtgagccacctcgcctggccagtttctttttatatctgttaaaacttgtagtattatttcttgtatttcttggggaaatttgtaaaattaccattttacattccactctgccatctataaaagatctagttgagtgacaaatcagaattgagttttagaaagattattctggtacagtgggcaggccgggtgtggtggctcacgcctgtaattccagcactttgggaggccgaggtgggcagatcacaaggtcaggagtttgagaccagcctgatcaacatggtgaaaccccgtttctactaaaaataaaaaattagctgggcgtggtggtgtgtgcctgtaatcccagttactcaggagggtgaggcaggagaattgcttgaacccaggaggcggaggttgcagtgagctgagattgcaccattgcactccagcctgggcgacagagcgagactccgtctcaaaaaaaataataaaaagagtattctagtacagtggggtataagacttggaataggtaaaacacacagtaaagtaatacacttgaaaattgatgtattccgggcaggcgtggtggcacatgtctgtaatcccagctacttgggaggctgaggcaggagaattgcttgaaccttgggaggtggagattgtggtgagccgagatcgtgccactgcactccagcctgggtgacagagggagactccgtctcaaaaaaaaaaaaaaaagaaaagaaaattgatatattccttatccaaggaattggtagggaggtagataagcttatggattctagcgctgtaaggacatggaatccttagacttgatatatggggtgaggataaggtagggatcaggtgacccctatgtatctgttataggctgctggatgttggtatgacaatagagtgaacactgtggaggaaaagatttaaagggaaggagtgatgagttccattttgtttgtaagtagtaactgggagtaaaggaagtatgagatatctctgggagtgtgtgtaggaaggatggagtagaattggaatgttggggaccagtaacatttaagaaatgagctgatgaagagtctgcataagaacaaaaggagtagccactataaaaggaaaccaaggaaagtgatttaacagaagttaaaagaatagaactttgaagagggaggaagcggctggaatgttgttagtgtgagtaaaaatacagacttctcgccaggcgctgtggctctctcctgtaatcccagtactttgggaggccgaggtgggtggatcacctgaggtcaggagttcaagactaacctgggcaacatggtgaaaccctgtcactactaaaaatacaaaaattagccgggagtggtgtcaggtgcctgtaatcccagctacttgggaggctgaggcaggagaatcacttgaacccaggaggcggaggttgcagtgaaccgggatcgggccattacattccagtttgggtggcagatcgaaaaaacaaacaaacaaaaaaacccagacttttggaggtttctttttcttttttttgagatggagtcccgctctgtcgcccaggctggagttcagtggcgcgatttcggctcactgcaacctccacctcccgggttcacgccattctcctgcctcagcctcccaagtagctgggactacaggcacctgccaccacgcccggctaatttttggtatttttagtagaatcagggtttcaccgtgttagccaggatggtcttgatctcctgacctcgtgatcagcccgccttggcctcccaaagtgctgggattacaggcgtgagccacctcgcctggccagtttctttttatatctgttaaaacttgtagtattatgttacttgtcccagtagttatactttatggaataaatcctagagaaacgtacacatgtggagaaatgtctttaacatatattaataatagtaaaaaatcggaagcactccaagtatccatcaatagaggattggttaaatcaagtatagtacatttatatttatatgatggaatgctatacagctgatggagtatggtgtctatactgtgttactttcctgtgcggctgtaacaaattagtacaaacttagtgacttaaaacaaatttaatctctcacagttctgaaggtcagagttcaaaatgtttcactgggttaaagtcaagattgtagcagggctggtttcttctggaggctctgggggagaatcttctccagcttctcgagctgcgttccttgtattccttactttgcattccttgtctccatcctccatcttcaaacccagcagcatagcatcttcaaatttttttctgtttgtgccttcacattgttttctctctcataaagacttatgtgattatatcaggcacaacccagataattcaagataacctcccttctcatgatcttttttttgttgttgagatgggagtctcactctgtcacccaggctggagtgcagtggtgccatctcggctcactgcaggctctgcctctcgggttcatgccattctcctgcctcagcctcctgagtagctgggagtacagatgcccaccaccacacccggctaattttttatatattttttttagtagagacgaggtttcaccatgttacccaggatggtcttgatctgaccttgtgatctgcctgcctcggcctcccaaagtgctgggattacaggcgtgagccaccgtgcccagcctacctcaagatctttaacttaatcatagctgcaaagcaccctctgccgtataagataacatagtcacaggttccaggtattgggatgtggagctctttgcctggggcaggtagggtggcagggggcgtgagaggagggagggaattaatcttcgtaccacaaatactgacaaggacagaagatcaaagtactttaagtaaaataaattgtcaaggaaatatgtaaaattttctaattttgtaaaatttaaaacattacatatatacctaaatgtcatatgtattattagaaaagaaatcttgatgaatatataccatattgttaactgtgactgtctttgagagtgagattacagagtacttggacttccattttcttctggatatttgggttcttaacatgtattttctaatcagaaaaatcagaataaaaggagagaatggtactggggcatatgttgcagagagatcaagttaagataaggactgtcaagtgtttacttgatttagcaacaaagaggttcttggtaagtaaccttggttaagtgtggtttcagaaaaatggcagaatagaatttgcaatgaaaaagtgggaggtgagaaaggaaagagtgaaaagctaaacattttttgtagttgcttagctatggggaagggagaatacagtgagacacagggtacttagggggatgtaagattcagcgagattttgtttttgttttgtttttttgagacagggtcttgcccggtcgcccaagctggagtgcggtggtgcgttcatggctcactgcagtcttgatctactgggctcaagcagtcctctcacctcagcctcctgagtagctgggactacaggcatgtgctgccacacccggctactttttgtattttttgtagagatggggcttcatcttgttgcccagactggtcttaaactcctgggatcaagcagtccacctgccttggcctcccaaagtcctgggattacagatgtcagtcagtcaccacacccagccaagatttttaaatatggcagaggagcaggtttaaaaattgagagcagaaactgggaagaagggagcaatcacctgagctctaggagagtccaaagagcataagctctgacggaagtcttctgactttagacagaatacctacttgcctatggcaggtgagaactagaaaggtgtggatgtgttggagttgagtatgtaacactttagattcctttaatattatcagatttaaaaaaacctcttgcagtcctaaatgcttttttggcgtcttctgaaagtcttttattgtgtagctgtgtatctttagtcttgcttatgtactctcattgtattgacttgtcccagaaatgtctgattttttctgtaacctagtatatggagctcagggaattaagaccttagttttctattatagtgcagcattttgaggattttttttttcctgttatatttgaaactaaccattgcataaaaaatttgcttatatgagttctcttttttttttttttgagatagggtcttgctctgttgcccaggttggagtgcagtggtgtgatcttggctcactgcaacctccgcctccgaggttcaagtgattctctttcctcagcttcccaagtagctgggattataggcgtttgccaccatgcctagctaatttttgtatttttagtagagacagtgtttcgccacattggccaggctggtctcgaactcctggcctcgagtgattcacccgccttggcctcccaaggtgctgggattacaggcgtgaaccactgtgctctgccaaaaaatctgcttatttgagtctgtataaatttcctggaatgttacaacagtaaagcattagaattattgcttaattcaaggaaaccaagattcaaagagcttaaataacttgtcagagccatacatcttgttaatagaacatggtgctttacctggtgagatgctgaagacctttaaaaaattattttattgatatttagtatatttgtgccaggattccctgatttttcacatgtatctttttccagttttgattaagagaacattttttccacctcataatttcatcactcttttcttttacgtatatagtagttcccccttatcctcgggagatacattccaagactactagtgatacctgaaactgtggatgggaccaaatcctatgcgtagcatgtatttacctgttcatacctacctatgatagagttttatttataaattaggcacagtaacagagtaaagacaacaattaataattattactagtcaaatattattaagtaaaataaggattacttgagcacaagcactgtcatacagcaacaatagtggatctgataaatgagatgcatactaagtaactaacaggcggatagcatatacagtatggatacactgggcaaagtgatggttcatgtcccaggtggaacagggcagatggcatataatttagaattgatgaattggatttttttttttttttttttttgagagggagtcttgctctgtctcccaggctggagtgcagtggtgtgatatcagctcactgcaacctctgcctccacaggttccagtgattgtcctgcctcagcctcccgagtcgctgggattacaggtgtgtgccaccacgcccagctaatttttgtattttcagtagggacagagtttcaccattttggccaggctgttctcaaactcctgacctcaagtgatccgcctgctttggcctcccaaagtgctgggattataggcttgaatcactgcgcctggccgagaattaatgaattgtttatttctggaattttccatgtaatatttttggaccagcttgatggcaggtagctgaaaccatggagagtgaaacctcagataaggaggaactactgtacctgtgtagttaaagtaactaaaatggctagcattaaaatagagtttttaggcctttgctatgatctaggcactatttacccttttggaggattatattgagatttttattgacattttaggatttttcaaaacagtggtaattcttatttcacattgggcagggaatgatagtgctgttgagcatacttaacatagtgctcgatatattgtgtatactgaaatttaaaattcatataatatatgctatattttaagagttacttgttctgaatttgtatttttaaggactagcatgaaacataaggaaacaggtattttaatacctttgctgctgtcaagaaaaaattgtgtgtggatatcctttttttaaaaaaacaaaatgaaacaaaacaattttgtgtttgtggcgttggaaggttgaggttagggaataggcttagctcctcacttgcgagcttgaacagcttaggtataacaattttaggtgcagcttaaataatcaaatttcagttttccagtgttcttattcaatatattttattaattattattattattattattattattattattttgcagggtcttgctctgtcacccagcctggagtggagtggcatgatcatagctcactgtaaacttgaactcttgggctcaagtaatcccaagtgtcagacttctgacacttggacagactcctgagtagccaggactacaggcacatgccaccatgcctggctagtttttaaaagatttttttgtggatatgagatctcaatatgttacccaggctgatctcgagcttgcagcctgaagcgaccctcccgccttggcttcccaaagtgttaggattacaggcatgaaccaccatgccccgccctttccccccagttttaatacaaaagaatttgtggggaagtcagtaatttggtaatacagcaaagtggttcatgtaataataattccttctctatgaaggaagacaactttaggtttggtagggaatccagcaaaattctgtgttgaaaagaatttgattataaaaagaattgatgcctgggaaataaagtggcatggtgtagtagagcatgggttttgtttcgtgtctttgttgtttataacttttctgggtcttttttttttttaatcagaaaaatatgtgtcttgatatttactgtgtaaagttggtcatgaggagtggaaataatagcatgtagtgcctataacagtacttgctatatgttttggtggtcaatataaatagcagctatattaattttgtgattatgatattaaaggaaggctaaatgcataaagcagccggtcttggtggctcacgcccataatcccagcactttgagaggctgaggtgggaggatcacttgagcctaggagttcaagaccagcctgggcaacatggtgagaccctgtctctattaaaaaaaaaaaaaaaaaaaggaaggaaaaaaaatgcagaaacctcagatgaaattgaagatatatataaggaatgtctggtagcagaattgatttcaattttgttgaattaccaaatggttaagtatattaccaaaattacctatatgacagttttctcatgttaatatggaggattatattgtccgcctcataaaactgatgtatgtgcttaaaaatattaattattctatttgttggatgatttaggttggcctagtagcagaaaaggtcctgggtttgtataattcttttatagattgtgtttaccgaagcatataacattaaataagacataattttttggcatgtaggaaacttatttcggatacacagaccatggtaattttcgttatttgtaacaaataaattgtaatttgttatttatagttttaaggtcattatttcttcataagaaataagtataacctagcaatgactatactggacatattaacttgaaaaatcttttaatactaggtagtagattaaatggctggttaaagtatttcattaattatttttgaatgaagttgcacttgtatagttcaaaaggtttcaaatgccaaataaatcctaattcttcaaggtaattgcatgctgtatcttgtacagttttggatatcttgaaataagtttggtaatcagtatcaccagctgctaactctggttttattgagtctaaggatatggctggtatttttcgttacattggaccagggagaggaagtttaagtgttctgtctcagagtagaaacggaattatggaaagaattcttgccacacctgtggtctactatcattttaaatattcctagattaacaaacattgaaaatgctaaaactgagtaatacttcatttattcacgtgaaatgtcttgatcagataacacaaaaatatcagctgtactcagatgttttgaactgttgcaaaaatgagtgtaggtatgtgtggtaactttgtatgtagcttaagatatttctgagctgtttagctgatttagggggttttatttagctggagagcagtgcatgtggtactatttagtgaagttctctagcagtgaatataaatatgtatttgcagctaaaacacaaactcatactactggagcattaaatataaaaaaattaaccacaaacctgacattttatatttagatttttttttaaacttaagccctgtaaccaacatagattagtttggtgtttctcttacccttcgtaaacttccatttgcctctgatacaggcatgtaattatgatgtggtagccattggatgctttttctctattaattttctctcattttctcttcttttcttcctttctttagaaactgttgcttatagtttatgaagttggaaggtttcctttcatgtaaattttattatttattttttaagagactccctctgtcacctaggctggagtggagtgtcacaatcatagctcactacagcctcaaactcttggcctcaagtgattctcactcctgggcctcctaaagtgctgggattccaggtgtgagccaccatgtccagccccaaatgtttaaattaaattaattaatttagttttaaagacagagtcttgttctttcacccaggccagagtgtagtggcatgatcatagctcattgcagcgtcaaactccagggtgccagtgattctcctgcgtcagcctcccaagtagctgggactacaggcacacaccaccatgcccagctaatttggcctccgaaagcactaggattacaggtgtgagccaccgtgcctgcctcaaaatgttaattttaaaatcaggaaaatttccgatgtttctgttagggtttatagggtttatatttaatataaaaattatcaaaatttttattgatattcttgagacctttaaacatttatattttatatatgtatttatttatttgagacaaagtctcactctgctgcccaggccaagtgcagtggtgtgatcatggctcactgcagtcttgacctcccaggcttaagcagtcctcccacctcatcttctcaagtagctgggaccacaggcatgtgccactacacttggctactttttaatttatttgtagagacaagggcttcctattttgcccaggctggtctcgaactcctggactcaagggattgatcctcctaccttggccttcaaggtgctgggattacaggtgtgagccaccatgcacagccccttttttttatttttacagatttaggggtacaagtgcagttttcactacatggttatattgtgtagtggtgaggtctggacttttagtgtagccatcacctggatagtgtatattgtacccagtaaataacttctccttccttacctgcctcccaccctcccactctgagaccttttaaaaaatactggttttactacatcgatgtagcagaaaaagattaagtatagtctataataggctgttttcagaggagttgggaattttcatgtggtatgttgataatttcatttttcaaatataatttctgccttaatattttagttaatagaatttcttaaataggtaataagattagttttaggcaggcaataaaatcctcagggtcatgacgtattctgatatgctatgttttgacttttatgttctacagttagttttagcttaccttcttagcagtgatttatagttgtcagaacatttagggctgaatgtttagtatcttggctctatcatttattaattagctaagggatcttgggtaagttgtttaacctctataagcttcagtaaaatatatctcagggttatggtgaagattaaataagataatgaatctaaagtcttgtcacagtgcctggctcataataaagcatatagtaaatgatggtggtagcagcagcagtaatgtgtcattgtgtacatgttttgtttcctgaaatttagctgtaaggcaggaaggatcagagagagatagaaatatgttatatgcctacagataatattaacttggagaaacatgccatatagacatctaagaaaagataattgtcgtgttaccattatttcctcttttttccctttttctgtaattcctactcttgtgtttttttatttcttctgaagccagtgctctgtgtatctttgcaacttccatctctctctgatagttgttagcttaaataagtgaaagacataacttgaaattcttctttttggatatgttttaaaacctatattccattttaatatcaagtattttggtaatacttataatatgcaagacattgcatgggcgtttattcccatttacagaattggaacaacaattcttataacctgttaaaagattgaagataggtattacatttgtactagtcttaaatcctactgtaataagatatttgtaccaaccttaaatcttactggaactaagccatttgtgatagcacacatctgtagtccaagctacttgggagactgagccgggagcattactagagcccaggagtttgagaccaacctgggcaatatagcaagacaccatttcttaaaaaaacttactggaactggtgtaaatattatttttaactctccacatattaattcagttgtatatcaggttttttatgggctcagagtttttaactccttgaaaactccttaaagtgggagacataacgatgtatgcagatacaaattaatgaccttttatatttgcattgatacagcattttgaaatttgagcaaacattttaggatgtacttctcagtttgatatattgctatttattttggaggcaaataagaaaagaactgtggatgcatttggcgttacaaatacttagacaaatacccactaaaaaaaaatcgtgctataagtctgcacactctggtttgtaattttgtttaagcaaagttgcagtttaaataatgatccctgagatataattacctgtcattcacctacctgccaatttcccctagtgtatggtttctataaaacttactatgaaacttgaggtacttgtaatagtcaatttgagactaaaaatataaataattaaaaaaatatgacataggtggtagagcttagaggtctgtagaaattacctattcattaattcttttttttttttttttttttgagatggagcctcgctgtgttgcccgggctggagtgcagtggcgctatctcggctcactgcaggctccgcctcccgggttcatgccattctcctgcctcagccttctgagtagctgggactacaggcgcccaccaccacgcccgtttaattttttgtatttttttagtagagatggggtttcaccgtattagccaggatggtctcgatctcctgacttcgtgatctgcccgcctcggcctcccaaagtgctgggattacaggcgtgagccactgcgcccggcctattcattaattctttatgccaccttttttttttttttttttgagacagagtctcagtcttcgcccaggctggagtgctgtggcgcgatcttgcgtcactgcaacctccgcctcctgggttcaagcaattctcctgccttagcgtctcaagaagctgggattacaggtgtgtgccaccacacccagctaatttttttgtatttttagtagagacagagttttaccatgttggccaggctggtctcgaactcctgacctcaagtgatcctcccgcctcagcctcccagtgtgctgggattacaagcatgagccactgtgccccgcttcttttagccaacttttgttgtttagtgtatactagctgctgtgctcgtcattagggagggaagactagtaccctctcttattcagaacaggaaaaaagaaaaaaagatgcttttaggctccaggtcagctcccttctcagctgtgctgctaacctgcaatcctgacctcagtaatgatctcctgatatcttcagcattgtgttgctctctcccttttatttccttactttgtatcttttcagattagaacatatttttcttgtcatgacaaaggactctccaaaaattaatttcccctcatttatgcaaaataatacatatttaacaaaatttggaaaaagaagtataaataatattaaaaatcacaaagttaatgtcttatattgaattttattgtggtaattgcttttggcagtttctgttacttctgttctctttatagtttagccagagcaaactattaaaactcactttggtacttgtatgctcatgtttatagcagcatgattcccaagagtcaaaaggtggaaataacccaaatgttcctcagcatagagatgaatgcatagacaaaatgtatgtgggggggagggtatttgtatatgtatgaatatgaatattatttagccacaaaaaggaatgaggttctgatacatgctacaacatggatgaaccttgaaaacattatgctaagtaaaataagccagacagaaaaggctagttttacatataatcatataagtatgatcccacctatatgatatatatagaataggcaaattcatagagtcagaaagtagattagagtttacccagggatgcaagaaagggaaatggatatagtatttctgttggggatgatgaaaaagttttggaaagaatgctgatggttgcacaagattgtgaatgtattaaatgccatgaatcatacatttaaaaataatgagaatggcaaattttatatgttttactataaacatacttttaaaaaaagtctgtttgaaaccgttaaggacttgtagctagttcacagttttacttctgagtgaggcttaggtgtctctctatatattgttcatgctccatcattttttcaaaaaaagtactgattatgtgagtggtgagtttgttgacaattaaattttcttcttggttttctttttttccataaatatggatcacttataatgaaaacatttacacataagaattacttttttttctttttgagatgggatctcactgttgctcaggctggagtacagcggcatgatctcggctcactgtaacctctgccccctgagctcaagcagttctccctcctcagcctcctaagtatctggaacgtgcgccaccacacccggctaagtttttgtattttcggtagagatggggtttcaccatgttgcccaggctggtctgagctcaagtgatctgcctgcttgggcctcccaaagtgttgggattgcaggcatgagccactgcgcccagctaagaattactttaaaaacaaaattacattagacagtatttgtcttctttaggctgctgtctagtgtctttttttttctatctgctcttgatcatctttcaccttttttttttgatgtgtaggtctcattccttaattataagttttatgtaaccatattggagataattagaaaaaagagaaagaactctctctgaccccaaatttagtattctgacataacctttattttaattttgatgtattttcttcatgtctctgcctatatctttgatctaatttgaatatatgtgtaatttgagttcttttttcactttttgttgtattaacattttgcatgtggtctgcctgattgttgtcttaaccagatttttttttttttttttgtgagacagggtcttgccctgtcacccaggctggagtgcagtggctgaataatggctcactgcagcctctgacctcgtagactcaatcaatagtcctgcctcaggctcctgagtagctgggaccacaggtgtgcgccactatgcccggctaatttttgtattttttgtagagacggggttttgccatgttgcccaagctggtcttgaactcctgggctcgagcaatccacctgctttggccttccagagtgctgggattacaggtatgagccaccgcgcccagccttaaccaactttttaaaacaaaattacaaaaggcttacatgatactaaaaaattttaaatacagaagtcgctaaagtagcaaagttttctttctctgtttttatttcacttgctacattctcactatcttgaggtagctgttaatagtttcatagcctatcaaaatatggtattatattgtatgtatatcctattctttacctatatttgattggctccatcaaattgggaaccatgttatttttaatggctgcatcacattctgttgtatggtagtgtcataatttatttgcttattttctgattgatgaacattgtggttattaccagttttttcttataaataattctgtgattttttttttttttttttttttgaggcagagtctcgctcactcttttgcccaggctggattgtgcagtggctcagtctcggctcactgcaacctctgcctcccgggttcaagtgattcttatgcctcagcctgctgagtagctaggattacaggcgtgcaccaccatgcctggctaatttttgtatctttaatagagacggggttttgtcatgttggccaggctggtctcaaactcctggcctcaagtgatccacccactttggcctcccaaagtgctgggattacaagtgtgagctaccatacttggcctgattttttttttctttttaaaaataagagatctactccagccttaattttagtgcataaatccatatacctatactatttataataggaagttatgtagaatcatctaaattttttttattgtacagattgccacagcataggaattcatgactttaaacttactcaaaatttcttctagagaacaaagataaaactcaaaactgtagaataaaaaaaaaacctcttcaaaaattagtactttacatcataaaagactgtttggcaagcccaagataaacgtttgtttttgacttataagccaatgttaggcccataatctaccataggtcaaatctcaaaacggcaaattggagtctgtccaaattttctgttgtattgaatatttttgaaatatttgaactattagccaggacgtgagcatttttgtcatacacggatttgttgtaactaaatttgacacacgcaccgtcaaagtgtttgtttagtccttgcaggtgttcatggcatattgaaagagatattcagtcttcctggtgctggtacctgaagagttctgatgtcatttggatctctttacttttgaatggaagtttacaaaaagcttacccagagcttcaagtcacagagcagtctgggtcagttattacccttacacataatcacctttcaaagcatgaagtaatacaagggtaatgttcatttgtctgaaagctctggttataagaaacattcagacagggcttaacttctgctactgttgccagtgagggacagcccaataccagtgcgcatgtgcccaaggccctgaacactagtttggaagccaggaggacacatctgtagcttgtaagatgaggcgtgcatagtagataccatctgctaacaacagcttggttgatgtaggatggcgatacagcggtgaggtctatgtgactgtttgacatgctgaggttgctgaaagtgaactggctgtgagggctgggagactgtctagaacacacttagttgtgccatttgaggtcctgcttgtcctctctttgcttctttcacatcattatcatgagcagtcaatagctgttcagtacacggcactaagaaataccaggagtaagcagtaagatgatgtaatgatgtagtcttgtaggccatgttggagaaagacgaagtataatcctcgaagaagccatacatgtagcagctacagaagaaagtgcataatttagaaaggggtaattttgcaacagtacttccaggaaatctgcatatttggctgtgtagtgtttaatcttttccaggcaaatcgttggccagccatcgtgaagatctgttttgtgtactacttcagagagaacaaattcaatgaaatgggcagctgttggaaggcggaggtccattccactgataggtttctaatgataagagttacacatgtagcaaattttgttttgttaatactacattcatattagtcataacacctaggctgttgagctgttccagcttaggcacactatcttctttttcttcagatttacttgctagaagcagatgggaaactgcagctaaatacagctgctagatagagatgtcatagcaatccataaatagttctagtaaatagcaagatgctggtgtagaaagagcgtgacgtgatcgctcacaatggcagtcaagtcagcaaaatactggctgagactcagttgaggggactggcctttgtatgagggcaacttcagctctttgtaccaagtgctcggtgaatattggcagccagctctcctcgccatcactgcttctccagctccctgggaccctgaggtgcatgcagccagacacgacaactacagtcccgccccgaggccctcacagcctcagtccccttggcgtcggccccactggtgctgcagacagttggctgcgaagcaccagtctcagctctggccaagctccccccattgttaaaggactggcaggcggctcccaattctgtgattaatttcagtacgtaggtccttgcttatttgagtattgggacagatttctgagtcagcccatcgacatgtatcatggatacttccaaatagtcgttctaaacagctgtatgaatgaatgtattcagcaataatgtctttaaaaatactaatttcctttagacaaatcattagtttttttgtttttgggttttttggtttgttcgttttgtttttaagacggaatcttgctgtgtcgcccaggctggagtgcagtggtgtgatcttggctcactgcaatatctgcctcctgggttcaagtgattctcctgcttcagcctcctgaatagctgggactacaggtgtgtgccacccacgtccggctaatttttatattttttagtggagacggggtttcaacatgttggccaggctggtcttgaactcctgacctgtagtgatccacccacctcagcctctcaaagtgctaggatttcaggcgtgagccactacagctggcccaaagcatcagttttttataatgaatatttcagatgcaaaaaaaaaaaaaaaaaaaaacctatgttcacatcacccaccttaagaaataaacattataaatgtacttgtaaacataatccccatcttctttaagatataacattatacttatatgtatgtttataaacagtatatcatataaacatgcccttttacattttcattattgcccaactttgtgtgttgaacataatatgtcacatgaggtcattagcctccaggatggctgtcagtggtctccacttccttatatttatgctgttatgcgctttcttcccatgttgaatagggctgacttgtgtaaccaattgaatattacaaaaatatcagagtgacttatgaagctaaatcatgtaagcattttctgtcttgctttcttgttctgggggaagccagttgccacaaggtgaagatactcagcagtcttatggaaaggtccacatggtgagaaactgaggacttttgccaataactatatgagggagccatctttgaagcagctcttccagccccagtcaagccttcagatgacagcagcactagccaagatttctgcaagctcatgagaggccatgagccagaatcgcccagctaaactgtactgcagtttctgacatacagaaactgggagataataaatatttaatgtattaagctactaggtttggtagtaatggatgagagaaagagacttgtaattgtttccatgtttgcctccccatacttcattactagtgagcaatttgaagacaggacaggaaccatatgtcttacttattttcccactcaatgcctagccttatgcctatgtttagtaagtatttgttgagtgaaattgatagtattctggtggaagtaaaaaatttagaagggatattaaatccctaaagctgagatagcctgatgtttgaatcatgagtcattgttggatagcatgtaaagaccacattgtttcttctgaatagtagttaaagtaagcctctcagctactaatgctaccctggctatgggagtatggcattgattttgaagttatggcatgtggcttttactttactattctctggggcttgggttaggatacaatctttcctagatgactttcatttcagacttccttctaggcatattaactgaagctaaattttttcctttttctttttcaaaatatggaagaatgtaaaaaacctaaagtcctgtcagtttaggattttgctggtatatgtagcaagagacagtacttaactatatcctagtggattgtttttatagattatggagagacagtattactacagaggattatatctaattatattcagaaaatatattccaaaattagattccaaaattaggtgtaattttgagtcacacatttggtactttttagttcttgtaacctgtgttgtttaatatggaggcccctagctacatgtgatgagtgagctcttgaactgtgactagtctgaattgagatgtggtgtacatgtaaaattcatactgaatttcggacttaatattaaagaaagaatgtaaaatattacactaataatttcttcatattccttatctattgaaataatgttttgagtatattgggttaaaaaatataatttcatttgttttacttgtttttactttttagaatatagctactagagaatcttaactgatatggcttgcatttgtggcttgccttatatttctattagagagtgcttttctattgattgattgattggttgattgactgtttgattgagatgaagtctcactgtgtagcctaggctagtcttgaactcctgggctcaagtgatcctcctgccttggccttccaaggtgctgagatcacaggcctgagccatgtcgactggatgagagtggtttttaacccatcaaaatattcagttcttcagggcctttgtacattttccttctttttttttttttgcctgactctttgtttatctggcttcttcctgctcatttcatagatcttatcttaaacgttgcctcctcagaaaggcagtccttatccaccctatcaaattaagttctttagtgttttgccctcatgtcatgtatccttctctgcatttatttattcactatttgtctgacttcttaactagctctgtgagggaaaggaccatgtctattttgtttatgacgacacttttagcacccaataaagtgttcttttagaaagtagattctaaataaattcttgttcagtgagtgatactggtattactaagcagtgggctcactgcttgatgctcatagaacccaatactatgacaccggcttttgagaaaagaaaaagggctttattgtgagctgactggcaaggagacaggagtttcagaaagaaaatatggaggaggatgtcataaaagaaattaggaaaacagggctgtgctgcaccgctgcccctcgtcatgctcaggtcgactccccgctccccacaaagaaggaaaagttcccagaactgaacaacctgctgtgcttagcactccgattggtccttttctaaattaaaagggcccattggagtgctaagcacaacaggtgaaaaaaatatctgtattaagacgtttcattaggctgggtgcagtgagtggctcacgcctgtaatcccagcactttgggaggtcgaggcgggcaaatcacttgaggccaggagttcgagaccagcctggccaacatggtgaaaccctgtctctactaaaaatacaaaaagtagccaggcgtggtggcacgtgcctgtaattccaggtactcaggaggctgaggcaggagaattgcttgaacccaagaggcggaggctgtagtgagctgagattgtgccactgtactctagcctgggcaacagagcgagattccgtcattttattgaattttcacaactaaggggctaaggagaagatagagaagttcccagaggtaaaggaaaaatgggttagttaataaaattagagtagttacaggctcttcaacaagaatactggaagcaaaagacaatagagggcaatatcttaagtataagggaaaattattatttttttaagacagggtgtctctctgtcgcccaggcttgagtgcagtggcgtgatcttggctcactgctacctccgccccctgggttcaagcaactctcctgcctcagcctcccaagtagttgtaattattataggcgtgcaccaccatgcccggctaattttttgtgtttttagtagagatggggtttcaccatgttgcctaggctggtttcgaactcctgagccagatgatccacccaccttggcttcccaaagtgctgagattacagacgggagccactgtgcccggttgggaaaattatttgtaatctaagagtttatagtgcagtcattttcaagtgtaacagtagaaaaagcattttcacatatgcagtgtctcaaactcacctctcatgcaacccctttcaggaaggtagtagaggaggtactccaccaaaataagagtgttttgagcaaagggaagacatagtgtttaggaaacaaatgatccaacccaagtgaggtgaaaggaatacctgggatcacagttgtgtaccaggtgtagagcaactagtccagaatggagcaagtcagaaggttgcagaaaggacttgtacaaaaatataagattgatagcacatgtgatatgctcgaatatgttgaggagatttatataattggatgaattgggggtgaatttataagtacaaataaagctaaacaattagacatttattaactccagggaaagtaaaaaattggtccaagaaagtaaaagtaatcacagtatacctcatagaacaactgtgactaaagttacatagtcatgttaatgcatacactgaatattggtgtaaccaaaaatatgttttttatttatttttattttttttgagagggagtcttgttctgtcgctcaggctacagtgcagtggtgcgatcttggctcattgccagctctgcctcccgggttcatgccattctcctgcctcagcctcctgagtagctgggactacaggtgcccgccaccatgcctggctaattttttgtatttttagtagaaacggggttttaccgtgttagccaggatggtctcgatctcctgacctcatgatccgcccgcctcggcctcccaaagtgctgggattacaggcgtgagccaccgcacccggcccaaaaatatgttttaattacatagggataatggaatgtatgaagtgtttgtatgttatggtgggcaaggttgatgatatggatgatggggaaagaactaattgacctttttcacaggaagaagtcaacagataaaatattacttttttttttctggtcataacctcatgtaagtggtaaaaattaaaagtaaggggaaaaaggcaacggggtagacatttattatagccaaaggagggtcaggaattctacttctggatctggggatgataggaaagttcaaaaattatttgcaaaattttgttcatatgtgcatgaatttctcaaaggagtttgtgacccctaaaatgtctaaagagtatagtgtagtgtgatgattgtggtgtttttcagcgtgttcgtgaaagtgttagttttagttttgattcttgatttatttttatgttttcatgtattcattatcttgttatatgaaagatgacttagtttggtaaagcaaataccattttttatttggttttgtattaaaataaacctcttaagtattgatttgtatctgtgctgccttctgagttaatgtcttcggctcttctagttcattgattttctgtttatgtctgtttaattctctatccctctgtcttccccacatctcacctccctttttttcctatttcatttattaaattttttatttctataagttccacttggatacttcaaaaatttgcatgatctttgtttgtatcctattccttgctcatttaaaaaattcttttattgctttaagcattttaaaagtagttatatattctgtatttgataattccaatagttgaagtgcttgtgggtctaattctatgctcagctgtcatttattgagttttgtctcttgtgtgagttatatttttgagtggtgagcttattttcatctgtgtcaactttggtggcttgattgagcattttaagagacttagagagcagttatgtgaacatgaattagtatggatatttggaaatctgaggctgtgggcccccttttagcaggatgtagattatgtgtgataaggttggatctacattttagtgactcttcgaatgcttggcaaagtacattattttataacactttctgtgctctaaatggggagggagtttttccttgtctgaagttagcatgatttggctaattaagtgaatactcatattcagtagttagtactctcctgcttaactaggtgtatatatttatttacatatatttatagatactatatatatatgtagaaattaccctttattccacagagacatttattgagcatctggtttatgatagacaaggtctttgatactggggatatagaggtattcaaggcagtctctcctgttggaaaattaaatagtagatgaaactgaactttgtatatattattaaagatgtgctagagtatccatattaaaagcttctgaatgcccaggcttatatgttcatattgtagaatggttgccttttaagaagttaaaaattaggagctccagctgaaggaggaggttaagtaaggagagctctataccatggctggtacaaagctaactgccagcagatgcaccagtggtaaaacacccaggaagcaactggctacaaaagctgcttgcaagagtgtgccctctactggaggagtgaagaagccttatcatcatgactataatacaatttatttgtcctatctcctatctatttggctattaagaataaagtagctatgaaggttttctttttctttttttttttttttttttgagacagagtttcgctcttgttgcccaggctagagtgcaatggcacgatcttggctcaccgcaacctctgcctcccaggttcaagtgattctcctgcctcagcctcccaagtagctgggattacacatatacgccaccacgcccagctaatttttgtatttttagtagagatggggtttcttctgttggtcaggctggtgtcaaactcccgacctcaggtgatctgcccgcatcggcctcccagagtgctgggattacaaccatgagccaccgtgactggccaatatgtatttatattttcttagtgtacttgtacctactcatagcacactatagacaaatgaaaagatgtttttttctcaattatttgaagcctctgtctccccaaaataaaaataagtctggtatgctgtctttactgatactctatacttttagtttcttggttttatttcaagcactgttaaatattttaattttgttttgtgggataatgtgatattgttccagttactgtagcggtgtaacaaaccaccatgaaacttaatggcttcaaataatcattttagtatgtgcttagattctgtgggtcaggaatttagacagaggattatgaagaggacttgtctctgcttcacgtctttggtctcagctgggaagacttagagtctggggctgactcttcacttagggcctagaatcagttgggggtatgttcacatttgtgcctggtggttgaggctggaacctcagctggactgttagtgagaatgcctgtactctccatgtggtctctgcgtgggctagtttgggcttcttgaaagcatggtagccagattccaagagttaagctcagtaataacttttggtacccacttttggttgaagcagtcagcgagctttgcttgggctcaaggggaggggatgtggacttcaccactctctgggaagatgtgagataggaaatgtggccgtgttacagattggattgtgtccttcaaaaagatatgttgaagtccagctatcacagtacccttgtacctcagaatgtgactttatttggaaacagggttgttgtaaatgtaattagggaagatacagtcactggaggggagaatgtcatgtgatcatggaggctgagatccaagtgcttgaagtgctgcaactgcaaaccaagaaatgctggtcattactggcaaaccacccaaagctaggaagaggcaaggaaagattctccctacaagttttagagggagaatgaccctgctgacaacttggttttggacttctagcctccagaactgtgagacaatacatttctgggtggttttttttttttttttttttttttggtgagatggaatctggctctgtcacccaggctggagtgcagtggcgtgatctcagctcactgcaacctccgccttccgggttcaaacaattctcctgtctcagcctctcaagtagctgggactacaggcacccaacatcactcccggctaatttttgtatttttggtagagacggagttttgtcatattggccaggctagtctcaaactcctgatctcaagtgatccacctacctcggcctcccaaagtgctgggattacaggcatgagccaccacacccggcttatttctgttgttttaagccacccagtttgtggtactttgtaacagcagtactaggaaactaagataacaattagttttcttgctgcatctgcaggggattggttccaagatcactgccctcatactaccatggatgcttaaatcccatatataaaatagtgcagtatttgtatataatatacacacatcttcctgtatactttaaaatcatttctagattacttatgatacctaatacaatgtaaatgctgtgtaagtagttgttatacagtactgttttaaaaaaaatctgtattatttttaattgtattattatattttgaatatttgtgatgcatggttggttcagaacctgcggatgtggaacctgtggactatataggccatctttgggaaatacagacttttacaaatgtgtcataaaaattattctatagcttttcccccgttacttgtattgggtaacaatatataataatatatggttgttttgctcacttatacttcttttttaaaaaagcttttttttttttttgaaccagagtcttgctctgttgcccaggctggagagcagtggtatgatcacagttcactgcagccttgacctcaggctcaagtgatcctcccgccttagcatcccaagtagctgggatcacagacacacgccaccatgcctggctaattttctttttaattttttgtagagacagggtctcgctctattgcccaggctgatcttgaactgctggacacaagcagtccttctgccttggcctcctgggctcaagtcatcctcccacctcagcctcccaagtaggtgagactacaggcatgcaccactacacccggctaatttttgtatttttagtggagacagggtttcaccatgttggccagactgatctcgagctcctgacctcaagtgatccacccacctcggcctcccagagtgctgggatttcaggcgtgagccactgtgcccagccagtacagtactttaaaagttatttttagtgtgtatagctgcaaagggaattttgaataggagataccttcattgaaatgtgctatttaacaatcaaaattaatcaaaagtcattgagaaagtattgagtactcactggtaaaaaggaaaggccttagacacattaaatttaacagagtttaattgagcaaagaacgattcacaactcggacagccttcagaaccagaacaagttcagagaactctgacctgcaatgtggtcaagcagcatttatggacagaaaacagaagcgaggtaaagagacagctcttttggttacagcttggcatttgctttattagaacatgggttcaatgttggctgcctaaagcttggttgctgtgattgattgagactcagctatttattacgtaagtatactgtacacccaacttaggctttcagttagtttgccaactaagttaggttgctctttgttatgtaaggactcaaggacatgggcatccttaggccaagtttagtttaacactattcaccaattttgttttcaggtcatcaagaagattcatgaagagtaatgaatggtctgtctttgacctacaggaatatatatgaaataatgtttttgttttatttttcagacaagctctcattctgttgcccaggctagagtgcagtggcataatcatggctcactgcagctttatgctcctgggctcaagtgatcctccacctcggcctcacaagtgcctctactacaggtctgtgccaccacacccagctaattttttttgtagagatgaggtctcattatgttgcccaggctggtcttgaattcttgatctcaagtgatcctcctgcctctgcctcccaaagtgttgggattataggcctgagccaccatatgtggcctgtttttctttcttaaggtactgagaggcagtagtacatctaatggtttataatataacagtgtaagcataatatggcacatatagcactgtggagatgaggtgataatgtatgtgaaagtactcagtgaatattatcattattaatgaatgtcacaatatttaatataaacaagaagtaccatagaagtgaagagaaacatgacacagagcacacaaacaccttaaagaatgagtactgttggcaactgagcagcatttctcagaatttgttttgcagtaaagagtgaaaaaggctgggtgggtggtccacgcctgtcatctcagcacttttggagcctgaggcaggtggatcgcttgagccccaggagtttgagaccagcctgggcaacatggtgaaaccctgtctctaccaaaaaaaaaaaaaaaaaaaattagcctggcatggtagttgtgtgcctgtggtcccagctactcaggaggctgaggtgggaggattgcttgagctcgggaggttgagactgcaacaagccatgattgcaccactgcactccagcctgggtgacaagactctgtctcaaaaaagagaaaaacgattcctgactagtcaagtttggaaagtaaattcctctaccttctacttttgacagtgtataataatgcctgagaattgctgtaataaaaaaaattttacttacggacttcagcttttaatgatgtgattcactacatagcttggaaaaactcttcctctataaagcacctcaaaatgcaaacatccttttaaatgcaaagttgtattttcaagaatgtaagagaaatgccccttctccaaaaacagagccactctagaaaccaccagattgtcttcaagtctgccgtcctctgtgtgtgtgtgtgtgtgtgtgtgtgtgtgtgtgtgtgtgtgagagagagagagatatttggcataattatattaatttcaaacaaagcaaacttaagaaggagaattatcagggataaagacaggcattacataatgataaatgggtccgttctcaaagaagacaaaatagtctgtgaggcaaaaaccaatagcagtgtaaggagtaatagacaaattcactattatagttggatgcctcaacacctctcagtaatttatagtgtagcagacagaaaatcagttaggctatagctgaatagcaccatttatcaactggatttaattgatatatatagactgcttcatccaacaacagcaaaaaacacatttttctcaaactcatatggaacattcgccaagattaaccacattctgggacataaaacacatcttaacttgtattctcagaccacggtggaattaagttagagatcactaacaattatctatacaacttgtgttgtatagttagaaagatatttggaaaatctgaaaatacttgggaattaaaaaacacacttctaagtaacacatgagttgaagtctcaaactaaaaatattttgaactgaaggaaaatgaaaagcagcaaaagcagtgcttagagtttgatttatattgaatcatatagtagaaaaaaagattcaaaaatcagtgattaagcttctactttagggaactagatagaagagcaatataaacctaaagcaagcagaataaaataaataataaaaattagtagaaatcagtgaaatagaaaacaggaaaacaattacaaaattaatgaaagaaaaactgtttcttttaaaaggcattgaaagtgacggacctctagccagggtaacaagaacaaaagagagaagacacaaattactaatgtcaagaatgaaaggggtaattttttcccccagatttcattgtgataaagtattcataacaaaatttacagttttaaccattttaagtctataattaagtatattcatattgttgtacaaccaccatcaccatcatctctataattttttcatctttccaaagaaactctgtggccactaatcaataactccctatttcctcttcccatggcaaccaccattttactttctgtctctgtggatttgactatctcataaaagtggaatcacacaatatttgtcattttatggctggcttttttcacttcgtataatgtcctcagggtgtgttcatgttgtggtatgtcagaatttccttcccttttttttttgagacggagtcttgctctgtcgccaggctggagtgcagtggcacgatcttgatgcactgcaacctccgcctcctgggttcaagcgattctcttgcctcaacctcccaagtagctgggattacaggcgctcgccaccgtgcccagctaatttttgtatttttagtagacacggggttttgccatgttggccaaactggtctcgaactcctgacctcaggtgatccgcccacctcagcctcccaaagtgctgggattacaggcgtgagccatcacgcttggccctccttcctttttaaggctgaataatagtccattgtatagagatagcacattttgtttatccattaatccattgatgtacacttggttgtttatcccttttggctattgtgaataatgctgctatgaatatgggtatataaatgtctaagtccttgtttcagttctttggataaatacccagaagtggaattgctggatcttataattctgtgttaaattttttgaggaactgccatactgttttcgacagcagctgtgccatttatatttccattaacaatgtcaacacttgttattttcctttttgataatagccatcaaaatgtgtgtgaaatgatatctcattgtggttttgatttgcattttatttaattttaatttaatttttttttttgtgagacagagttttggtcttgtcgcccaggctggagtgcaatggcactgtctcggctcactgcaacctccacctcctgcgttcaagcgattctcctgcctcagcctcctgagtagctgagattacagggacccgccaccacacccagctaatttttgtatttttagtagagatggggtttctccatgttggccaggctggtctcgaactcctgacctcaggtgatccacctgcttcagcctcccgaagtgctgggattacaggcatgagctaccatgcctggctgatttgcattttattaatgattggtgatgttagctgggcacagtggctcgtgcctatagtaccagctactcaggaggctgaagcaggaggattgcttgaggccaggagttcaagaccagcctgggcaatatagcaagacctcatctcttaaaaaaattagtaatgttgaacgtattttcaaaagcccctgtgattattggccatttatatatcttctttggggaaatgtctgttcaaatcctttgctcatcttttaatcagattatttgtttttttttgtgttattaatttgtaggagttctttatatattctagatattaaacccatacagctatatgatttgcaaatatttgctttcatttttctgggttatttttactctgttgatacacaaaagtttttaattttgatggagtccaatttatcttttttttccttttgttgcctgtgctttttgtgttagtctaaggaatcattgccaaatcattgtcatgaagtttttcccttacgttttcttctaagttttatagttttagttctattatttaggtcttcaatccattgtgatttaagaggtcttttaaatgagctgaatctttgatttcttatctctaaaatggagacattacctactttatagaattatgaatgagcactaaaatgagttaatatgaaataatgtgaaaagtcctaaaaaataaaatactgagttgtcagatcagcctttatattataaaacaagctaactccacagtgacaaagaataaccccatcagcccagttttctgaattgtaccagtttttttttctttttaaaataaaatcaaatgaagttactgtctgtttgaaggcccttttcgaaaatagagtttgttatgtaataatatcctgactatccttttggaatctccaggctttaggaattagtctgattcaagaaatctcaaaaataaaggtcattgtggtaggaatgggaatattttgcagctcttatttctgtatctctcagatactcctcaacttactataatctggtttctgccttcttttggtgaaatggactcactgaagtcattagtgaccacatccattgccaacctttggtcttgctcattcttgatagtggttaagagcaaggaatctccaaccagattgcctgtgtttgacttttattagctttgtgaccttatgtaagttgtatagcatttttgtgtcatcatttcttcacttgtaaaatgtggaaaatagtaatacctactttatagcatttcaataattaaatagatttaatacatataaagtgtttacaacagtacctggtgcgatttaaatgctgaaaaagtgtttgcggatatattcccctcctttttgaaactttgtttccaaacctctggcaccatacagtgggagttgcatggaatctacgtagagtttaggtagcgcagaaggctggtcaaaatttcatatcagagtccctaaaaaccataccatgtggaaactgttatactggctttcagtactaagtctaagactgccatacaattaacaaagatactgaagggagtgatagggatactattttagatacttttccatatgactataagaaatacaggaataatgacagggtaaggtactatctttaattatagcagtctccatgctttgcatagtgacttacacagaatactcagtaaatattagttgattttatacatacatgtatacagacacacacatacacacatatgtatatctgacatagtaaaagtgagcccaataaaaaataaaaccaaaatcttgacctgtgtgtctttggtccactcatctcgaggaaggaacatgagatgtctggttggcagtccctcataatggccagttttgtgagaatcaaagagtgtaagaaaattgtcaagagacaagaaaccagaaaagaaaagaaaaagcggagataaaaatgagtgtaacacagattagaggggtggggataaacagcaggtactttggagaagctaataagagacggaaaataaagcagttttgcattgtggtgtggtggtggaaaagtctcttagtcctcaatagcccttgaaagtgtttgagcttctgtgttaaaagctacttgtctctggttcctgtactttttgaaggaagattgtaaaatgataatagatagtgaaatgtttatataagcaagctgtatgtacactaatggtaactatattttaaaatcatctcatgtgttcattcagtaaacagatatgaaaaagtattaggaaatattccctggctctaaggaagggtaaaaagatagaactgcaaaatgattggtgaatctttgtgacatctgtatatagctgaagtcctgacattatgaaatgtgttctgccgcactgcccctttttttttttttaaaggtaacttgacttttgacatttaaagatctgttgggtttttgactctcggtgatggcacaggtacccatactcatagttcctctttacccacaatagtaccctttacccaggggggaatattatactctagaaatgtgattcagtttcacagtatgattcaggaagtaattaaccatagccatgtccttttctccctcatgattttttgatctaaaatcagaatctttaaaaatagatctattttagggaagttaagagcatccttttaataaaatataaagtgatataatcatgtctgtttctcatgggagattgtattcaactattgtaatagtatgtaacgcttttactacacttaaaaaattgagatataatttatataccataaatttgccccttttaaagtgtataattcagtggcatttattatattcacaaggttgtgcaaccttcaccactgaccaatcccagattattttcatcaccccataaagaaatcctgtacccattagtagtcattttccatcccttttcccaggccctggaaattactgatctacttctggatttgcctgtttggaacttttatgtaaatggaatcatacaatatgtggccttttttgtgtgtgattactaagcctttttaatgatggttttagcattttcaaagtgtgttcgctttttttttttttttttttgagacggagtttcgcttttgttgctcaggctggagagcagtggcgtgatcttggtgcattgcaacctctgcctctcgggttcaagtgattctcctgcctcagactcctgagtagctgggattacaggcgcccgccaccatgcccagctaatttttgtatttttagtagacacggggttttgtcatgttggccaagctggtctcgaactcctgacctcagggtgatctgcctgcgttggcctcccaaagtgttgggattacaggtgtgagccaccgtgcccggccagtatgttcactttttaaaataaatgcataacacctctatgagatagacaggaactttgtgacatatttacattgtcagatttgtttatatttatttatgtgacctcaatttaccctaggttgaggaaaagagattcagaggtggcagggtggaagtttggaaaagtaaaattaaaggaaaaatagtacctgatgatatatgaaaaaataatttagccctgtgggatttctagattctatgaatattaaactttattaaattgcagatgcaattaaatactctaactatatttaagaacttaaaacttgaagttcagtctttagtagttataggctgaattccatttcagtgaggtctaaagcatgtcagaattgtgcttttgattatttcagactctttaaatcgaagcctgttgctacagtgtgcagaaggggtatgatataaatttcttttaataaagcaattaataggtgtcttttgcttttgcagcaattaacttactgagtaggggagtttaatataatgaaaatgtaaagcattaattattgaaaattgtaagtatatttgaaattattggtaaagtgtaccatttttttataaattttatacattaggttttcttccgtttttctgtaaattttatacattaggttttctctttttaaatattagagtgtgctttggggatgcgaatttgtgccattttcacaattgagtttatagttgttatcctaagatcgataggataacaaatcacacagtaggctatcttagtgcctactatggcttctgtcatttcgtggcacaaataaagttttggctaaattattatttggttcctatacggccttttgccctgatgagctgttttcatctatgagttgacaggaaggacttcttttgcctggaagcaggcataaacgatcacctcatgcttctctttcttaggtctcttatgccattcaacttttctttcttgggattcgtctctcaacggtaacagcccactgatcctttctataatatcatttctaaaggaagtaagttctaaaaggggaaaattattggcaaatggaaagaaaatgagaggcatcttgagtttaataaaactcttgcccctattcagcacttgtaatggaatctttgtccttttagatgctccatcctcaggttaagtggcttaactatgtccttagaattgcttttccattttatcctttccgtacatggaatttccctgctaaattgaagtggaggaagtggagacagagaaaaagccatgtatatattgagggcaggaggaaatgcttgggtaaccaatgaggagagtggtacctactaccaggacctggacaggattttttttttgtgtgtgtacatatgttcatatggattgccatatataaaccagtgttagctttgaacagtatgtacattttctttttcagctgaatttgttgtatacatatctgcttaggaggttggcatggtttatgacaaatatgtgagcatatgtataattcgttgaatcttagaaaagagaggaatcttaaaggcttttttcttcctggttagccacctaaaacagaaacttaacccttaaccaacgcttgacatttggcttttacaattgccacattaacgtagctattggtagagaatgtactactctttcctaggcatcccattctatttctgaataagccaactattagaaattctaccttgaacccctctcattctattaacccagccatttaccataattttgttcctggggtgctagtccctcttctataacaacactctttagtggtttgaagagagatcaatcaagggcctcactacattttatttatgctaaatacacccagtttttgttgaattgttagtcatgttacaggatttccctgatcatctaatggacatgttttaattccttgacttgcatatgtttttgactaaaaccccaagaatacattttacatcctcactcaatacacccatatacatacatacatgtaggatgtatttttaaaataacaaaaatttcattagacagcatatctttaatttgatatttttgctctttttcatttttgaaacatgctggttgatttttgtcactcctgatgggtctcagtttggaacactgttctgatttgttcatgctgcagaactgaaataaacagtttgcaaaagctggatattagggtattgttgctaaaacaggttttacctttacttcctcaaagagaatattctgatgatggttattaagtaaatcctaacagaattattaagttctcggtaatgaatacagtgtaactaaagtatatgcaacttttatttttgtccttaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgacttagaactcctggctaaactggaagaacagaataggtgagtgaggttgcttagcttttttctctccaattatacaaatccagccattcatatttacttacactagaatttttttttctattttttggtttcttatttatcaaagttatttacagaagtgttcatcttttttggggggagattggtcttaaaagagactaacattttcttctggctcaaatagctttagagatttgttttcttaatatagcaaattccctaaatccttcttgaattttatcaattttttaaaaagtaaatgaaactataactttataattttaaactctctgaacagtctcctttggtaaaagcataaaataatttaatccagtatagatatctgatttgtggtttagagtgcaaaatcttttcataaattattcatagaaagcaaaatatccttttctcctaatggtattaaatagaatagttttctgctctgctaggaatgcatattccggactccgtttgtttccttaccatgttattgtcagaggctctttagggcatcatctcttttatatatttatttatatatatataatatatattataatagattatattataataatatataatatacaaaatatataatatactttataatatgttatatataacatatatcatattatattttaatatgattatattatattatattatatataatataatattgtatatttcaatctatatatatgttatatataatatattttgttgaattaattatgatatatgtatatataatatatatgacatatatcatatatcatataattatatataatacataatataatatatacattatatacatatggaagagcacccttttgtgctcagtcaagctatataatgctactggcttaaaatcataacaaaaataacttttaacaggttttttgatgtattgttgtaatcaactatgcgtaaactgtacaatttgatacattctgacatatgtatacacctgtgaaattgtcgccaaaatcaagaaaatgaacatctccattatccccgtcgctgtccccaggcagccactgtagtttgcattttctagaattttgtagaaatggaatcatacagtatgtagtttttttggtatggattatttcactcagcataattttgaaagtcatgttatagcacatattgatagttgattcctttttatagtattccatcatgtggaaatatcacagtttattcactcacctgttgctattaaatgccataaacatttgtgtttaagcctttgcatggatatatgctttcatttctcttggaatggaatgactggatcatatggtaggtatatgtttaactgccaaactgtttttcaaagggcctgtatttttgatatcccgccagcagtgtatgaaattaccagttcttctacatccttgtcaacacttggtatgatcagtctttttagtttaagccattttattaggtattagtatctctggttttaatttgcatttctctgttggttttgagcatctttttatgtgtttatttgtcatctgtatatattctttgattttttaaaaaaaatttgattatttgctttcttattactatgtttggagagttctttatatgtttggggtaaaagtcttgtatcaagcacatgactttcaaattcttcccccagctggcagcttaccattctcttaaaagtgtctttcaaaaagcagaagttttatcttattttatttatctttgagcattccaagtttactcctttaagtaaatctaaagccactatacatgtccatgacaattagaatagaaaagagacaaaggataaatagaaatagtttctgttggaggtggagcttgcagtgagcggagatcatgccactgcactgcagcctgggcgacagagtgagactccgtctcaaaaaaaaagaagaaaaagaaatagtttctgttctgcttatagtagtattttctgggtgtcaatagaaaacatcagtcaagagcatttatctgaatttgttggtaaaatgtagttactttcggcaagtgttttgctttggtatttatacacggaccgtaatgaagttgagctatcccatctttcttctcatttgtaacacattcatacaaacaaaaaagatgaatcctactggaagtgggtctttatcagaaatatgccccaatgcagttaagtgataccaagaaaatcattctctcatcctaggcctaacattcttcatgcaaaaattaggagattgaatgaatatgatctgtaagttcctacaattaatgtatatacatcaatttatacatcatgatgtaggtagacagcgaggctatactttccggcccccatgatgctaggcgtggccatataacttgcttaaagcaaatatggtacatgtgtcttgtaagagaaaactgaagtttctttcatctcttgcttcctctgccaaaagaatgacagtgtcccaaaagggactttgcttcacttttgatcctggagtgaagatgacttggagcagtgctacagccagtcaacagctgacagtactcaacaggaaacgcacctttgttgttgttaactgcagcataacctaatgaaagctaattaattataataatttgcaaataattgaggatcagcacatagttaaaacacaaacactcaaatttaatagaaagctgataatgtagaccgggtgctgtgtctcacgcctgtaatcccagtactttgggaggctgaggtgggcggattgcccagtctcaggagttcgagaccaccttgggcaacatggtgaaacctcatctttactaaaattaaaaaaaaaaaaattagctgggtgtggtggcgcgtgcctgtagttccagctactcgggaggctgaggcaggaaattgcttgagcgtgggaggtggaggttgcagttagctgagatcatgccactgcattccagcttgggctatggagtaagagtccgtctcatttaaaaaaaaaaaaaagatgataatgtaaaatacgacatcagtggaaataagttaaaaagcaacttttaagaattaaaaaaagaaattgtagtaaaagaaattgacttaaccatgtatgtagaattttccttgtgatttctggcccgaatccttgaatgactattccaagtaagattcaacatttttacaaaattatcattcatcattaagatactccaagattttatttccaccattttataaaggacaatccaatttagcaatccaggtttccaaagtaagttctaaggataaggcttctcctgaagtaatgtgacacaaccttaatttcttagctgttaattttttttttcttttttttttttaaataaaatggagacgaggtctcactgtattgcccaggctggtctcaaactcctggtctcaagtgatcctcctgcctcggcctcccaacatgtcaggattacaggtgtgagccactgtgcctggcctgttagtgtaatttttttttttttttttttttttgagatggagtctcacatgtctcccaggctggagtgcagtggtgcgatctctgctcactgcaatgtctgcctcctgggttcaagcaattcttctccctcagcctcccaagtagctaggattacaggtgcccgccaccacgcccagctaatattttgtatttttagtagtgacggggtttctctatgttggccaggctggtctcaaactcctgaccttgtgatccgccctcctcagcctcccaaagtgccaggattacagacgtgagccaccgtgcccagcctattgtcaaagctttaagactggccagagaagtggcaaagtttgtgacctttctgatgcttcatccatggaaaagaacattggtttgcccttctctttgctccccttaggtaagaaaacttgaaagcaaatagtttctccctgtggcagtgatatatctccatcagcatatatcctcaatttcaatgcaattcctttgcagctgtttcactattttttgtcacctttcccttctttgcttgctgtctctcctgttttggaatcaatgtctttaacaagttactgagtggcagtcatgtaaggctttgggatttccagtttttcacacttgtgatctgactgatgatggtgtctcaggcaaaaattattctcacagtaaggacgtataactgccacaagtttttcaacacggtccttgaatgagcatgggtaaaatttatgtttatgtcttcagtctctcattgattacagtcatctcaggacaaccatgagactgccgccagcttttgtattcaaggcaaaatattcctgagtatcacacacaaatgaaagaaaatctggcagtgctgcccagtgttcaactgtgccatctctctcgtgccactaaagaacagaaattttaaattttgattaagttacaatttcaaattgttcttttatggattgtgctttcggtgatccaagattataccgtttctctcctatttttttcctgaacgttttatagttttaagtttgacatttagctctgtgatacatttggagttcattttttgaatatggacatctaattattcctgtaccatttattgaaatggctgttctttctttacttaattacttttgcatttttgtcagatatcagttgtctgtatgtgtatgagtctatttctgggctctattctgttctgttggtctacatgtctatcttaatactagcactatactgccttgattattgtaggcttatactgagtcttgaaatcagatagtgttaggcctccactgttgttctttttttggcctatttttggtccttggcatccccaaatgaattttacaatcaagttgttaatttctacaaaaacgcctgctgaaattttggttgggattgcattaaatctctaacaatattgccttcctccccatgaacacaatgtatttctcaattattatttgtcaatggtattgtttttgtaaacttcatttttaattgttcattgctggcatatagaactacaattgtcaacaccttctgtgttaaaaagaaaatacaattgtatttctttttttgtttttttgaaatggggcctcactcactcaggctggagtgcagtggtgtgatctctgctcactgtgacctctgcctcctgagttgaagcaattcttctccctcagcctcctgagtagctaggattataggcatgtgccactatgacggctaatttttgtatttttagtagagatggggtttcaccatgttggccagactggtctcgagctcctgacctcaagtgatttgcctacctcggcctcccaaagtgctgggattacaggcctgagccactgtgcctggctctacaattgtttttcttatattgattcatgtatcctgcagctttgctaaactcagttattgttttggtagttttttttggtttttgtctagattccattagattttctatgtagatgagcctatcatctgtgaataagagcacttttgcttctttccaatctggatgccttttatttattttcttgaccattgctactaactgggaacctcctgtataaatttgaatggaagtggtgaacagacatacctgttctttttctgatcttaagaagaaagcattaagcttgatgttaactgtattttttggatatggcctttgtcagactgaggaagttccttttttttttttttttttttgtgagagaaggtcttgctttgtcaccaaggctggaatgcagtggcataatcatggcttgctgctgccttggtctcctgggctcaagtgatccttccacctcagcctcctgagtagctagaattacatgcatgcaccactacacttggttaatttttttttttaatatttttgtagagacggggtcttgcttcgttgcctggattaatctcaaactcctggcttcaaggacttgggttcccaaagtgctgggattacaggcgtgaaccactgtgaccagccgctttccatttctttctttctccatttccttctttctttcttttagagatgggggtcttgctctgtcacttaggctgctgtagtgcagtggcacaatcagggcttgctgtagccttctcctgggctcaagtgattctccaagccctgcctcctgggattacaggcacgtgccatcatgcctggctaacttttgtacttttttgtagagatggggttttgccatattgcccaggctggtcttaaactcctgggctcaagtgatcctcctgcctctgcctcccaaaggctggcattaccggcattagctattgcacttgacacctctttctatttcttgtttgctgagaatttatgtaaaacagattttggattttgtcaaatgctttttttgcctctactgaaatgatcattaatggttttcttctttcagtctgataatacggcaaattacattgatttttcaatgttaaaccgactttacattcttaggataaaccccacttcatcattatatcttttctttgtaaagtattggattcaatttgctaaaattttgtttgtgatacagtctgcgctccatatccacaagttctgcatttgcagaaccacagatggaaaatacgttttaaaataagaaataacatacaacaataaaaataatacaaataaaaaatacatataactattatataatgtttacattgtattaggtactaaaagtcatccagagctgatttaaaatataaggaggatgtgcataggtcatatgcaaatactataccatttgatctaaggacgtcaccacccacacattttggtatctttggtatctttggtatcagggaaccaatccctgaaggatatggagagttgaatgtatttgcatctgtgttcatgagggaaatggatatgaagttgtcttcaaaagtccttgacctttatcggtaatatgttgtcaccttgtaatgtctgtgtgacctttcttttctaataaagtcatttagtgctatatagtagtccccccttatgtgtgcgggatactttccaagacacccaggagatacctgaaactgtggatagtttcagacctcattgtcatcaactgaaacgtatttctgttcatgacttctactcacaaatttaatgctgttttcatcttaattaagcatttatcatacattgtgaccataacttttgtagtttgaagtgcaagaataaaatcagtatgaatttatttttccttcacagtttcacagatagaagatttattcttaccataaatcttagcagcctcagcattcaattttgtttgtttccttattaagtagagaactttcaccttctcacttgaaggaagcactttaacagcttccctttgacatattcaaattgccagcatcactacttttgtggtttggggccgttattaagtaaaataagggtgggttgaatgcaatcactgtgatatcgcaatagtatatctgataactgactcagatggttactaaatattagccagctggtagcacatacagcatgggtacactgggcaaggggatgattcacttcccaggcaggacggagtagcatggcatgagatttcatcgttctgctcagaatggtacacaatttaaaacttttgaattatttacttctggaactttctgtttaatatttttggactacagttgattgtgcataattgaaaccatgattcgctgggcccggtggctcatgcctgtaatcttagcactttgggaggccaaggtgggcggatcacctgagatcaggagttcaagaccaacctggccaacatggcgaaaccctgtctctactaaaaatacaacaattagctgggcatggtggcgggtgcctgtaatcccagctactccagagggtgaggcaggagaactgtttgaacccaggagacagagattgcagtgagcagagatcgcgcctctgtactctgcactctagcctgggcgacagagcgagactttgtctccaaaaaaaaaagaaaaaaaagaaaccatggcaagtgaaactgtggataaggggtgactattattggtacatctttgttggctttctgtttacatgttatatcagatattgagagaagagcagtaacttcaaattataattgtggatttatctatttctttttaaattctgtctttcatgtaatttgaagttctattttaggtatataaacatttaggattgttatatcctcttgtaaaatgaccttctttatctttggtaatgttgtttccttggaaatctactttatcttatattaatatagtcactctagcttccttttgaatagtgttaacatcttatatattttcccagccttttgcttgtattctatttttttttgtttatctttaacttttttttttttgagacagggtcgcactctgtcacccaggctggagtgcaatggtatgatcatggctcactgcagccttcatctcccagactcaagcagttcttccatctcagcctcccaagtagctgggactacaaaattttattatttttttaagagatggggtcccactatgttgcccaggctgttcttgaactcccggattcaagcaatcctctcacctcagcctcctaaaatgtttggattacatgtgtgagccatcatacctagaaaaaatctttggagtttgtctgttagtagcatttagttgggttttgcttttaaaaatacaatctgacaatctttgtcttttaattgggttatttaagccattttatttttttaaaaaattaaagttttattttttgctcacatttacattcatctcaattagtaggttggatacatctttgctttactgtgctttgttctgtgaccgcagccggcatctatctgggataaatcagactcatgacagacagaaaagagatctagttgaaataccttaaagcatcccctagggagtggtatacataatttctacttaaattttattggccaaagtaagtcagatggccaaaccttttatgagcaaatctagcagggatggatctaaaattcacacttttaaagggtacagtttagtggtttttaatatgttcacaaatttgtgccattattactactatccaaactcccattcagaatatttccatcaccccaaaaagaaactctgtacccattagtctcctcattcaccttccttccagcccctggtaaccactaatatattttctgtctctatggatttgcctattctggacatttcattatgatggatacaataagtggccttttgtaaccgacttctttcatacaacataatgtttttgagatttttgaggaaaataggttatttacatttaaggtgattattaatattgttatatttaaacttgtcttatattgtttcctttaattctgccatctttgactttattgaatatttttatgattttgttatagttcatttattgatttataagctataactgttattttggtggttgtgttaagatttataatataaatctttaacttatcagtctgactttgagggttataccacttcacatgtactgtaagcaccttataatagcacacttgcatttctcctgtccagtcctttgtaccagttttgtcatgcattttacttttatatgtgttataaactctacactacattattttttaactcaacagtcaattatctttaaatgagattgaaataataagaaaaaacttttatgtgtttacctatttagttaccatttctaatgctcttctgtcctttctttagatccagatttccatctgatatttccttcttgaaatactttttctttaacatttcatgtagttggtggtattggtgatgaattatttagcgtttgtatgtttgagaaggtcatcattttggctttgatttttacatatatttctttgactatagaattctatttaataggttgacagtttttattttccaaatattttaatgttgcgatttcattgatttctctcttgtgttttcagtgagaaattcagtgtgttccttgtctttttgtttgtttgttactctcaagcacatttgtttctttgtatatgtctcttttctctgctttatcactggttttaagcaatttgattctgaggtgtcattgttttttccatgtttcttacatttgtgatgtgttgaacttcttatggatttatagttttcttcaaatgtggaaattttggagccaatgttttcttcagataattttttgtccctttcttgcctcttctttagagactctaagtacacacatattaggccacttgaagttgttccacagctcactgatgctttgttcattttttggaaagttgctacgtattcaaattcactaatactgtcttttgccatatctaagttgctattaatcccatctagtgtattttttatctctcacattgtgttatagttttatctttagaagctagagctgagtgttttttaatatgtctctattaaacttttgaatatataggatacagttataataacttttaatgggctctctggtcattctaacatttgagttaatgctggtttgcttttgatggattgatttcccccccacctcattattggttatgcttttcttctgctttgcatgcccgatttttttttttttttaaacaaaatctcactctgtcacccaggcttgagtacagtggcgtgaccacggctcactgcagctttgacctccttggctcaggtgatccttcgacctctgcctcccaagtggctgggactacaggtgtgtgccatcatgccctgctaatttttgtattttttgtagagatggggtttcaccgtgttattcaggctggtctcaaagcctgataattttttattgaatacctgagattgtgaattttatcttgtcgtgtttgactattttctattttcctataaatattcttgaattttgttctggcatgcagttaaattacttcaaaagaatttgttctggagtaatacagaacctaggactattattcccccctactgaggcgagacccttttgtgtactcttcccaatgtgtcttgaaacagtaacttttccagtctggctggtgaggataggtataattttctaccatgtgtgaatgttagccatggttacatctaatcttttctggtggttgattctctggccatggatagtttccttacatgaatgcattgatcagttcccagctgaatatttgatggagatctacctatctctgaagatctctgtatagttctttcatctctggtcatgacctgtgaactctagacaccttggtctcactgccattgagtacctgaaatatggtttatctgacttgcaatgactcttctcatcatctcctcagttcagggagcacacaagactgtatctcaattttccccacctgttatagggccctgaaactgaatttcaaggtggttaaaatggcagtcacagagtttactttacttatgtcccgagtctcaggaattcttctccaatgctgcctgttgtctgaagtctttatttatatatatatttattttttttaaagacagggtcttactctgttgctcaggctggagtgcaatggtgccatcacagctcactgcatccttgacctcctgggctcgggtgatccttccacctctgcctcccgagtagctgggactataggtgtgtgccaccatgcccagctaatttttgtactttttatagagatggggtttcgccgtgttgtccaggcttgtctcgaacgcctgggctgaagcaatctgcccaccttggcctcccagggtgttggaattacgggcatgaatgagtgtgccaagcctaaagtcttgaaaatcattgttcgatataatttaatgtattttgttcaatattttttggtttcaggaaagagggtaaagctagtctctattatttaatcacggcaagaatgaaataatttttcatataaagttttgtattttcctttggcatggtatcggaggaaccagcccccagtatttcaacgtaggttcttttctattttccctaagtgtcggccggtctgagaaataaagagaaagagtacaaagagataaattttacagctgggcctcagggggtgtcatcacatattggtaggaccttgatgatgaccccgagctgcaaaaccagcaagtttttattagggattttaaaaggggagggggtggaacagggagtaggtcacaaggatcacatgctttaaagggcaataaagatcacaaggcaaggcaaaattagaattactgatgagggtctatgtcccactgtgcacgcattgtcttgataaacatcttaacaggaaacagggttcgagagcagacaaccagtctgactagaatttaacaggctggaatttcccaatcctagtaagtctgagggtactgcaggagaccagggcgtatttcagtccttatctcaaccgcgtaagacagacattcccagagcagccgttcatagacctacccacaggaattgcattccttccccagggttattccttgctgggaaaataattcagcgatatttctgctactcactttctgcaagaagaaaaatatggctctgttctgctcgaccccgcaggcagtcagaccttatggttatcttcccttgttccctgaaaatcgctgttattctgttctttttcagggtgcactgattttctattgttcaaacacacatattttacaatcaatttgtacaatagtgatcctgaggtgacgtatattctcagtttacgaagataacaggattaagagattaaagtaaagacatgcctaagaaattataagagtattgattggagaagtgataaatgtccatgaaatcttcataatttatgttcagagattgcagtaaagacaggtgtaagaaattatcaaagtattaattttgggaactgataaatgtccatgaaatcttcacaatttatcttcttctgccttggctccagccggtccctccgttcagggtccctgacttcccgcaacagcatgggaagaagtctgaatagaattagaaaaattgatttatattatttgacaattagatattggacttaatatcatgtataaatatattgtgaatgttacttctgcttagctttaaaaaaatgtactgctgaggtaattattgaagtaattttataattttactgctgagattatttttactttaaatagacctgtcctcagacttggtcccttcctattgagatggagacagacaacagtagcttgaaggaaattcacagggaacaggattaggaactatagattttgagtctggcttaattgagccccaggaataggacctaatatcaactcatgcaaacctggtgatagaaaatactgctttcttatcatttcttaggaagcccttttaaaggttttctttggctctcagcactcagtgggtaaggtagaaagctgggtgtgccacataactttttgtgggtttagtgtgtgtatatgtgttttggttttaactttttacccctttgtttactacatttgaaagattttgagcaaatcctctggtcagaagttttgggaagagatagtcttttaaaataatatgtagattctgaaagtttcttggataagatgaaattagaagaggatcttgaaagatcaaagtggagtgttaggttgtgtgagggctgttatgagcaaataggttctcagaaaaggaaatgaaagggactattaaatagagcaaaaggagatatgtgatagaaaaatagtgggaaaaccaaacactgcatgttctcactcataggtgagaattgaacagtgagaacacatggacacaggaaggggaacatcacacactggggacggttgtggggtggggggaggggggaaggatagcattaggagatatacctaatgctaaatgacgaggtaatgggtgcagcacaccaacatggctcatgtatacatatataacaaacctgcacgttgtgcacatgtaccctaaaacttaaaagtctaataataataaaatttaaaaaaaagatattgatcaaaggatatgaaatatcagttagataagaggaataagttcaagagatctatagtataatacagttactattgttaataacagtatattatattcctgaaaattgctaagagagtagcttttgtgttcttaccacaaaaaaaagtatgagaggtaatgagtatgtgaattagcttgatttagccatgtggtacatgataaatatatacaatttgtatttgtcagcataaaatataattttaagtaattaaaatagtgggacatgaagttggggcaggactgacaaagtaaagcacttacagacagtgctaaagggtataaaggatttttaagtgttcagttggttattatatacaaggatgaagtagtttccagtaaagataacttctggtatagattttgtaagtgaccaaagttgaatttatttttacggttgtgatcagtaattactgtgcaactaaaatacacaaagcgttatattaaaattgttgtaggtaaggtgtggttgtagatgaattgcttattcccatacaattcacaatttaccccagaataccagatgtgtttaatatatatgttgacaactaaggaataattactggagttttaaaaaaaattattgttatactttaagttctagggtacatgtgcacaacgtacaggtttgttatataggtatacatgtgccatgttggtttgctgcacccattaactcatcgtttacattaggtatttctcctaatgctatccctcccccagccctccaccccttgacaggcaccagggtgtgatgtttccctccctgtgtccaagtgttttcattgttcaattcccacctatgagtgagaacatacagtgtttggttttcagtccttatgatagtttgctcagaatgatggtttccagctttatccatgtccctacaaagtacatgaactcatccttttttatggctgcatagtattccatggtatatatgtgccacattttcttaatccagtctatcattgatggacatttgggttggttccaagtttttgctattgtgaatagtgccgcaataaacatacgtgtgcatgtatctttatagtagcatgatttataatcctttgggtatatacccagtaatgggatcactgagtcaagtggtatttctagttctagatgcttgaggaattgccacactgtcttccacaatggttgaactaatttacactcccaccaacagtgtaaaagcattcctatttctccacatcctctccagcatctgttgtttcctgactttttaatgattgccgttccaaatggcgtgagaggtagtatctcattgtggttttgatttgcatttctctgatgaccagtgatgatgagcattttttcatgtgtctgttggctgcataaatgtcttcttttgagaagtatgtgttcatatcctttgcccactttttgatggagttgtttgtttttttttcttgtaaatttgtttctttgtagcttctggatattagcccttagtcagatgagtagattgcaaaaattttctcccgttctgtaggttgcctgttcactctgattgtagtttcttttgccatgcagaagctctttagtttaattagatcccctttgtctattttggcttttgttgccattgcttttggtgttttagtcatgaagtctttgcccgtgcctatgtcctgaaaggtattgcctaggttttcttcaagagtttttatggttttagatctaacatttaagtctttaatccatctcggattaatttttgtataaggtgtaaggaagggatccagtttcagctttctacatgtggctagccagttttcccagcaccgtttattgaatagggaatcctttccccattttttgtttttgtcaggtttgtcaaagagcagatggttgtagatgtgcggtgttatttctgaggcctctgttctgttctattggtctatatctctgttttgataccagtaccatgctgttttggttactgtagccttgtagtgtagtttgaagtcaggtggcatgatgcttccagctttgttctttttgcttaggattgtttcggcaatgtgggctcttttttggttccatatgaactttaaagtagttttttccaattctgtgaagaaagtcaattgtagcttcatggggatagcattgaatctataaattactttgggcagtatggccattttcacagtattgattcttcctattcatgagcatggaatgttcttccatttgtttgtgtcctcttttattttgttgagcagtggtttgtagttctccttgaagaggtccttcacatcccttgtaaattggattcctaggtgttttattctatttgtagcaattgtgaatgggagtttgctcataatttggctgtctgttattggtttataagaatgcttgtgatttttgcacattgattttgtatgaagttgcttatcagcttaaggagattttgggctgagacaatggggttttacaaatatacaatcacgtcatctgcaaacaggagcaatttgacttcctcttttcctaattgaatatcctttatttctttctcttgcctgattaccctggcgagaacttccaacagtatgttgaataggagtggagagagagggcatccctgtcttgtgccggttttcaaagggaatgcttccagtttttgcccattcagtatgatattggctgtgggtttgtcataaatagctcttattattttgagatatgttccatcaatacctagtttattgagagcttttagcatgaaggactgttgaattttgtcgaagaccttttctgcatctattgagataatcatgtggtttttgtcgttggttctgtttatgtgatggattacgtttattgatttgtgtatgttgaaccagccttgcatcccagggatgaaggccactttgtcatagtggataagctttttgatgtgctgctggattcggtttgccagtattttattgaggattttcacattgatgttcatgagggatgttggtctaaaattctctttttttcatcgtgtctctgccaacctttggtatcaggatgatgctggcctcagaaaatgagttagggaggattccctctttttctattgattggaatattttcagaagaaatggtaccatctcctctttgtacctctggtagaattcggctgtgaatccatctggtcctgaactttttttcgttggtagggtattaattattgcctcaatttcagagcctgttattggtatattcagagattcggcttcttcctggtttagcttgggaaggtgtatgtgtccaggattcatccatttcttctagatttttcttgtttatttgcacagaggtgtttattatattctctgacggtagtttgtatttctgtgggatcggtggtgatatccctcttataatttttttattatgtctatttgattcttctctcttttcttctttattaatcttgcttgaggtctatcaattttgttgatcttttcaaaaaaccagctcctggattcaccgattttttttgaagggttttttgtgtctctatctccttcagttctgctctgttcttagttatttcttgccttctgctaacttttgaatttgtttgctcttgcttctctagttcttttaattgtgatgttatggtgtcaattttagatctttcctgctttgtcttgtgggcatttagtgctataaatttccctctacacactgctttaaatgtgtcccagaaattctggtacattgtgtctttgttctcattggtttcaaagaacatctttatttctgccttcattttgttatttacccagtcgtcattcaggagcaggttgttcagtttccatataattgtgcgttttgagtgagtttctgaatcctgagttctaatttgattgcactgttgtctgagagaccgtttgttgtgatttctgttcttttatatttgctgaggagtgctttacttccaactatgtggtcaattttggaataagtgccatgtggtgctgagaagaatgtatattctgttgatttgcagtggagagttctgtagatgtctattaggtctgcttgctcgagagctgagttcaagtcgtggatatccttgttaatgttctgtcttgttgatctgtctaatattgacagtggggtgttaaagtctcctgttattattgtgtgggagtctaagtctctgtaggtctctcaggacttgctttttgaatctgggtgctcctgtattgggtgcatatatatttaggatagttagctcttgttgaattgatccctttaccattatgtagtggccttctttgtctcttttgatctttgttggtttaaaatttgttttatcagagactaggattgcaacccctggtttttttttttgctttccaattgcttggtagatcttcctccatccctttattttgagcctatgtgcgtctttgcacgtgagatggatcttctgaatacagcacactgatgggtcttgactctttatctaatttgccagtctgtgtcttttaattggagcatttagcccatttacatttaaggttaatattgttatgtgtgaatttgatcctgtcattatgatgctagctggttattttgcccgttaattgatacagtttcttcatagtgtcgatggtctttacagtttgtcatgtttttgcagaggctggtaacggttgttcctttccatgtttagtgcttccttcaggagctcttgtaaggcaggcctggtggtgacaaaatctctcagcatttgcttgtctgtaaaggattttatttctccttcacttctgaagcttagtttggctggatatgaaattctgtgttgaaaattcttttctttaagaatgttgaagattggcccctactctcttctggcttgtagagtttctgctgagagatcagctgttagtttgatgggcttccgtttgtgggtaacccgacctttctgtctgcccttaacattttttcctttatttcaaccttggtgaatctgacaattatgtgtcttggggttgctcttcttgaggagtatttcattaatttgaacttcagtcactgatatcctttcttccccttgatcaaatcagctattgaaacttgtgtatgcatcacgtagttctcatgccatggttttcggctccatcaagtcatttaaggtcttctctacactgtttattctagttagccattcgtctaatcttttttcaaggtttttagctgccttgtgatgggttcgaacatcctcctttagctcggagaagtttgttattactgaccttctgaagcctatttctgtcatctcctcaaagtcattctccatccagctttgttccgttgctggcgaggagctgcgatcctttggaggggaagaggcgctctggtttttagaatcgaattggctattgaagcttgtgcatgcgtcatgtagttctcatgccatggttttcagctccatcaagtcatttaaggtcttctctacactgtttattctagttagccattcgtctaatcttttttcagggtttttagcttccttgtgatgggtttgaacatcctcctttagcttggagaagtttgttattaccgaccttctgaagcctatttctgtcagctcctcaaagtcattctccatccagctttgttccgttgctggcgaggagctgcgatcctttggagggaaagaggcgctctggtttttagaatttttagcttttctgctctggtttctcctcatctttgtggttttatctacctttggtctttgatgttggtgacctacacatgggattttggtgtggatgtcctttttgttgatgttgatgctattcctttctgtttgttagttttccttctaacagtcagaaccctcagtttcaggtctgttggaatttgccagaggtccactccagaccctgtttgcctgggtatcaccagcagaggctgcagaacagcaaatattgctgcctgatctttcctctggaagctctgtcccagaggggcacctgcctgtatgaggtgtcagtcggcccctactgggaggtgtctcccagttaggctacatgggggtcaggaacccacttgaggaggcagtctgtctgttcttagagctcaaacaccatgatgggagaactactgctctcttcagagctgtcagacaggaatatttaagtctgtggaagtttctgctgccttttgttcagctacaccttgccccccagaggtggagtttatagagatagcaagccttgcagcactttggtgggctccgacaagtttgagcttcccggccgctttgtttacctactcaagcctcagcaatggtggatgtccctccacctgccaggctgctgcctcgcaggtcgatatcagactgctgagctagcagtgagcaaagctctgtgggtgtgggacccaccgagccaggcgcgagatataatctcctggtgtaccatttgctaagactgttggaaaagcacaatatttgagcaggagtgtcccgtttttccaggtacagtctgtcactgcttcccttggttaggaaagggaaatcccccgaagccttgtgcttactgggtgaggtgacgccccgccctgctttggctcgccctctgtgggctgcacccactgtccaaccagtctcagtgagatgaaccaggtacctcagttggaaatgcagaaatcacccgtcttctgcgtcgatcacgctgggagctgcagaccagagctgttcctattcagccatcttggaacacgcctccttactagagttgttgaaagatgttcagaaaagagattttgacaagaacttgaagaaataaaaggagcagaagtttaagtcactctttattcttgtgtggaagtactaaaaaatttgaacttttgggttcaaattttgagtcgcgtgtgtgtatttttaaaaatcattgaaactgtcagggcacggtggcttatgcctgtaatcccagcactttgggaggccgaggcgggtggatcacctgaggtcaggagttcgataccagccctgaccaatatggtgaaaccctgtctctactaaaaatacaaaaaaattagctggacatggtggcaggcacctgtagtcccagctacttggaaggctgagacaggagaattgtttgaacctgggaggcggaggttgcagtgagccgagatcgtgccactgcactccatcgtgggcgacagagtgagactccatctcaaaaaaaaagaaaaaaaaatcattaaaactcagaatccatgggaaggatttatatgtagagaatgagtcttgttttgccttgggagaacaatcctggtggaaaaacatctctctgactttagttaaaagtaaaggttaggtgcagtggttcatgcctgtaatcccaggattttgggagtccgaggtgggagaattgcacgaggccaagagttcaagaccagcctgggcaacatttgcaagaccccatcagtacagaaaataaaagaattagctgggtgtgatggcatgttcctgtagtcctagctacctaggaggctgaggcagaagtattgctgtagcccagaaatttaaggttgcagtgagctctgatcacattactatactccagcctgagagacagagcaagaccctctctttgaaaaataagattaagtaaagtaaaatgacaaacactaagctttagtgctcttcttcctgttctgtcctatcgccccaccaactagtaagtctggggaaaaattgcaaggataataatttgaattctctctacttctgtggtttgtaatatagatatgtaagttatatatctaaagtaaaaattatgagatacaacttacactttgtagcataacaaagtagatgcttttatttaggatttattcttcccttccccaaatgtagatgattctctggttgtgttcactctctttgattcagaaagtataaaaataacattttagaaaattaaaatttaagaaacatgaaaatatcaaattctatgaagaaacttttttcttttcatagttttactgcggctattactttttaaaaataagtgcatgtagcaaccccagaaagatgtgaagaaatggtttaatgtaatgtcaaagatctatttgatgaaagttaataattgatagctttaaagttgaaatcggatagttttttttcccccttgtgtgttaaatgtgcttttcttttttcattttaaaatcacaaaggctttggcagagatgaatttatggaggtaagtctcaagtataataggattgcattttaattaaggaggggaatgttgctaatttaaattttgagtgagccattatttgcgtggtttaaaactttggcattgcagccatatttgttccgtttttatattctgttatttggaatcatattttgctttttagcatattttgggggctgagatatgagaatgaagaaaaagaagtggtttattgatttatgagacagggtcttactctgtcggccaggctggagtgcagtggtgcaatctcggctcactgcaacctctgcctcctgggttcaagtgattctctgaccccagcctcccaagtagctgggatcacaggcatgcaccactgtgcctggctaatttttgtagtttttggtagagatggggtttcaccatgttagccaggctggtctcaaactcctgacctcaagcgattggcccgtttcagcctcccaaagtgctgggattataggtgtgagccactgcgcctggccagaaagggttctttttaaactagcaaatgtattttatgatttttaaaaatatagtcaacaggaatctttgaaaacttaatttatgtatctttatatcctaccaaaatctagatctagtatggtctagtatggtcgaccatattgtctaccataaaatgaaaaaagaaaaggcaatactagacaatactagtattgtgtagtatggtagccagtaaccatatgtagcaattgagtacccaaaatctggctggtttgacttgtgatatgctgtaagagtaaaatatgtactagattttaaaacttgatttgaaaaagagactatcttggtaattgaaaaaattttgtttacctgttgaagtgacatttcaactgtatttgataaaataaattattaaaattaatttcaggctgggcctggtggctcactcctctaatggtagcactttgggaggcctaggtgggaggattgcttaagcccaggagtttgagaccagcctctcaagaccccatctctatttaagatatatcttaatatatatatcttatatatatatttttcatcttttttaaaaagcttttaattgtagtgattagaacatttagctttgcataagtggactgcattatatctcttttggacaggctgatctagatgacctaatgtccatcttatatttataattttaccaccatagcattacctcagttttcctgaggatactctccataaaacatccagcaacaccaaggaagtgaagagcttgcaagcaaaatagatattttcaagtctctatttaaaaattcttgtatttttaatcataggaaaggtctgtagatcttcatttgaagtctttgttcttattattttcattgaggattgttttaaatttttttatcagttctctgatttcctaaagaatttgatggtataattaattaaacaatttattatattaccttttctgtggcaactagcttagcctaagatagtctcttgaaattaagaaatcttaagactgaagtcggctaggcttgtttttctggaatgtctgtataaaataatctccatactattagtttctgatcataatatttgggaggagcctataaaccttctccaagccctgatcttaaacacagaaaaaaaaaaattctatttttcagaactagagaaatccctgtcatttaggtatctttcttctgtgttgtctctgagttgtttcctgtcctaattccttgtgtcttctctgaattctctcattgttacagtatttctattgctctgagacatgaatttgtgcttggtgttgttgatgtgaaaggatgtgattcctctctgggttaggcatgtagttttgctatggtctttttgttaccctctaaaattcatgcgttgaaagctaatcccaaaggtgatggtattaatatattgggcctttgggagtctgtaatcctcataaatgggattagtgtggttataagaggcttgagggagtcctttgccccttccaccatgtgagggcccgtaaaggcctccatctgtgaggaatgggtccttatcttatgccaaacttgctggtgccttgatcttgggcttcccaccctccaaactgtgagcaataaatttctgttgtttaaaaattacccagtccaagatattttgttatagaagctcaaatggactaaaataagttttttgttaatcattttccattcttttacctggcaagttgctgcacattcatatcttgtttctttggtgttacattacaaagagatgtttgaaccttgtgtttgaaaagttgcctcctccgtaataaatctctctgccttttttttgaaacagggtcttgctctgtcacgtaggctagagtgcagtcgtgtgatcatggctcactgaagccttgacctcctgggctcaagcagtccttctacttcagccttccaagtagctgggactactgcacttttaagtgccagtgtatttagcttcccaggtgtttgtatcatacagcgtttttcttccttagatcctttcttagctccttataaattatcttagcagtttataaattaccaactggcatgttgaccagttgctgttgtatcctgctttctgagttctggtatccataggaaaacattatgctgagtacaataggatactcaagaagtttaatatcaactgttttcagataattaccagatttttgtttgtggcgttcaccttgcttatgaacttcagatttgtcttttcaactgctgtgcttattgtctacatggattttcccccaagtacttcaaactccaaatactcaaaagagaactcattcttttccctttcctcccttgtattttcaaatcatagtattatagataagcctttttggggggctgtttatcatctgcatgctgccatacacaagctattcttttttcttatatggccatcgtgaagtctgtactctgtcattttccttacataggtggcatctcgataagaagttttgattctcagaagcaaagatacggtgaaggtcatctgtctaagataagaccgaggctgttctccatgctggaatattttcttgttctcaacttattccccagtcccacccattagggaactggaaatgctttctccctacaaagtctaccaaacttccagaagcaaccactcctagactctcgatctttaatactgtttggagtccagttggtatattggcaccccccccccaaccccaatctcactattgtgtggctgtagccagtttcagtggctgcccttggatcaggagctactctaagagaaacctgtagtgacccagttaggagacaggattgtgtgttcccttgttgatagaaaaacaatgtcttatgtcctagtctgtcattctgggagaatgaatgaatttaggcctgtgaattatttactgtataaaagtggaatattagaaatggccaggaggctacacaaacctatagggacaccttagattacaatgtacaatattcctgcttggacagtattctttttctttaatctgtgatagtcagaattcttgtgttagaaggagattatgatgggatgggatgggaagtgaggtgaattattcccccaccatcccccctgcttttttttcgagacaggatctcactctgtcaccctggctagagtgcagtggtgcagtgcaatcatggcacactgcagtctcaacttccggggctcaggcgattcttccaccaaagccccccagtagctgagactataggtgtgcactaccacacctggctaattttttgtatttttagtagagatggggtttctccatgttgcccagtttggtctcaaattcctgggctcaagcaatccacctgcctcggcctcccttttttttttttttgctttgcaataaatccatgtaaggcagtgcacccatgtgatctgggaggaggaaaatatgtgaaaaagttttagatatacttctcactagcccacagacctatgagtaatgctgtattaccattttcccagctgccaagctcaaggctttgtaaattgttgactttcaggcagtgcgcccctcccccaccatgccagactaccttaattatactgaaactaggtggaaacctgtttaaaagccttcttgagttgttcctcatcacgtttagcaataaggaataaaaatgcttgattctaactacatagtctataaagtttacatattcttgaacacgtaaattatttttctacatgctataggaaaatacatgctatagttcactggggagagacttcatggtatcaattcaagtgttactacttctgcaaaatgttccgactctctcacagagaaagacttcttcattataaaaattctaaagtttttctttagagaattttaaaatttgctggaatgaccaggaaatttgaaaaggcaaatatgaagtcatgtttatatcttcctttatttataaaatatgcccaaaataatcttttacaaaaagtaatagttacggttttaaaaagttcagaagggcttacaataataaaatgcagtcatttctcaccgaatttttactatccctagtgccattaagtagataatattttttacaaatattgatgaagtgataaaaattgatgaataatatgcagagaaatgtgtagttcttaagtgtaaagtttgaatttcaaagaatgtatatacctatgtataacccacatacctattaagacttagaaagtttctatcatattagaaaatgtccatcatctcagaaaattcctttgtgtcctttctagcaaccccaccctctgtcaaaacttctcttctacctgttcttttttgtataatggctttattcagatattcatataccatatatttaattcccccacttaaagtttacagttcagttgtgttttgtctactcacagaattgtgcaattgtcaacacaatcaattttagaatttttttcatcactccaaaaagaaactgcacacacattagcagtctatgttttcctgactaccttcactcctactacaaccctcagcagctgctgatctattttctttcttctagatatttcatataaatgtattcatggaatatgtgcccttttgtgactggcttcattaacttaacatcatgttttcaaggttcatggatgtcatagtgtgtatcagaatataattccttctcgtggctggtattccattgtttgggtataccatgtttttttaatccattcatcagttgatggacacttggatttttcttttttttgatatcatgaataatgtttctgtgaatgcttgtatataagtttttgatggatataaattttcatttcttttggatatatacctaagagtggaattgctgagtcatggtaattttgtgcttatcatttgaggaactgccaggctgaagtgcttgtaccattttacattcccacaagtagtgtatgagagttccattgtctccatattctcacaaacacttaactgtttgttatttgtcatctcgattgtaactatcttaatggttgtaaaatatctcattgtgttttcaatttgctttttccctatgactagtgatgttgaacatcttcttatgtatttattggccgttttctttggaaaaatgtttattcagatcttttgtccatttttaaatcacgttattgttgatttgtaagggttctttctatattctagatacaagtcccttatgattcgcaagtattttctcccattctgtagattgtctttccactttcttggtggtagccaataaagtacaaaatgtttttaattttgatgaattccagtgtatctgttttttcttttgtcacttgtagttttggtcatatttaaggctttacctaactcaaagtcatgaagatttattcctgtattttcttctatattatgcttgttcttgaactttatatagatggaatcatatcgtatgtactcttttgcacctggcttctttcgttctaacatctatcagattcatccatgttgatgcacatgtcagcagtttatttctttttattgctgagtagtatcacactgaatgaatgtaccacaatttgatcacttatttttctgaacatttggattgtttctggtttggggctattgtgaataaagctgctatgaactttcaactatgtcttctttgtacatatgttttcattttactgctggaccatatggatatgtatttcaactgtatgaggaattatcaaacagttctcaaatgtgttatactattttgtacttttaatattgatagaattgcttccatcctggccaacatttggtatggtcagtctttagaattgtagccattctaatatgtatatagtttggttttaacttgcatttccattgatgactaaagatgctaacatttttcaagtacttattgaccatttgattatcttgtttagaaagtatcagtttacgtctcttactcattttttaaagtgtggtgtttggtttcttagttattgactttaagagtggttcatatattctgtatactatcttttgtcagatacctgtgtttagacttttttttttcttcttactctctggtctggcttgccttttcatttttaaaatagtatcttttgaggagcacagctctttaatttcggtgaagtccagtttttaaatcaattttttcttttgtagttactgtttccttatgtcctgcaaacaaatttttgcctaccccaaaggctgtgaagaggttttcttgtgtttttttttttttttttttttgagacagagtttcgctcttgttgcccaggctggagtgcaatggcacgatctcggctcaccgcaacctccgcctcccaggttcaagcaattctcctgcctcagcctccctagtagctgagattacaggcatgtgccaccatgcccggctaattttatatttttagtagacagggtttctccatgttggtcaggctggtctcgaactcccaacctcaggtcatccgcccgcctcggcctcccaaagtgctgggattacaggcatgagccaccacgcccggccatggttttcctgtattttgtttttaggagttttatagttttgttatatttaggcttatctattttaaaccattttataagataaagcagggacagtatctttaaatagtgtaatgtcttgagatattttatttgtaaacgttcctcacagctttgtataattggatgtgctatttcaatgttctcggaaggttaactgcttaatcttctctaacccacgaatgccacgaattcacttgatatttgtgcctatcctagaagttgtattaataactcagcaatccaagactttttgactctctaaaagccttctgtttaggtgcttcttcatctatacttggattacacctcgaacttaggtttaacttaggaaaaccattattttctttgaactgcatatctctgttgatagtgatgcaatttaattgagatgtagcaagcagtcagtaaataagtatggcaaataactaggattcaggttatttcagtaaaatttgtttctttattgcatttacaattcttagggtttagaatcatgtggaaaattacctatgtaaactaatttttccataagatatattacggacttactgaaataatatgtattttaaaacagtatttaaagtaaaacatcatcattaattctttttttatctttttattttcctcagagaccttgttctgaaataatttttttcaagtaaaattatttataataattagttgatgctcactttggctgtttggtatgtttttatgtttttagcaatatttgggaaattttattttaattattgttgccatgaaaatatattaaattttccttcagtaaggatagaatttgtttgttcagtttatactgttgtattattgaaaatgacatacctggaatttggaattttaaaatttggacttatgattttatttcattttgataatatactttgcattgagctaaatgttctaagggatataaagatgagtagcatataaatctggctctcaaagggtggttgtataatctgttaaataggatttgacctctatatgtttattttctttctcagcttttgtattttatgaattagtattgtgagcttttgttgtagcctaagcagatgacttttcctgaagaattactggaagtgagtagtagctatataaaatagtgatagagctacgttttccaccttccttttataaataaaagacttaatgtagtgattagtcatggattggatcttggaaattatcttaacccttctttcaacagataaggaggaggcctaacacagggttgcaagctcaaaattcaacagggaccttatgagtgaggaggtcccagtttaacagtgtaaacctagtaataaatagcagctgttagctggcctgagttttaggggagactgtagggattatggaaagtgagcagattaaagtccttctgcatttgaaggaagaagctcccacgcagctatatcctgttcttactgtgcaggaatatggaccggttttgccttatctttttatttttcaagagaatctagaattataaataaagtataaatgcatataagcaaatatgtgaaatcctccaattttagtatattagtaatagctcagtttttacacaaacactgcataggccaaataaatactttttgtttgggcagattggttatgcatgtgtgaagcaaaatgaaaaaagagaagtgatttggttaattttgggggctctgccttacttttaagccttagacacattgtaaacgttttaggattggttatttcatagatttgttgtacctcttccaagtataagttcttttttcctgaagcctacccaaatacttttctcatcagatttcccctaatttgaatttttaatggagatgaagggaaattataatggggctagtagctcaaaaatttttaacgtaatttgctttttcaaattttcaaactgctataataggtgaaaaaaatatagcagtaattttattgatgtgaccaaaatttatttaaattatgtatattattaaaactatattttaaaacaatggttaaattgcagtaataaagctctaagtatcatcaatgcctcttctaatatcactgtccgattagatcttgaacagtttttaattatattttagattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggtattcatgttctttgttgaagttcttattcttattccatagtgcgtcagacataacttaatagaggattgggaaaaaaaccccaaatacaacttccaagctatatattaaagaggtctgctttatttgttttcacttacttgtacccctaaaagttttaatttgtagacatcagttgttacagaggtcctgatcatatagaaatatataactgaaaattattttatttacttattattattttataaagactcactttgttgctcaggctggagtgcagtgatgcagtcatagctcactataacctcgaatttctgggcttaagctgttctcctgcctcaggctcctgagtagctatgattacaggtgtgtgtcaccacacctcgctaattttttattttcctttttgtagagatagggtcttgctttgttgcccaggctggtctcaaactcctggcctcaagcagtcttcctacctccgcctctccaagtgttgtgagctactacacccggcccgaaaattgttttagaaattaaattctctcattttattgattcagaaatgaagttgtgatatcctgcattcttgaataacagtattttcctttttttttttttttttgccttcaacagccctttgaatgttgggtactgtaccatcattcacagctctgcaggtttcaagtccattaccttaagaggtcacacactgaggtgaaatgatcattattaatcccctgaccagaagaggatacacccagggcccaatcttacccttgacttacagggttccctagtcttattataaagctagctttgtgagttacaaatttaatgatgtcttctacttcattccaaccccctaataagtcttccttggcttgcaagataggacacttaaataattcatttttgtaattttattttatttttaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggtaagttttatttattcattttttgaaatgaaatgaattcctggaaggttgaaattatacatttttcatgatgaagcatgacctcccaccacaataatcagttgctttggcagtgaaattggttttagcatcatttttgccttaattcttatgctacattactatctagtatagagaacttgttagaacatttactacgttatttagcattagttgatggaaatggaatagcttaaaagtcacatatcatagagggatcctcatgaaaaggaataattcaccatctgtgaagttcaaaacctgggatgtgggtttctcctatcatatctgtgttcctacagtgagcaaatttttctgctttctatggccagcactgttaagagcacttagcccttgaaaggtgtaccattgtcattttttcttcaatattgccatttcccttcccacagttactttttcttttagctacttctttgaaatactgacttcttgttaaatcatttcaatttcgccaatcctttgccttaaacctagtctagttttatatacatcaatataaattttacttgaatttttttttttttttttgagatggagttgcactctttttgcccaggctggagtgcagcggtgtgatctcagctcactgcaacctccacctcccaggttcaagcaattctcctgcctcagcctccctagtagctgggattacatgcgcccgccactacgcccagctaatttttgtatttttagtagagacagggtttcactatgttggccaggctgatctcgaactcctggcctcaggtgatccgcctgcctctgcctcccaaagtgctgggattataggcatgagccactgtgcccagctcaattttacttgatttttaagccctgttacaaattcctttattttattttattttattttattttattttattttattttatgtctttagagctagcaagtttggattgggaaattgtcaaaataaaatttcatgtaataaaacatttgctttttaaatatgtataggataacatctataacaagcaagcaagagcttttctcaaaaataaatgttttttaatctgcctgtcttgccaattttaggttttttggagaaggaaggtataacttaccatgtattttgaacaacttttttttactttttaggcttactctttagtagatcgtgaggttggttactgtcaaggaagtgcttttatagttggattgttgcttatgcaggtaagttaatataagtattaaatgtccaatgaaattttttattaagttggattggagagtttaaaaagcatctttgttttattaaatataagtggatatgggtattttttcctaggcataatttgaatacaaatatttagtttgcattttaaaagattaaacatgttaaaataacatacagtaggccgggcgcggtggctcacgcctgtaatcccagcactttgggaggccgaggcgggcggatcacgaggtcaggagatcgagaccatcccggctaaaacggtgaaaccccgtctctactaaaaaatacaaaaaattagccgggcgtagtgacgggcgcctgtggtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaattaacatacagtaatatcttaccaccaaatgaaatttcaacttcatgatagatacatttttactgtaatattctactaaagcttgtatctacagtagtttaaaatcttatttgttaacatttaatgaagagtaatctttttctaaccaaggaggaaataattaaagtgttggtaagaaaatcttatttatattgtacaacatctttagagatttatagagaatttaatttatcatggagctaaaagcttgttatgcatacctcactgcatgccctaaaatagtggtactcagccacttttaccccctagggatataactttgttattgagtgtgcagtgggtttgggtggaatgttttcagaattcgggggtaggataatcatagctttgaagggaaatggcatatagtattatctcttcagctttgttgaaatgttaagtccatcttactctttatttagtctcagattttagtcctgaaaaggaatcatggagatacttggtttgagtcatatagggtggttttgcaactcagttctgcacatgctgtatgaatttaggctagattatttaacctctctctgagccttagtaagataatactatctactttcagattagttgtgagggttatttgaggtaatgtatgtagaagcctagcatggtgtttggctcataggagataggcagtgaaagttcagtggcttacccaagatcacacatcctggtagataaaagcaaagtaggaatcagaaaccgtttcctgatgctttgcttcagcttcccaactgctttgagttttaaagctcttgttgctgtcaggagtatacacttttctaagtagaagagacctgatgtcagagacactgatttataataaaaataatttttactttgtgttacagcatatataagaacacataagaagtgctcccagtggttattgatttctaagtggaattaggttataaataatacaatgcaaaactagatttgttaatgttaaggtatagttgtttaacaaaattatgattttccagctttgcgcagtggcagtatcgtagccagtgaggtttatccgaggcgcaattattgctaattgaaattatgattttcctactttatttagtattggtagatccttcattattgaactcagacatccttattatcagtctagtgatttttgctgctgttctattccttttattttcctgttagctccacaataaccttttagtagtcatttctcttgggcatctaaagagcagtttttctctgcttgaggtctgaatctctcaacagctgacctagctctctaggaatcctgtggatcctgtgaatcctctaggaatcacagtttccttcaagacagggcaagcagtggtggtagagatattaacttcaataagtattattaccaccattggagtaataaataatattttggtgattgatctacttagctgttgtcagtggcagcagtatattaacacaagaacagtagtcacttatggcccagggccataaggtagaaaagctcctctttttgtttctaaagtttatgccgacaccttatgctatattctcccataacttcagtttagaaatgtaactcagagagtctgataaaatttgcaaaattagtacatactttatcaaaatggttagaagtatgtatgttttgtatatatctcactcctataatattaggtatattgtctgcattagacctttgcaaaagacatggattcttatcagctcagagtcacagagaaagttatgtagcagcacattgctctaggactcaagtgtcttgatttctttctaatggaaaggaatgactataaaacaacttggtgtatgccactccgtgtcacattttttcattttgtcaccatggtttcaatttttttgagaaggacctagtgatactttttctgtctccttttcctcttttgtcaaattacctcaacttattttttaaaatgttgccattaaaaaaaattctcctctagttcccatatcaatgctattgcaaagaggagagggaatgaaacttgttttgatatgttcagaagagaagaaattgttgtaagacaaaaagggaaattataattacatactgcataatgacattttggtcaacggtggactgcatgtgtgatggtgcgcccataagattataataccctatttttactttgctttttctatgtttagatacacaaacatgtgccatcatgttacagttggcctacagtattcagtacagtaacatactatacaggtttgtagcctaggagcaataggctatatagcatatagcctaggtgtatagtaagctatatggtataggtttgtgtaggtgcactctatgatgttcgcacaatgattaaatcgcctgaggacatatacctcagtaatctctgtccccttccagtgctgtgggagagaaaagagaaaacaactaccttaggagagagccaggtttcagtgttgaaatattcttaggggagatacagatttcagctaaagaaagagaggaacatttggaaaagagattgaggatataggtagactattctgttgatggtaggatatgggttccagaaaatgctgtggaaaagatttaggaaagattggaaatggggtcagattaggagaacagtaaaatcatttaggatgagagtcctgggatttggggcttctcgtagtgactgacataattcagtggggctgtggggcttgatagaattaatagagatagtctcctaagtagaattgtggccatctgtgttgagaggaaggaagaagtgcaggttttgccaagagtgactcttggccccctgtccgtggctgtgtcaaggccaggaaaaatgtcttgttattagcagcagtcttcagtaagaagaaggcctggagatcctttgggatgttctcttttgaaacacactggtataacgggaatgaatgagaattagcaaattttattattttgagaaagatggtttaacaatttggatagttatttgcctaagtattctgaatatctttgtagctctttacagagctttcacattcattatcttatttgatatgatttcctagtgatttacacataaaatgtgaaattggtacctttaaaccccaatttcagataatgtgaaaacttaatttatatgtccttttaatacttgtaccatgtcatatgattttttgctcagaatcctcaaaaatccctctctctcacttaaggtaaaagtcgaaatccttacagtggcctctacagtcctctgcattttggttccctgttatttctcctccatgatgtaaccttcactcatagtattctaatttagtagttctctatttgctgtttcttgagcatgccaagtgtgattccattttaggacctttgtactctttggtcttctggaactgttctttcctcaaatgctcccttgctttcttcaggattctgcttaactgttaccgtatcaggggacctttcctgatctatatcaatagccgtgtgtctccccagcattccctactttattttatttctgtagcatccatcaccatctgacatatatattagttgatttattccatgtcttgtctgtctccctccattagaaattcaggttccttgagaatagagattgtgtttattttgttcactggtgtatacccagagagagaaaagtatctggctgtaaatcagtattttgggttgaattaatgaatgaggcaagttgaggcagttggtttcagaggttgtaagatttgtttaacttctcattcttggtgatagaatgggagactagaactttctgattcttacctcattgctcttaacattgcagcacacagccactcaaacaatgtttatggttggctgtgtacttagtttaaatatcattggtttatttgtgtatcagagaacattaacctatgttgtttttttttcttccaatgtagatgccagaagaagaagctttctgtgtatttgttaaattaatgcaagattatagacttcgtgaactttttaaaccaagtatggcagaattgggcctttgtatgtaccagtttgaatgtatgatacaggtaaaagtgcagtgttgataaaaaggcatattgcctttatattttttatatcttgttctgagtgccaactaagcaaatttaatgttaaaagcattaaagcacttgaagaagtaagtgttttaattacatgattgttttttggttggttaatgtacaatttgacccttcaaattaggtagatcacagtctaggacttgactccagttttcatattcaatccttaagcatttctgccaaatgtactatacaccccttacctaagcacatgaatttccttattatatcctattattgttacgtagtctaagctctcttacaggagctttatgatattacactgacatcagtccatttacttggagactgtctctttgagtcctctcctctgcctttttacttttattttatttttattttttgctagcccgtaattttttttcctgtaatgttttcttatgttgctagtttaagactcaagttatctagtgactgtatgaaggtggagagaataggagcagaatcaaaatcaagggaaaaatacctttgaagtattttacctttctggatttaatttttatattttatatatttaagtttgctataatgtaaatattttcatttatttcaatttcaatttcaattaaatgagcagaatttaagaaaataggtgaatgaatcagctggcatgagagccatttttattagtttcctctctcctggcagccttataaactccagtttttcccatctgtggtgggagcaaggggatatgtaaaatgttcttatattttattttttatttattcatttatttatttttgagatggagtctcgctctgtggcccaggctggagtgcagtggcgtgatgtcggctcactgcaagctccgcctcctgggttcatgccattctcctgcctcagtctcccaagtagctgggactacaggtgcctgccaccacgcccagctaattttttgtatttttttagtagagatggggtttcaccatgttagccaggatggtctcgatctcctgacctcatgaaccgcccgccttggccttccaaagtgctgggatcacaggcgtgagccaccgctgtgcctggctaattttttaattgacatacaatagttgtacattatggggtacatattttttgtttttatatattttaaagaaaaagccagaataggttttgagatgatttttttttttttcctgagacagagtctatctagctctgttgtccaggctgaagtacaatgacacaatcacagttcactgccgccttgacctcctgggttcaagccatcctcctccctcagcctcctggatagctgaaactacaggtgtataccactgcacctgaatagttttttatctattttgattttttattttttaatttttgtagagacagggtttcactctgttgtccaggttggtgttgaactcctgagctcaagtgatcttcctatctcagcctcccaaagtgctgggattacaggcatgagccactgtgcctggacttgagatgattcttaattaattcttttctgaaatagtaagcttgtttttagcagccttaaactctcttaatgttatattttcaattaatgtgtcatttatggctggacgcagtggcccatgtttgtaatcccagcactttaggaggctgaggtggacaggtcacttgagcccaggagtttgagaccagcctgggcaacatggcaaaaccttgcctctactaaaaataaaaaaaattggctgggcatggtggtgtgcacctgtagtaccagctgcctgggaggctgagatgggaggattgcttgagcttgggaggcagaggttgcagtgagccaagatcacaccactgtaccctagcctgggtgacagagtgagaccccatctcaaaaaaaaaaaaaagtctcatttatgttttgaattactagagttgctgaaacatctgtattttgaatatttttcctattctttaggaaggtaagaatgggtgatcagtggtagatagtgcctgaaagtattttaacataccatttattttctttttaaacgtctttttaaaatattataattgatagaagagtatagaaaatgtcagtcactcttgtatccaccaacaggattaaacaaatataaaacttttattcagtttctttttattaataaattaaatgttatactcaaaattccaacttcacattctttcccccttctttctttcctagatactagccactgtcccagatgtttcaatgtctatgtcttaccttttccatatgatgcttgatctaatctgtgtttggtataggctaatctagtataaatataatctaatttaaaatactcagttttactgtgttataactaattattttcttctctttaggagcatcttccagagctctttgtacattttcaatctcagagttttcatacctcaatgtatgcatcatcctggtttctgactatctttcttacaacttttccactaccagttgcaacaaggatatttgatatctttatgtctgaggtaagctaatgggcagacaaagagcaggagctgagcaaaggggtcactgagttagtgagagcagggcaatgaggagagcaatgaaggaaagccatgtgtcccatgcaaaactgcttacatggataatctcatttaaaccttataataaccctatcaggtagatactgtttttattgcatttgttagatgatagatgaggaagttgagacttagagaaaggttaagtagcttgtctatggacacacaatacataagtggtgttgtaaccaggattcaaacataggcagtttggagcctacactgttaatcatacctctttatcacctcctaactcatacagtgaaagttagtgagaggtaaaatttgtcttacagttaatattgttgaaatgcatctgtcatccaaagagtaagaagtaataagcatgtttcttctatgaacacattgcaggttgttgtccttttgtcagtagcacatagaggtaatcctttgttttctagtctgtgaactcaatgttgttattaattacatcttgggaaaatcaatttgtattacctatctaaattagttcagatcacagttggtcagctgtgattcatgtaccaatcagatggacagatttttgtgcgaaatccattcttccacacctgttttttataaagttttcctagaacacaaccctgcccatttatttatatgtcgtgtatgtctgctttagggttgtagtggcagaactgagtaattttgacagacaatatagcccaccaaacctaaaatacttgctttctgactcttgacagaaaatgtttgccagcccctagtttagatccctaaatgtttaccttagtattatttcaaatgactcgtttttgttgatggaagagtaacataaatttggatttatttaatttgtttcctcagggtttagaaatagtgtttcgtgtaggattagcacttcttcagatgaatcaggcagaactgatgcaacttgacatggaagggatgttacaggtaagttcataatttattttctttttttttttttgagacagagtttagttctgttgcccaggctggagtgcagtggcgtgatcttggctcactgcaacctctgcctcccaggttcaagtgatcctcctaccgcttcagccttctgtgtagctggaattacaagcatgcaccactacacctggctaagttttgtatttttagtagaaacagggtttcatcatgttggccaggctggtcttgaactcctgacctgaagtgatccgcctgccttggcctcccaaaatgctgagattacaagcatgagccaccacgcccagcccataatttcttgaatgtctttggatttcactattaacagcactaagtcattcttatgttttttttttaattgtatcttagcactttcaaaaggtcattccacatcagtttgatggtgtcccagacaagctaatccaagcagcttaccaagtcaaatacaattcaaaaaaaatgaaaaagtaagtattttatatttttgttggaaattcagtggaagttgcaaaacattctagtgatacagttttcctccttaggttatagaactatattattttcttcggtggtattggtttcaatatagcataaagctaatgttggaatatactgcttttaacagtggtgcatgggactagcatgtactacctttaaaactttcctccttttccacgttgactagaattaggagcctggaatggatatacatatatgaggatgctgttatttttaaaaccacttttctggtgtggtcccattcattgacattcttttcctcttagtttgaccccacagtgtcacttaagttcaaaattagcataaccagcaagatagacatgaggtatggattgagaacttaaaattttatttatttattttagagacaggcttttgctctgtcacccaggctggagtacagtggtgtgattatggctgctcactgtagccttgaaatcctaggctcaagtgatcctcccacatcagcttcctgagtacaggaagtaccctgtctctactaaagcacaggtgtactacaggcgcacaccaccatgcctggctaattttaaaatttgttttgtagagacagagtgtcactatgttgcccaggctggtctcgaacccctgggctcaagtgatcctcccacctcagcctcctaaaatgttgggattacaggtgtgagccgctgcacctggtcaaatcttattttttgtactactttctaatgaagctttttttggcattcatgtcctaaaagttcaaaataaagtctctgctcattagttttatttttgaaacagattaagtgtattaattaaaataatagctgtgatttctctagcttccagtacttaattcttagcctgcggtcatagttagcatttctgatactgtactttctatggtataaaatgctttaaaatgataacagtactgtatgctagcagttagcagtttttctgctgcaatatgaaattacattaacatgtacaacatactactcccatggatattcctactccacaaagtatatttaaatatgagtgagaattaatgttattaaaattagttagcttttccatgcacaatgatgtgtacctgtagtcccagctactccggaggctgaggcaggaggattgcttgagctcaggagttcacaatcagcctaggtaacatagtgataccttatctcttttaaaaaaattaaaaagttagctctaattgacaaaagcaagccaagccgatttttgagcttcagcttttattaagttacttgtgatgttttaaataaccaccatcatgttgatacgttttaaataactaccatgtgtggagacatcatatagacaaaaagccgctgtgccttgtaactgataaaaacaaattatctcaatttttgtcacttggtaaaaccacattgaactcacactagccaggcagagaatttatttgactttaaaagtctgatagagaatgaggttccttaaccttcttggtaactaattctccttgcatagatcttgtcatatgtacaatccatttctgaaatttcaattaatcctgtttacttatcagatttctggccctctatttctttcacttccttattcgtgctctccccattctgctttatcaagatctctagattgaggtttaaaagccttcttctgatatgaacaactgtgcttcctctgcccttttgtttcctgtattcatgtatccaattgttattgcatagttactgagattgctgacagtaaattatgtttccagtggccttccatgtatatttatattgactttgattaattatctcattcctcacagtggttacttcaaaccttaccattcttcccaaactcccatcccctttttgctatatgtaactctcaccagattaccttattcctaattcagcagtcatttccaaacttcctaaacttgctgtcttccagcttgtagacttagctatgttctttttcttctctttttagaatacagtatttttttttcctttataatgctaattcagaatacgtgatgttactcatttccatctcttccaggtctttgctccattaattattccttctctatcttcaacctctctctctgttgtttcattttcttcaatctaagaagataattttgagttctgacttagaagcaacaaaacaaaaccttcctcaacatagcatttcattttccttttatgaagcttagctgtgaaggaaagaatagattttactcattagctacagatcacattctatttgctttttttcacttgggaaaattttcagacataacaaaaatagaataataaatatccattgcttattgtctgtatttaacaactgttaatattttgtcatatttatttttttcaaagtatttcaaagtaaatattgttaatattttgtcatatttatttttttcaaagtaaagctcagaaattgtgacacttcactctttaatacatcagtattcatgtccataaagtaatttgcctcatttaccacattgcttccaccacttaacagtagttccataatactgcctaatactcagtctatgttcacatttcctcagttgtgccaaaaatgtctttgccattgatttcattgtattcagttgttcacttacatttttaaaaatttagatcagcaccacctattccaatcttcttttttaatatattggcttgttgaagagaccaagtcagttataccgagaatatccaacctgaaggattcatctgattatttccttgttatctcatttaacttctgtatctcttgtgttttctataaactgggagctaatgtgaagacttaatctaattaagtgcaaacatttctggcaagaatacttaataggtgataccatgtactttattcatcttaaaagatgcataatgtctgtctcactgttattagagatgccatgattggtgactaggttaaggtaatgacagatttctttattatgaggttatgttttccctcttggcacccagtaagtactttgtaagttgatactttggcattgtaagaatatccagttcattatgaccttccacctcttggctcagtctgctcaaaagttattattgagggccaggcacagtggctcacacctataatcccagtactttgggaggccgaggtaggcagatcacttgaggccaggaattcaagaccagcctgggcaacgtggtgaaatcctgactgtatagaaaaaaaaaagaccaaaaattagccaggtatggtggtgtacacctttagttccagctactcaagatactaagttgggagaatcacttgagaagtctaggatgcagtgaactgtgattgcgtcactgtacttcagccttggcaatagagtgagaccctgtctccaaaaaaaaaaaaaagtatcattggggatacttttcatgttaaattatttcatttaggataacaaaagcatgattttaaaaatgttattcttcttacatttatcagtcagctttcttcataaccttttcttctttaactgcagctaacttcattctactggaaacacatataaacacttcattatttcagccaggcgtggtggctcacacccacaataccagcactttgggaggcccaggcaagaggattgcttgagcctgggagtttgagaccagcctgggcaacatagcgagaccccatctctgcaataaataaaataagctaaccaggtgcctgtagtcctggcttttccataggctgaggtgggaagattgcttgagtctggagttggaggctgcagtgagctgtgatcacagcactgcactccagcctgggtgacagagtgagaccctctctcttaaacaaaacaaaacaactttattattccctttaattaccaatttccagagaaaagagttagtgggaatggtgttcttttaaattagtctattcttttgcaggtggcattattaacgaattacagcctatattcagaatgttttaaggttgcaaagtaagctgtgttcaacatcacaaaattttgccaaagtgacactaatctatagtctaacccggcagtgtaagagttcttattgtggccatgtgcagtggtttaacatctgtagtcctttcacttcaggaggctgaggcaggcagattgtttgagcctaggagtttgagaccagcccaggcaacatggtgaaactttgtctctacaaaaaaatagaaaaattagctggatgtggtggcgccagcacacctgtggtcccagctactcaagaagccaaggtgggaggatcacttgagcctgggcggtcctggctgcagtgatccatgattgtgccactacactccagcctgagtgacagagtgagaccctgtctaaaaaaaaagtctcattgttctactttgtcatcagtgcttggttattcttaatttttgccaatctacttaatttttaccagtagcagggggcattattaaggacttacaggtttatattcagaatgttttaaggttgcaaagtaagctgtgttcagcatcacagaattttgccaaagtgacactaatttgtagtctaacccagcagtgtatgtgttctcattgtggccagtataaaatgtctcattttccacttaatttacatttccctgattgttaataagactaagcatcttttcatatgtttattggcctcatgtttttcttctatttttttcctcccttttttactgcagtgtctacttcatactgctttgacttgttagtggttactagttgtttatgatctgggttgtaatcttttgtcagcattaaaagataagtcttgtccatttctactaagtatcagttttggaatatataataaactcaacaattggacctacctctcaaaaatgctcaagcttcctgttggttggagggtagcagcacagaaaagtaaatggcttgttagatgcaaatatgtaacagattattaaaattatatgttagagatacctaacccgtatgtcttcagactggcatacacagactgctgggtgtcaggaaaatgttcagagcttggttaagtagactttcaatttctatctatagtctttcctacaatttatctttctgataacatttctgtagtagaggtgcctcggttcttcttcgcaccttcctttttacagcatgccttctcccactttattaaaggaaggaaggaaaacctgtcacccaacctagatcttactatggtaccttactttagtttataaaaaatctctgtggctccaaacaaaatgaacaatttcagaatgacttgctcctgagggagtatcccctgagagagcatcccctgagagagcaaagcaagaaaaatggaagttttctttattattattattatactttaagttctagggtacatgtgcacaacgtacaggttttgttcagctcccacctatgagtgagagcatgcggtgtttggttttctgtccttgtgatagtttgtgtagaatcatggtttccagcttcatccatgtccctgcaaaggacatgaacccatccttttttatggatgcatagtattccatggtgtatatgcgccacattttcttaatccagtctatcattgatggacatttgggttggttccaagtctttgctattgtaaatagtgccgcaataaatatacatgtgcatgtgtctttataatagcataatttataatcctttgggtatatacccagtaatgggattgctggatcaaatggtatttctagttctagatccttgaggaattgccacactgccttccacaatggttgaactaatttacactcccaccaacagtgtaagcgttcctatttcttcacatcctctccagcatctgttgtttcctgactttttaatgatcaccatctaactggcatgagatggtatctcattgtggttttgatttgcattctgtgatgaccagtggtgatgagcattttatcacatgtctgttggctgcataaatgtcttcttttgagaagtatttgttcatatccttggcccactttttgatggagttgtctttttcttgtaaatttgtttaagttctttgtagatgctggatattagccctttgtcagatgggtagattgcaaagattttctcccattctttaggttgcctgttcactctggtgatagtttcttctgctgtgcagaagctctttagtttaattagatcccatttgtcaattttggcttttgttgccattgcttttggtgttttagtcatgaagtctttgcccatgcctatgtcctgaatggtactgcctaggttttcttctagggtttttatggttttaggtctaacatttaagtctttaatccatcttgaattaatttttgtataaggtgtgaggaagggatccagtttcagctttctacatatagctagccagttttcccagcatcatttattaaatagggaatctttttcccattttttgtttttgtcaggtttgtcaaagagcagatggttgtagatgtgtggtgttatttctgaggcctctgttctgttccattggtctatatatctgttttggtaccagtaccatgctgttttggttactgtagccttgtagtatagtttgaagtcaggtagcgtgatgcctccagctttgttctttttgcttaggattgtttcggcaatgtgggctcttttttggttccatatgaactttaaagtagttttttctaattctgtgaagaaaaccagtggtagcttgatggggatggcatttaatctataaattaccttgggcagtatggccattttcatgatattgattcttccaatccatgagcatggaatgttcttccgtttgtttgtgtcctcttatttcattgagcagtgatttgtagttctccttgaagaggtccttcacatcccttgtaagttgtattcccaggtattttattctctttgtagtaattgtgaatgggagttcactcatgatttggctgtttgtctattattggtgtatagaaatacttgtgatttttgcacattgattttgtatcctgagactttgctgaagttgtttatcagcttaaggagattttgcactgagatgatggggttttctaaatatccaaccatgtcatctgcaaacagggacaatttgacttcctcttttcctaactgaataccctgggtatttctttctcttggcctgattgacccctggccagaacttccaacactatgttgaataggagtggtgagagagggcatccttgccttgtgcaggttttcaaagggaatgcttccagcttttgcccattcattgatattggctatgggttgtcataaatagctcattattttgagaacgttccatcaatacctatttattgagagtttttagcatgaaggctgttgacttttgtcaaaggccttttctgcatctattgagataatcatgtggtttttgtcgttggttctgtttacgtggtggattatgtttattgattttcgtatgttgaagcagccttgcatcccagggatgaagccaacttgatcatggtggataagctttttgatgtgctgctgtattcggtttgccaatattttattgaggattttcacatcagtgttcatcggggtattggcctaaaattctctttttttgttgtgtctctaccaggctttggtatcaggatgatgctagcctcataaaatgagctaaggtggattccctctttttctgttgattgaaatggtttcggaaggaatggtgcaagctcctttttgtacctctggaagaatttgactgtgaatccatcaggtcctggactttttttggttggtaggctgttgattattgcctcaatttcagaacctgttaattggtctattcagggattctacttcttcctggtttagtcttgggagggtgtatgtttccaggattttatccatttcttctagattttctagtttatttgcacagaggtatttatagtattctctgatggttgtttatttctgtgggatcggtggtgatatcccctttatcattttttattgcatctatttgattcttccctctttccttctttattagtgttgctagtggtctattttgttaatctcttcaaaacaccagctcctgaattcattgattttttgaagggatttttgtgtctctatttccttcagttctgctctgatcttagttatttcttgccttctgctagcttttgaatgtgtttgctcttgcttctctagttcttttaattgtgatgttatggtgtcaattttagatcttttcctgctttctcttgtgggcatttagtgctataaatttccctctacacactgctttaaatgtgtcccagagattctggtacattgtgtctttgttctcactggtttcaaagaacatctttatttctgccttcattttgttatgtacccagtagtcactcaggagcaggttgttcagtttccatatagttgtgcgttttgagtgagtttctgaatcctgagttctaatttaattgcactgttgtctgagagaccgtttgttgtgatttctgttcttttacatttgctgaggagtgctttacttccaactatgtggtcaattttggaataagtgccatgtggtgctgagaagaatgtatattcctgttgatttggggtggatagttctgtagatatctagtaggtctgcttggtccagagctgagttcaagtcctggatatccttgttaaccttctgtcttgttgatctgtctagtattgacagtggggtgttaaagtctcccattattattgtgtaggagtctaagtctctttgtaggtctctcaggacttgctttatgaatctgggtgctcttgtattgggtgcatgtatatttaggatagttagctcttcttgttgaattgatccctttaccattatgtagtgaccttctttgtctgtttttatctttgttggtttaaagtttgttttatcagagactaggattgcaacccatgcttttttttttgctttccaattgcttggtagatcttcctccatccctttactttgagcctatgtgtgtctttgcacgtgaggtgggtctcctgaatacagcacactgatgggtcttgactctttatctaatttgccagtctgtgtcttttaattggagcatttagcccatttacatttaaggttaatattgttatgtttgaatttgaccccgtcattgtgatgttagctggttattttgcccattaattgattcagtttcttcacagtgtcactggtctttacaatttgtcatgtttttgcagtggctggcaccagttgttcttttccatgtttagtgcttccttcaggagctcttgtaaggcaggcctggtggtgacaaaatctctcagcatttctgtgtctgtaaagaattttatttctccttcacttctgaagcttagtttggctggatatgagattctgggttgaaaattcttttctttaagaatgttgaatattggcccccaatctcttctggcttgtagggtttctgcctagagatccgctgttagtctgatgggcttccctttgtgggtaacccgacctttctctgtggctgcccttaacattttttccttcatttcaaccttggtgaatctgacatttatgtgtcttgggattgctcttctcgaggagtatctttgtggtgttctctgtttttcctcaatttgaatgttgtcctgccttgctaggttagggaagttcttttggataatatcgtgaagagtgttttctaacttggttccattgtccccatcactttctggtacaacaatcaaatgtatatttggtcttttcacatactcccatatttcttggagtctttgttcatttcttttcactctttttttctctcatcttgtcttttcgttttatttcattaatttcatcttcagtcactttcttccacttgatcgaatcaactattgaagcttgtgcatgtgtcacgaagttcttgtgccatggttttcagctccatcaggtcatttaaggtcttctctatagtgtttattctagttagccaatcatctaaccttttttcaaggtttttagcttccttgtgatgggttagagcatgctcctttagctcagagaagtttgttattacctaccttctgaagcctacttctgtcaactcgtcaaactcattctccatccagttttgttcccttgctggcgaggagctgtgatcctttggaggcgaagaggtgctctgtgttttggaatttttagcttctctggtttctcctcatctttgtggttttatctacctttggtctttgatgttggtgacctatggatggggttttggtatggaagtcctttttgttgatgatgcgatttctttctgtttgttagtttttcttctaacagtcagaaccctcagctgcagatcttttggagtttgctggaggtccactccagaccctgtttgcatgggtatcatcagcggagactgcagaacagcaaatattggtgttctgaattagaattcagaaaaaatttctgaattagaattcagaagtagaattgtgatcatggggcagattattaactcatgtttatttgaattgaaaagtgaaggcaacactttaatgacaggaagtaaatgtaatttggctcattggtttaataataatgactgcctttgccagttaggtcctagattagacgtccataaataagataaatgtcacttaagtttcagtggaaaaattttaaagtacatataaattacaactgtatgtcctttttaactatatttacacttgagataaaacaaaatttagaagtctttaaaatgtatatgaggaaacattcttttagcagatacatgagcagaaaaataagaccacaggatggcataggatgatggcagaggaggaagtttcaggtagttctctgaaggagatgatacctgagtacaattttgaagacctttgtttctttctttttttttgagacgaagtcttgcaggctggagtacaatggtgcgatcttggctcattgcaacctcctccaaggttcaagcctcagcctcctgagtagctgggactagaggcgcatgccaccatgtccagctaattttttaaaaatttttagtagagactgggtttcgctatgttggccaggctggtctcgaactcctgacctcaggtgatccacccacctcggcctcccaaagtgctgggattacaggcatgagccaccatgcctggccgaagactgttgtttctaattgctagggttaaattatgcctgcaacagaaaatccctgctgatatggaacttactgaaatacagaagactgacagaatgatatacagtgtaacatccatcagtgaacgtgccatgaagaaaacaaagccagataaaggacatggagagatgagcactcttttagacagggcacgcagagatagggctcacaggccggtaagatactatttgagccgacaccagagggaagtaagagtgcgagtcatgggattatctgggggaagtgtgtcctacagtacaataacagtaaatgtaaagactgaggcaagaatgtgattgatacattcaaggaatagaaaaccagtgagaggccgggcacagtggctcacacctataatcccagcacttggagaggctgaggtgggaggatccattgagcctaggagtttgagaccagcctgggcaacatagtaaaaccccatctctgcaaaaatgaaaaggaggaaaaccaatgggactgtagtagcataggcaaataggagtgtggtgagcagtgaagtcagaaacatggtagggtgctaggggtatttagagcaatgccatctactgtggtagccattacccatatgtgactatctagtctaaatatgattaaaatttatttcatcagttatatttcaagtgctaattagtcactcacatgtggctaatggctactctattggacaatacagatctagcacgttttcgtcattgtcaaacgttttgttggttattgtcctcctcatgggccagactttttccacatctgaggggaaaccagtagaggattttgcgaaaagtgacatgatctggttttaaaagttttactctttgctgtaatgaaggttggccaggtgaagagaaggagggcattttaagaagaacggtaataggtacaaaggctcataggttcccttactacatgacagttgtaagagttgaatcttagcctttgacttttttttgatgaatttttacgttggtatacttttaaacttaagggggtacgatatactctttaccaagattcaccaattgtttacatttcatcccatttgctttattatcctctctcctctgtatgcgtatataaatatagtgtgtgtgtgtaaaatccattcccattttgggggaggtccatttgagagtaaattgagatattgtgccctttatctgtaaatacttgaatgtgtacttcctatgaacaacaacttttctctcctttaacataaacccagtagttaatcaaaacaaggaaattatattaggttggtgcaaaagtaattgcagtttttgcattactttcaacggcaaaaaccagttacttttggaccaacctaatagatacaatactattatctaatccacagtgtatgttcagattttatcaccaatatatgctgtatatatgctgtcccaataatatgctgtataactatctcccccaccctccgtccagggtccgctctaggatcatgtgtaggatttaggtgttaatacctatttggttttctttaatctgacatatttcctcagtttttgtgtttctgatatatttaaagagtgtacaggccaattattttgtagaaaatctcaaagtctgagtttttctgggatttccccaggattagattcaggttgtgcatttttggcaggtatacccctgatattatatcttctcatttcaccatacgatatatatgatattactttctctcagaactggtaatgttagctttggtcacttgattaaggtgatgtttgctgggttttactactgtaaagttattatttccccttttgtaataagtaatttgtggcaggctactttgagattatgtagtaacctctttctttaccaaacttaaccataccagttttatatccatttatgattttcccactccctcattctttatttattaatcagcattctactgtaaggaagagctttcccttcaccctcatttatttattcatttatttacatcagtgtgaattcatggattattttattcagtgagctataatccattactattaaattatccctgatttgtccagtgggaacccttgcaacctgggtgctttgttcttttgatattttccccattattctttgggaatttcctttctttggggcaacaaaatattccaggttcaacttataccttcttggctcctgcgcagtaatgagctatttctccagagagctttgattacttttttgtaagcctttgaaatttagtctgaaggtgatgagtaaccactgacacgctgggtgtggcgtgatccaaatcaacattttaaaaaaagatcactctgttaatagtgtatagaaaatattgagttatgaaactggccatagaaagaacaattatgagtattttccagtaatttagacaaatcataatgcgggtctaaaaacactatcagtgaagggggaacaaataactttacactggaaaaacctggtgtgtactccttcagccagatgatcaaggtcaacatcaatagtgatgttctgttgatagtttgtacccttagtatgagacaatgaaaacggcatttatgtctgtggtcttcctcctgaaaacccaataaccccagtataatcatgagaaaaacatgagacaaatcccatttgaaggacggaatggtcccttttgaagatcacataatgataactacaaaatacctgaccagtactcctcaaaactgtcaaggttctcatcaaaactgtcatgggctttaggtaacagcaatgtgttaatattggttcattaattataacaatgtaccatactactgtaacatgttaataatagggtaaactgggatgggatacatggaatctctgtactatcttcacaatctttttgtaaaccaaatatttttttttaaattaagtttattgaaaaacactatcagtggagttaaataagtagggtttatttttaggtgtataaatgagtgatatttttacataatgcataatgataactacttcagagtagtcatttgtgaaggctataaacttatttcagtagtgcagctgttgaaaatgttttgcagctctttggagtctttaataaattctgtcggctatcttatagtcttttaagacagtggtccccagcctttttgacactagggaccgctttcgtggaagaccatttctccacttatgggggctgggggtatggcttcaggttgaaactgttccacctcatgtcagatcatcagtcatgagattctcataaggagcccgcagcctagatccccagcatgcacaattcacaatagggtttgcactcctttgagaatctaatgctgccactgatctgacaggaggtggagctcaggcagtgatgttcacttgcctgccgttcacctcctgctgtatgacccagttcctaacaggccacagactggtattggtccactgcccaggggttggggactgctgttttaagatacactttagtgagagacagagtaatgtagcagtcaaatctgtgactatacagaagtttctcaagctttctaaaccccagagtgggtataacaacttatattaaaaagttgttgtgagctaaatgagataagtaatagatttctgtcctttgagggagaattttatttttgaaagcagctgtaagttatttggagcctggtctggtttatatttggagtaaccttggtattgatattttttgtcaagagcaagataaaaaaaatttggtggtactaatttttgtgtggcctatacatttttataaaggtaaatttagacttaccatagagttgcatatcgtgcttactctcctccaatcagtgacagaccacagagatgatatgcccttttcaggacatcttttttcttttaaaaaaatggtttatcactttctgggcgttgcagggaagggtcccaggctggagtgcagtggctagatcatggctcactgcaaccttgactttcctggctcaagcaatcctcccacctcagcctctgagtacctgcaactacaggcatgcacccaccgcacctggctaatttttgtattttttgtagagactgggtttcaccatgttgcccaggctggtcttgaacccctggcctcaagcacttggccccccttggccccccaaagtgctgggattagaggcatgatccaccgtggtcagtgtcatgttttaaattatttttactttttaataattttgacctttattttaaattcagggggtacatgcacatatgtatttcatgggcatattgcatgatgctgaggtttgagatatgaatgatcccatcacccagatagcaagcatagtacccaacggttagtttttcagcccttgtccccctccctgccttcgccttctattagtcctcagtatctgttgttcccatctttatgtccatgagtacccagtgtttagctcctagttgtaagggagaacatgggtttttggttttctgttcctgtgttaattcacttaactcagtacatcttaacaggggtgcatgatgtcagtatgtattactggtgatgttaaccttaatcagttagttcaggtgcagtctactaggattctgtactgtaaatttagtattttcctttaacacttactaaatattttaggagagataatttgagactatgcttaaactttcacccactaattttagcatccattagtggttcctcccgcagtagttattactgaggaattctaatggtgatttttatattaaccttattcctcctatgtctattaattggaattctataaggaagagttgtcccctttccctcattaaaattttcaaagtcaatgttggtaccaggatttttaagttaagagccagttgaacctacaggtgtgttttaatttgagaaataagaataatggttcatttgtaagtttagggctgaaaagaatctgtaaactaagttgcattttgtgctttatacatttcagtttgtaaattttctttttgtgtggtttttatttttgtcatttgtaaagtgagtttttaataagaactcatgaagccacatgatttttctcacatcaaatatctccaagttataagctagaagaaactaaagaaattgtattttatgttcatatgtatttttaaattttgtaatttaataactacttttgaatgaaaacattacctttaactctttttttttcctttcttaggcttgaaaaggaatacactacaataaaaacgaaagaaatggaagagcaagttgaaattaaagtaagcagttgggggctttttaaagtactgattgattgaaatcaattattggacagtagatgtttaaagtttgtacttcttatattcataaatgtatttaccatcctactagattatagttaaaaatagacatttcaaaaaagcagaataatgcgactgaagtggctttcattccagtatgaaggagagcaagctcttccctttttctagatttgttggtggctcatcaggagaaaacacttccatggagaagaaaattatcattccatttaagcatgttttttaaagttgcagagaagacaatctataataacactttctatgctgagaccaacaagagtgtaatctcaggcaaacattaaatagagcatatattacactagaactaattatggttgctctagagctgcagaaagctttgactgatacgactttttcttctctaagcaagggttatacttttgaactactcctctccagaaaatcaagcagattttcaattcgaagggcatataaataccctatatgtaccctaaaaatataaaatttgtacccccctccataaaacacggaattcttgaggtgagggtctgtggcactgttggagctgggacttgagaaaaattgtgttgccttttatgctgatattgtaggatggcgttgataagtggaagcatgagtcaaagaacttagtgattggccaattcactttctaatctctttattcccctccaccccctacccccaacccctggagaaagggttaaaagtaaaataattttagtggagtgactccctcctccctttttaaactttgtgtttgaatgtgtctgatttttgacttggatctggcgagacattatatgaccaccttatttttctccttttacaaggaaatgggttctgttaaactaatactctttcctgccttggtcctcctcaaaagcctctagggagacagtctctccagttttcttatgttaactctctcttatcaactctcctcccttttctagaggttctattcccatttctgtcaccttttccttatcaaatggaagtagatacttccacattttttatatatatagaaaagacccctgtggatgttttttccttcctttttttttttttaattctgtcacccaactgctgctctgctatttgctttgctttttttctttttctttttttttttttttgagacgaagtctcgctgtatcgcccaggctggagtgcagtggtgcgatcttggctcactgcaagctccgcctcccaggtgcacgccattctcctgcctcagcttcccaagtagctgggactacaggcgcccgccaccaagcccgcctaattttttgtatttttagtaaagatggggtttcaccgtgttagccaggatggtctcgatctcctgacctcgtgatccacctgccttagcctcccaaagtgctaggattacaggcgtgagccaccgcgtccagccctatttgcttttcttttaggtactatgagtaagggtacttttactgcaagtaaaaagtacgtcatcctgatgagtggggagagagtatgagttttcacatactacgaatattcggaactgcaaatcaagaatctgaggatggggaagccatcctgttcatttcaccacactatattattgaaaaaaaaatcacagttctatgaacaatccttactcttgaagaaatttcttataaaattaagtacatgaatataggaataccaaaaggcattttcagaaaacagatttttagcagactttcacctatacctgcagtattttcttttcttttagacagggtctccctctgtcactcaagctggagttcagtggcatgatcttggctcatttgcagccttgacctcccgcgctcaagcgatcctctcacctcagcctcctaagtagctgggactacaggtgcacaccaccatgcctggctaattttttgtattttcggtagagacagggtttcaccatgttgcccaggctggtctcgaactcctgagtgcaggcgatccacctgcattggccttccaaagcgctgggattacaggcatgagccaccacgcccagccatttgcagtattttctatactttgttttttgaggaaatatatagttcatatgcctgaagaaatgtttttgaatctagctccatgtgtctcaggcagttggcataaaattgtctatagagaagaatcggaaaaaagagtttagaaagttagtggaacatatcaggtaaataaagtgctgatctcaaaggtagtctgttctctttttataatattgtttccatgtagttctttcttataccattttcatctctttcttcactccccagttccaccagatagaaaaaccaaaacaacttttgaatgactatactttttttaaacttcatatttaggggtgtctgatttttttttcaactgaatacttttttttttttaattatactttaagttctgggatacatgtgcagaacatgcaggtttgttacataggtatacacgtgccatggtggtttgctgcacccattaacccgtcatctacattaggtatttctcctaatgctattccttccctagccctccaccccctgacaggccccagtgtgtgatgttcccctcccctgtgtccatgtgttctcattgttcaactcctgcttatgagcaagaacatgtggtgtttggtattctgttcctgtgttagtttgctgagaatgatggttttcagcttcatccatgtacctgcacaggacatgaactcatccttttttatggctgcttagtattccatggtgtatatgtgctacattttctttatccagtctatcattgatgggcatttgggttggttccagggtgtctgatttttttacttagaccctgacaactcattctaatcatgatcagatgaccaccttatttacaattcattagccaggtataatattaattgagccttgctgtaaaatgggaaatgctacttcttacacacactccctccctcccgcaaaagtctcttttacaagagaatgggttctggttgtaaactagtactttcttgccttggttctttttaaaagtccatgggaagatagttttgtgccattatttttacagcccattggtatgatcatcaaattgtttgatgttttgatatggaagtataaaattagcctttgatgttgtgaaatgtgtttataaggtctctgttgtttttactttaattaaattataagacctttggggtgatgaccttctattctaagaactatatctgtcagtgagcccccggttaagatgcgacttttaagtattttttcacctcttccctaaaagtgttataggaagattttgataataatgtcttcatatggaaaatcttaaattttgcgtgtgaaattttttgttaatagaaacatctttatcagtatcttcttccagtctattgatgttctacctgattgggaggaggtgaaaaatattaaaattctagtttggccgggcgcggtggctcacgcctataatcccagcactttgggaggccgaggcaggcagatcacttgagcccaggagtttgagaccagcctggacaacatagcaagaccccatctcaattttaaaaaagaaaaaaattataaaactaaaattctagcttatattagggtaacccacaaatctttaaaaaggaaaaaaactttgattctgatagacatacgaacagttaatctaatttttatatttaaatttgtgcttcgggatgcagagatctaaagccctaaaatgagaagtatgagaaattctggccagtttttagtcaaaagtaaagtattttttcctgtttaaaaactatggtacatttcagatatgctgaaagccagaaaataatataaaagtgctcacatattcactgcctggcataaaaatgaaaaaaaaaaaaaaaaaagagaagtgttatctaagttgcccaggaattacattttaacaatcaatgtgaagtattagaattgaagctcacatttatttagcccttaatatatgatgggtcacttacatgcattatttccccttattcttaaaacagcattattaaagggttcttatccttacctgtgaagaaattaggcttcagaaagctcaaatattatgccagtggtcacattgcgaggaaacagagtcaaggatttgaagtctgatttgtgttattctaaggcccatgtgtattcttcagtatatacactgtgctgctgctgctttccaagagagactttgatatatttgtgatgtaagatttggatgcccatttttctctggcatatcaaacttttcattaaaaaaactaatggctacataatatccaagggaggtatgctagcctgatttattcaataacacttcatttaacagataattcatagtgcctcctagatgcccaagcactgttctaggcacttgaaatgtggttatgaagtagaccatgatctgtcctcatggagattatattttaatatggaaataacaataaacagaaaagtcaaatgtacggtattttggatggtgataaagtcttaaggagaaaaaataacctcagggaaagagaatgtaaaatggtagtgtttgggtagaaaatttagagaagttaaccaggtgatttttgaaaaaagacctgaaggaagtgatgggactagatatgtgactatctggaagaatggcagaacctattcggggtgtgcctggtgaggagcagtaaggtggcattgtggatgggacagcatgaatgatgagaaaagtggtaggaagtaagatggagcaggttgcagataatgtaggatgttgtcgacagtggtaaggactttggcttttactctggttagatggcagttttcagcagagaaggacaaaatgtgatttaagttcagtagatcattctggttgctgtgttaagagtaaattgcagggattgagagcatttctgatgaacgctgatgtggtaatgcagacaaaagatgatggtgggccaggcatgcctaccatcagggtggcttatgcctgtaatcccagcacttagggaggccaaggtgggcggattccttgagcccaggagttcaagaccagcctgggcaacatagtgggcccctgtctccacaaattttttttttcaaattgccaggcatggtggtgcatgcctgtagtcctagctactcaggaggcggaggaaggaggatcactagaaccagggaatttgaggctgcagtgagctgtgatcatgccactgcattccttcctgggtgacagagtgaaaccctgtcttaaaaaaaaaaaaaaaaagatgatggtggcttggactgaggtaagaagtaattggattctgaatagatttcaaatataaagtggacagctagaatgtagagatgtgtgaggaggaggaaccaagccttgtggtctgagcaggtagataaatggtgttcccattacctgagatgggaaagactccagaaggatttggtttagtggggataccaggagcccaattttgggtatcttgggaatgagatgcctaggagatgtccagttagcttcttaaatattcagatctgaaattaaaagaagccaagctcaaaatataaatttggtagttattggcggggtcatagtattgaaagccatgagaatgggtgagattacttgggaaaggattgtagataaaatagagaagaattcaagaattgagcctgagaataaaccaacatttaaagatgaggaagacaagtagaaagtagcaaactaggagaaaaccaggtaggtgtagttcccagaagccaagagacagtgagaaagagagaaggatttaccatgtcaaatactgaagagtttttgtgaaatgaggatggagaaacgaccattgcattttccagcatgattataatttatcctagaaacgagtggagcagaatggtaggtactaaaacctaactggaatagaagaagaaaaattagagatatttttcaaggaatttactataaggataaaagaaatgggacagtagctagagagggtaattatgttgaattttttgtttctgttttctgtttttttttaagataggagaaataactgcatgcttttatggtgataatcaagtaggaaaaatttatcattaagaatgggggataatcactggagtcaggaagatacggaatttagtgcgaagttaggagatgtaacttagtatgctagcatgagtagttaatacacaataacaagaaatcaaaatatatgggcaaaaatgcaggtaggatgtaggatgtggttttgggagcttgtgaaattctcttctaattgcctcagtttttttcagtgaaatcatatgccagattatcaactgagagacaatggattggagggttgctggtttgaagaaagaggaataggtatgaaatagtgacctagggggatagaagaaggacattattattgctaagaaccatattgaatttagtgatcagtaatttaaataaacgtcatggttttgtttttgttcagtcatatttactggcataggtacagactcaaaattgtcagatagttgatccagagtagtgttttttccaggcagttatactacgaagggagagaagggcaagggggcttaaaagcaagggagccgtataatgattgcaaattaaactttgtcaagaaggaatagagaacatcaaggattgagggacagtgaaaagttgttgggatcactagactgtctcagtgaaaacaattgttggggttgggttactttgtaaactgagtaagctggaaagaataggaaatagtgattgaagagtgggttatttgaaatgagattatcctatttcaggatataaggttgttttcagtttttcttattaaaaataatgctaatggttaacatctttgtatataacaagttttttgtctcctattattatttccatagccagttataaaaagtagaattaataagttacaagatattagcattttaaagacttttgatgtataatacgtaaatttcctaaagaatgtgtccagggtatgtttgtcttagcaacaagtttccatttaatgactactttgccaacactaagtatttcattcttgctctcacttttagtctcttttttttctaatttggtaggtcaaaaaattgtctctattttctttttcaatgtacaagataaacatttgtatgtagctatatctaggtatcttcctctctgtggttttcactttaaagtttaggaagcactctattctagaaaatgtgaggaagatattgaagaattattgagaatcaatcaggtggtagattttagttattaacctttctatgtatcgtcaataaacagttcaaaaatatactggaagaagttccatttgaaataaaaataaaagtatatctaggagtaacctaaatgaaaaatagaataggacctaacaaacactggaaaactttacatacagacattttaaaaagataactaaagatagacaaaaatagctccatgttatataaagatatgaatttcccagtgattttttttttttttttttttttttttttgagacagagccttgctccgttgcccaggccagagtgcagtggcatggtcttggctcactgcaaccttcacctcctggattcaagtgattctcctgcctcagcctcctaagtagctgggattacaggcatgcgccaccatgccaggctgatttttgtatttttagtagagatggggttttgccatgttggcctggctggtctcgaacttctggcctcaagtgatccacctgccttggcctcccaaagttctgggattacagctgtaaaccattgtacctggccctcaaattcagtgaaatttaattccttgtaaaattccagggcaataaaaaaatcttaagaataattctaaaaatagacaaaagtagtaaaataatattcatgcctaacttcaaaactattgtgggcagtgcttatcattaactgagtatttggcatatattaggtgctatgctatctcatttaatttttcagttccctgtaggtttgattactcttaatttctggatgaggaaatggagattctaaaacattgaatgtcatgtgcaagtgttaattgtagaatgagaatttgaacttaaatctgcctaacttcaaaacctagtctcttagctactttagtatactagtatttggggtttgggaacaataaacaaatgtaagaacaggggatattagctctactaggtattaaaacagatagcaaagctataattaccaaaatactgtgatattagttttaaaaaaagaagacagtaacacttgaaacgtaaaagtaaccctgaaatggtctgtattaactgaaaaagtctattgatcaattcctgatgtaaatattatacaaatgaggaagtggtgatttattttttaaatggtgttaagcatttggttagttgtttgtgggagaaaatcaatttagatttttatttataatgaaatagatttcagaagccgtaaaaggggttggggaaggaaatccagatgagtgttttcagttctaaattttattttagcatgatttctgtcataactttattcactcagttgtctggtgggaacttagttttctaaatcttttaagataaaacattaccttttgttgatgaaatatgattgagaacattttgagaatcccatttatttctttggctctctagactttagcagcatttaataattgcttatttgtgtagactactatgctgcacacagtaggaggagccaagacataagaacattttctacttctcaagctgttattttgtctgagattagttattaactttcctgtatatcataatgtctatttcagatcatctgaattttagtgaatagaacaagaaatctaatttgccaagtatctttgtaataactctaagatttgtttcaatttgtgatccactttaataagatgcagtaattcatagagtctctcatttccctgaactaatactttatatgttatataaagccatatttaagtctttactggcaaaataataggttgaattgatggaagaattttctgagacagacattttttagcagaaatttataggaaggtggggctggaagaaggcccttgattgagttctggaacaaattggtacaaaaaagtaagttatcaccttgaggccgggcacagaggcttatgcctgtaatcccagcattttgggaggctgaggcgggcggatcatgaggtcaggagatcaagaccatcctggctaacacggtgaaaccccctctctactaaaaatacaaaaaattagctgagcgtggtggcatgtgcctgtaggtccagctactcaggaggctgagtcaggagaatcgcttgaacctgggaggcagaggttgcaatgagctgagatcgcaccactgcattccagcctgggcgacagagtgggacaacatctgaggaatttgaaaatgaaaagataacttataaaggggattaataagcaattatactggtggatatgcaaaaataactttttaaaaatgtagagtgacttggatttaatacttaatgacagtaattagacaagttttttgggaaccaggcattgaataattaggtaaagtgcttttcaaaaaaatctggttttactttttgaactatgaggagatactagtaattggagttgttttctcagaaaaaattaataaattctttgtattttcagaattttgcaacttgtcatctatactgtataataaatggagactattgaagtctaaatgggcaattttttttttttaaatttgagacaaggtcttgctctgttgcccaggatggaatgctgtgatgtgatactggctcactgcaacctccacttccagggctgaggccgtcttccccctgagcctcctgaatagctgggactacaggcacatgccactacgcccagctaatttttatattttttgtagagacagggttttgccatgttgtccaggctggtcttgaactcaagctcaagtgatccacctgcctggtctcccaaagtggattgcaggtgtgagccactgagccaggccctaaatggaaaatttgatgtttagcctatgaacgtgcattttttagatctcctgtttcttcattcaactgacatttgaatattaattatataggtaggctctgttggaggtaggcaagttagaatcttttttgtctaatgaggatgttaaaacacataagaaaatatttgattatgagtcattatggtaagtatgtatagaaatggaagggcttatttctatatgtactgtagagtgtatttaaatttaatcacagctggaatgatgaatgtgagtatttcctttgctgtggtgtatttatttctctttctttatccctttcctttcccttctttttccttttctttttcctctttcctttcctttcttctccccttccctattactaccaattatagacttctttaatatgtttatgaagaaacattctcttatcatatatatgagctctaacattatatcactatctgcccttcgattaagccataggatgaacatttcatctctccctcttattgagttgtcaccttgtttcctattctcgtaacaccctgtcttattccttcctattcgtgagaatctctctcttcgtgtattttcattcatcgttatctcattccttgtctgtctcattctttctctttctatcatgattcacattatttgtgtctcatgttctatccttccctgtactctctctctctgatgagtactagctctctcgagctttctctgatctctctgtgtctatcgcctcatgtatnnnnnnnnnnnnnnnnnnnngtgggcacaagaatttgaaaaatgttggaagacagggataaacttctgtgacgagcctttaggttatacattaatgtgtgtgccaatttgttaaagaagtatatacagggccttcttccagccctactttataaataatttaagttagtgaagtgtgtctaaaaaaattcttccatgtatacgacggatattttagccagtaaagacttaattatgggtttgtataacatataaagagttagtagaggaaaattggagtctctatgaattctcggatgttattaaagtggatcgcaaattggaacaaatcttagagttattacaaagatagtggggaaattagatttcttgttttattcagtaaaattcagatgatttgaaatagacattatcatacccagcaaagttaatagcttatcttagcctaacaacccctcccttcccctcccctcccttcccttttttggacacagggtttcactctgtctcccaggccggagtacagtggtccaatctcggctcactacaacttccaccacccccacctcagcccccacctcccagccccccacctcagcccccacctcccagcctcccacctcagcctcccaggtagctgggacgacagattcgcaccaccattctgtgtgtgtatgtgtgtgcatgcatgcatgtgtgtgtgtgtgtttttcatagagacaaggtttcaccctgttgcccaggctcatcaccaccattcctggctaaattgtgtgtgtgtgtagttttcatagagacgaggtttcgccatgttgcccagactcaggctcatctggaacttctgagctcaagccatctgccggccttggcctcccaaagagctgggattacaggcgtgaaccatggtgccctgccttctgtgtatttcttactctgagtctttgacatttgataatgtaatcattccttagactcctttcttatttataaaaggtgatacattttcaggactgtgatttagaaatcttttttttcctctcaaaaatgcttgcaaataaaactttttttttcttggcagaggttacgcacagaaaatagacttttaaaacagcgcatcgagacattagaaaaagtaagtaagtgactacttatgcaagcttctgttgaatgcctggtgttttttctgtatatttattaaaaatcctcaaaaattctggcacatgtctcctatgttgtagtattgactgcttagcttgcttaccttactatttatttagccagataacttgttactaataaaaattgatcagttgtactggttcttaaactttagtattcaggttttaactgagattaacagtaacatattgatactatttgttttctttacacataatttctaaaaagtatgttcttttataatttagttgggagtccattctgatatagcattttaaagatgagtttcaaatgttgccctggactttctagcatattggaagtgtggcagtgattcctttaaggcctaggattgcttttagtcgaagtgactgattccttatataaaaattcactcatgttgattttcagcacaaaggaattgtgcataaacttttagttcttataattattttagtatctacttgttacattttctctgttttatatagagtgggcaaatatggaaattttgcattatttttcatagtgtgcttttgatgaaaaatcttttgtagtcatttacagatgctataagaatgaattgagtagtaaaagtatggtttaagaattttgctttattaaaagaaagacatctgaattcacaaactcttttggtgcttttttctttttcttttttatttttttgagagagagtctcgctctgttgcccaggctggagtgcagtggctcaatcttggctcactgcagcctcctcctcccaggttcgagggattctcctgcctcagcctcctgagtagctgggattataggcgtgcgccaccacgcctagctaatttttgtatttttggtagagacagggtttcaccatgttggccaagatgatcttgatctcttgacctcgtgatccgcctgcctcggcctccgaaagtgctgggattacaagcatgagccaccgtgcccagccacttttttctttctttaactagagataagagtaagtagatttaaacatacccctcatcatattgccaaggatcttaaaatcttccctgaaaatctacaatcaagaaataaataaatggaaatatggatattttgcagtatttgtcgtttgtttgaaaagtattgatgatttcatattaaatagaagtgcgtaaggacaggatatttattacatatctgcctttgttgtataataattgcagatacatcatattaagtcaaaaatagtttccctgtttttctctcatcatgttagggttgctatgagagtaattctacttttggtgactccacaggaagattgagcttgcttttaagttgttttaattatatactcttttttcccactaaatatctagcttacagtcaaatatgcatcttcttagttttttttttttttttttaaatctttggagtaagacatttaaactgggaaaggattataatatttcattgaaccttcggaatgagaatgatgctgtaagaaagtgttaagtttggattttgcttctagaaaattaagttcctttttttattggcttagatggcccagatgtgtcacttagcacttagaattctataaatactatgtatcaattgaattctgtaataaaaaagtatactttctcagttattgctaaagtttaagtttagctcattaattttatttgtcatattttccttgctttgtttctttgaaagttgtggttgcacaaattgctgtcacactttataattggaattgcttactcaaattccttctccctttcatgtaagtgggttgacaatatggattaagtctaaaagatgtaaatataccaaaagaggaagaggaaatatttgactgagtgcagtggctcacgcctatgatccccgcacttcgggaggctgagacaagaggattgcgtaaggccaggagttcaagattggcctgggtaacatagcaagactgtatctctacaaaaaattttaaaactagctacatgtggtggcacacacctgtagtcctagctgctcaggaggctgaagcagaaggaccaactccttgagccgaggagttggcagttacaatgagctacatgatcatgccattgcattctagcctgggtgacagagtgagaccctgtctctattttaaaaaaacaaaacaaacaaacaaaaaaatttgcttgttccaggtaatgaaaacccacttggaatttgtgtttggtatcttctggaaacacatgattttcaaccacctatccttgtttttatatatttttcttaaggtttaaaaataaaaacattcagtaaaaaatggttttaaactttaaatgtccattttaattagcaatgaaaagtagatggaatttgggtatatttgtttcttttttcctaattttatcacttttatttctttctcttatatttctatctgaatttttccttttgtaggaaagtgcttccttggcagatagattgatacaggtatagtttttgttttgttttagttttttaaaacatcttctctaacttctaaggaaagtcctaaacctcgaaattcatattttaatgcatgcaattttacatgcgtttttctagaaataattctttgggtggtatatgtgggtataaatttaattttttgtaacaaggtgttatcttggtttatttttgcacgttttaaagctaaccttattttttaaagtatttatttcaaaatggcaataagtggattctgtgaaattaactactattcattgaaaattttagtcctgcatgtacaactcagtaatattgcatgaattaaatttttattgactgaaagaattgttcttgtcaggtgaatttttcgtttagtttccgaaaatttgctggagcaataacaagctgctagctaatgattacgtaggctgttctattcgctgaggtgacttttttttttttttttaacatgtcaaagtaaataactaaacctcacaaaggcagtctttcttgaatctatcctaaattgctttacacacacaaaaattatgtcctaagggacaagtgacaagagcccaggaggctgaggaaaactacctcataaaacgggagttggccaccatcaaacagcagagtgatgaggccagtgctaagctggagcaagctgaaaataccatcaggaagctccagcaccaacaacaatgggtaaggagtctggtagtgcttttctcatctttctcatcccccttcctttcaatcattttttttttcatagcacagattttgtgctgttgttttaaataattttgttttagactttgaacttttaaattatacaattttatgttctgtgatatttaggggtcttattgtggcctaaggactcctgttctaattttttttctgtctacatagttttgttagaaataggtaatattttctttccttacactgtgttttaagtaatgggaaataagcagtgtatgtcagaattgcttttaagtttttagaaatctgttttcataataggtatcattttgctaacagtaatttttaaatcccaacttcagctagtttttgttcattgtacagatgaaacattatccagcatgcagaatatatgcagttatctcatttaaagcttcgacagtgtggcaatttgtgtcttacgaaatactattgcttagacttcctacatcaagacattgaattatgggttaaggtgtatgcctatatttcaaagggagagaagttgcaaagatgaaaaagattaaccctttaaaaattatcttaattaacctagggtgtatttctaattatcttaatcaacctagggtgcgtactaaacagctactaattgtacatctagcctcaggtatcttttgcagcttagacattttccattggcaaattcagacaagggcgatcttaatcaggaatatgagggtaaaagaaaagccaactgtttatctttgaaaacatattatttcttgtttcagttttccatcctcaagtaggcgctagattgtaataagtaagcagaagaagttgtgttaatcctggaactctatgcagatctggaaggcaaatagagtgactgcaaagtaggacgttctttttattcaataaaattaagaaacagcatcgtcatctcggtacaaaaaaatcagaaaaccagaagcaaaaagaaaaattggcagttgaaagggtcataaacatctttttttttctgttattgaagattgctaagaaaaatgaataggagagtgacaaaataatactaaaaagaagggaactcatattttgctccacttttgtatgtaatgtcaataatatcaaagcattaaaaagaaaaaaacaattgtggatttatattaggaatttacctgaaataagttacttcaatgtgattttctaaagaaaacacaataagtattgtttgcatttagcataagctacagtcataatacattagaatcatgaattaaattttttacattgtttttcaaatattgagacttattgatagatgtatatcaaagggatagaatgctggtttatagtgaaaaatttaacttggtgagcaaaaatggccataataaagtgaatgagcatattacggctagaaagtgaacatctgttgctcattgttttaattatagccttccaatataactttatgaattcttcaaagtttcagaataagggttttaaatttgtattccagcaggaggtattgaattaccaatataagcatccaccgccaccactccctactgccaaatagtggcaatttatatgatataaagagctttggattttatttatggaactagattctagtcctgttttgccaactatgtgatcttgtatactcaaagacagttttgtgtgtgtgtgtgtgttttttcccaaatgattaaatagggctagaccttctcaggtctctctctttcacttttaaaattaactttattaaagtataatttatatgtaataaaattcatcaaatgtaggtatgtagcttgatgtgttggaaatgtatgtagttatgaaacactaccacaatcaaaacaaataatatttctatcattccctttatggttcaccaccccccaaccccagcaacctgtgtgctttctttcactatagttttacctcttctagaatttcaaataaatagaattgtaaggtatgtgacttttatgtctggcttctttcacttagcatatctattcacttttttgattatttttgaaagttttatttttaattgacacatcaaatcagagtaattagctaacacattgattgcctcgaacattcctttgtggtgagaacattcaaaatcccctcttctagctattttcaaatatacaatacgttattgttaactatagtcactctactgtgcaatgtaacaccagaatttattcttcctatctaactgtaactcatacctgttgaccattctcttcccatcaccatgttcccaattccctccctagtctctagtaaccactattgtattctcagtttctatgagatcaacttttttagattccacatatgagtgagatcatgtggtatttgtctttctgtgtctggcttatttcacttaacataatgtcctccaggttcatccatgttgtcacaaatgacaatttcattttttaaaatggctgaatagtgttatttttatacatttaggggatccaagtgcattttgttacatggatatatttcatagtagtggagtctgggcttttagtgtaaccatcagctgaatagtatatattgtatccatgagttaatttctcattcctcaccgcctctcaccatgttacctttctgagtctccagtgtctattattctatgctctatgtccatgtgtatacattatttctcatttataagtgacggtatgcaatatttgactttctgagttattttacttaagataatttcctctagttttatccatgttgctccaaaacacataatttcattctttttaatggctgagtaatatttcatggtgtatatacacaccatttttttgtattcagtcatccatcaatggatacttaggttgattccatatctttgctgttgtgaataaatctacaagaaatatatgagtacaggtatctttgatataatgatttttcctttgggtagatacccagtagtaggattgctggactgaatggcagttctgtttttagttctttgagaaatctccataccatttgtcatacaggttgtactaatttccattcccaccagtagtgtatatgtgtcctcctttttccacatcctcaccaatatctgttattttctgactttttaatagccattctgactggtgtaagatggtatctcattgtggttttaatttctctgatgatagtgatgttgagcatttttttcatatgtttgttagccatttgtatgtcttcttttgaaaaagtctgttcatgtcctttgctcactttttaatggagttttatttttcttgttgagttgtttgcgttccttgtagattctggatatttgtcttttgtcttatgtgtagtttgcaaatattttctcccattctgtaggttgtctattcactctgttgattattccttttgctgtgcagaagctttatagtttaattaagtcctatttgtctatttttgtttttgttgcatttgcttttgaggtcttagtcatgaattctttgcctaggccaatgagcagataggttcttcccaggttttcttctaggctttttaaattttcaggtcttaagtttaagtctttaatccatatttttttccttctctttaatccatcttgagttaattttgtaaatgatgagagatatgaatccaatttcattcttcttcatatggctaattttcccagcaccatttattgaatagggtgtccttttctcagtgtatgtttctatcaactttgttgaagatcaggaaactgtaggtatgtgactttatttctggttttctgttctgtttctttgatctgtgtgtctgtttttaataccagtaccatgctgtcttggttactatagccttgtagtataatttgaagttaagtaatgcaatatctccagtattgttctttctacctaggattgctttggctgttctgggtctttcttggtttcatatgaattttaggatttttttttcctaactgtgaaaaaagacattggtatttttataggaaatacattgactctgtagactgctttgggcagtatggtcattttaatgatactgattcttccaatccatgagcatggaatgttttttccatttgttggtgtcatccgcaatttatttcatcagtattttgaagttttccttgtaaagatcttccacctccttggttaacagtattcccaggtatttaaatttttttgtagctgttgtcaatggaatttacttctagatttggatctcagcttgattgttattggtgtacagaaatgttactgattctgtacattggttttatgaaactttaatgaattcttttatcaaatctaagagccttttggaggaatctctagggttttctaggtataagatcataacatcagcaaacagataatttgacttcctcttttccaatttgaatatcttttatttctttctctttcctggttgctctggctaagactgttagtactatgttgaataagagtggtgaaagtaagcatccttgtcttgttccagatcttagaggagtgctttcaacttttccccattcattatgatgttggctgtgggtttgttgtatatggtttttattattttcaggtatattccttcaatgcctatgatatggcttggatctcccttccagatttcatgttgagatgtaatcctcattgttggaggtggtacctggtgggatgtgtttggatcatggggcaaagacctcatgacttggtgctgtcctcatgtgagtgagtccttgtgaaatcagattgtttaagactgtgtggcaaccccctcccctactctcttgctcccactctcactgtgtgacatacctgctcctgcttcgccttcctcaatgagtaaaagccttcccagaagtaaatgccagtgcttcctgtacagcttgcagaaccataagcctattaaacctcttttctttataaattacccagcctcaggtatttcttcataacaatgcaaggagaacctaggttttttagtttttttttgtttgtttgttttaacaggatcttgctctgtcacctaggctggagtacagtggcacagtcatggctcactgcagcctcaacctcccaggttcaagtgatcctcctgctttagcctcctgagtagctgggactacaagcacacaccaccatacctcattaatttttgaattttttgtagagatgggttttcgccatgttacccaggctggccttgaactccagggctcaagcgatccacctgccttggcctctcaaagtgctgggattacaggcatgagccgatgtacctggcgtatgtttggtttttgtttcgttgggttttttctgtttttaatcatgaagggatgccgaattttatcaagtgcttttttttgcatctgttgagatgatcatacagtttttgtttttagttctgtttatgtggtgaatcacagttattgatttatttatgttgaaccatccttgcatccctgcagtatgacccacttgattgtgatatattatctttatgatgtgctgctggatttggtttgctaggatcttgttgaggatttttgcatctgtgttcatcagagatattggtctgtagttttgttatttttgtgggtccttccctggtatcacggtgatgccggcttcatagaatgagttaaggaggagtccctccttgatgttttttggaagagtttcaggagaattggtactagttcttcattgtatgtatggtagaatttggctgtgaattcatctgatcctgggcttcttgttcttgttgggagatttgttattactgatttaattgcactactcattattagtctttttaggatttctgtctcttcctagttcagccttagaaagttttattcttccagggatttatccctttcttctaggttttctagtgtgagtgtagagatgttcatagtagtctctgttcatttgtatttctgtggtatcagttgtaatgtctcctttttcatttctgatcacttgttaatttgggtcttctctcttttcttggttaattgagcagtatattggttttgtttatttttttcaaagaacccacttttcatttctttgatccttagtatattttgttgttgttgttctcagtttcatttagttctgctatggtctttgttatttctgttcttctgcttgctttaggttcttgtttttctagttcttgaggtacgatgccaggttgttaatttgtgatccttctggtttttttatttaggcatataatgctgcagacttcccacttggtgctgcttttgctatatcccagaggtttttgtatgttgtgtctccatgttcatttgtttcaaaaaagttttagatttctattttaattttgttgctgacccaaagatgatttgggagcaggtgaatttttatgtatttgtatagttttgagagttcttcttggaatcagtttctagttacattccactgtggtccaagaagagacttgatatgattttgatttttgaaaatttattgagacttgtttcatgggctaaaatatggtctgccttagagaacatttcatgtgctgatgagaagaatgtatattctgtggttgttgaatagaatgtcctataaatgtctattagagtccaatttatgtccagtatttctttgttgatttcctgtctcagtgatctttaatgctgtcattggggtgtggaagtccttctctattattgttgtgctgtctcttttcttagatagagtagtttttctggggttctcctttctttttcgtctgagtcatgtactgtttccaaggcactgtctcaggatgtcctgagaacatgtgccccagtagtagttgtcttatgaatctgggtacctcctatatcgggtacatatatatttaggattgttacatcttcccgttgactttatcccgttatcattttaaaaatgaccttcccttgtcttttttcactgttgttgaatttaaagtctgttttatctgatacaaagatagctactcctgcttgcttttggtttctgttggtgtgggatatcattttctaccctttttccttcagtctgtattaggtgggtttcttgtaagcagcatattactggatcatcctttttgtaagacctgtaagttttatacttttgtctgtttttatgatgttgagtattgaccttttgtttacatgtttagaactcacttgaacatttcttgtaaggctggtctaatggtgatgaattctgttagcatttgcttgtctgggaaagactttttctccatttatgaagcttgttctagcaggataaaaaattcatggttgacaggttttttttttctttaataagtcttaaaatgggattgtgattttttttctggcttgtaaagtttctgccagtatgtccactgttagtctgaggggatttcctttactgatgattagacacctttctcttgctgattttaggatttttttttttccttcatgttgtcattagtctgatgagtatatgtgttggtgaagtccttcttgcactgtattttcctagagttctctgagcatcttctatttggatgtctaaatctctagcaagagtagggagttttcctcaattacttcctcagataggttttccaaactttttgctttttcatctccctcaggaatacctatgacttgtaggtttagacattttatataacccctatacttctcaaaggctttgttcatttttgaaaattattttttctttattttcgtctgactggactaattcaatagacctgtctttaagctctgagattgttttttctgctgggtttagtctactgttaaagcttttacctgtattttataatttcttcaatgaatttttcatttccagacttgattttcagatttcttggtgttgattttcattcagctttctcttagatctcattgagcttcttggaaatcagtatttttaattctttatatggtatttcagagatttcattttagttaggatctattgctagagatttagtgtgatcttttgagaatgtcataacactgtctttatacttccagaattgtttggctgtttccttctcatatggagaaacttatcttttcttcttatttttgaatttactttcatttggacaggaatttttttcctctgaaggatataactacaatgtatgttctgggtgcttccttggcagaatgtatgagttctttgaatatagatagcctttgtgtggtggttttctcaaatgctagttgtagtagtagtgtactggctgtgtgagtagtatcacagcttcctgcagggctgggatggcggaagtctcaagaatcttatctcatttcccagcactgtgcacttgtgtcagcagattttctgttgggttgtgcatttcagcctccaggacagtaggtggtggttgtgggtaagagcctgctgcaacagaagcagatggacaggtgcttgatctttgtttaatgggggaagttctttgttgcttcaggcaatgggctgggctgtggaatgtacagtggcttgagctctctgctcaccccctagcaggggacaagtcagggcagagatggacagccaagccggcccttggattccccaatgatgagcacaagcagaagacctgagtgggggtggcagggaagctcctggtaagtacactgaggtctctgcagagaggcagggagccaccccagttccatagcccgggcaggcaggaatgtaatctctctccctgtcatgcccctgtccccaaactcagaacactcaaattggtcagacaccactgtctatctccaggctgcaatgtacctgagagccataaaagatgactgccccttggcttgctgccagaatgtctttgttttggagtcttcttcctcagtccaaaacacacagctttttggctctcctctcccttgcaggaacgctgctgctctgcatggagagggggagggggtcccaccttttgcacaagcttagatatggtggactgattgccagtaagaccacagtcacccctgtctgccccagaaagtctgtgtgctctgatgcacccatgccagtttcctgtggtatcagccatggctatgcctacagcagtggggttgaggaggagtccccatctccatgcctgggtctgagcactcatactaggttggcccctgggatgaaatcacacttgcaaagccttgtagagccaagcacagtgcccacatctttgctggaggcagtgcagtcactcagagtccacaggtggtgagctcttgggcacaggaaagtatgtgttctggtttcctttgtcccagtgggtgctcccttggcgtgcaatacttgttcttctcttcggggcagcagttgccgaggaaccctgcagctccctgggtccagccatccctttgctgctgccacaatctgagcagatgccagggaatgtctatggggctctggtgatgtggagacacaaaggctgaggttccctgggcagggtacagacccctgatggctgtgctcccagtatagcaccctatcgctgctgctcaagtccgggggcagagtgagcaacccagtgcaagttggtaatctggtgcagtgccctcaagaagtccccaaatcactgcccacaccagtgtttgggtttgcagggtagaggagatctccgacagttcagttaccagtggtttgtcacaggttaaagaggagcccaaacactcccaactacccttttgactagataccaaatccctcggggttcctagccgatctctgccagcttcttgcttccttctttttctgtgccccagcttcttcacatgagttctctactagcctccagcattctctggatagtctattcacattatggttattcacttgtaaccttggttcttctttctgaagagaactggcattggacacctctagtcattcatctcgaaccctctccccaagaatagtatttgattgtgcatacacaccacatttcccttatccgtttgtctgttgatggatatttaggttgattccatatcttagcttttgtgagtagtgttgcaataaatgtgggagtacagatacctcttcaacatactgattttatttcttttggagccagcagtgggattgttggatctgatttttttcattgtgataaaatatatacaacctaaaatttaccatttaagtgtacagttcagtgtcattaagtacatttataatattgtgcagccatctccactgttcatttatagaaccttttcattgtctgaaacagaagctctgtatctagtaacaataatcttttcccatcttcccagcctccggtaacctctgttctactttctgtctctatgaatttgcttattctgggtagcttatttaagtggaagcacataatatttgtccttttgtgtgtggcttattgcactaagcatgatgttttcaaagtccatcattgttataacaggtatcagaatctcattcatttttatggctgataaaattccatagtatgtatatactacgttttgttcatccgtttgtttgttgatggacatttgggttatttctgccttttagctattgtggataatgttgctatgaacattgccctataagtatctgtttaagttcctgctcttaattcttttaagcatatacctagaagtagagttgctggatcatatgtaattttatgtttaattttttgaggttgtgtcagacttatctatagcaactgtaccactttccattcccacaagcagtgtacaagggttccaatttctttcttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccacctcggcctcccaaagtgctgggattacaggcgtgagccactgcgcccagcccccaatttcttaatatccttgccaactgttgttattttctgatttttgtttgttaagtaatagctatcctagtaggtgtggggtagtatctcattgtggttcaaatctttttttaactttaaaattctttcaatgcaaagactatatcaaatagacatttaaataattttttgaccgagattttgtttatggttcctctctttctccttttctccaaatataagtagcggccaatttagtcatgggaaagataacaactaatttctttattctgtaatttattgtaaatatatcaggttcaatttgtgtaaatactttgtattttccttagtcctatatgtgttaatcttataatggaatgaacttattcatatatttatttgaaaactaatgtgcaaagtattgtcttaagtgcagagggtacgataatagtaaacaagaaaaacgaagactgctgttacgtgaagtgttctagttggggagacacattaaacagatacaatttcaggtggtaataaggtgatgaagaaaaataaaaataaagcagaggagaggtggtttgtgcaggtgctactgtaggtaagctagttttggagagcttccctgaggagctaagatttgaccagagactcaatgatatgaagatggaaactatttgaagatctgggaagaaacattccagatagagcatacacttagtagaaaggcctttatcaaggaataaatttgtggttttcaaggaacagtaaaatgtatatttataaaccatagggaaaccacctaaaatttttttagagaaaaatatataattaggtagcaaataacagagataaaattgagtaatttaagaaattatttaatcaggaaaaagaaaaaaggaacagcaagtaagtggatcagatagaaaatttggaagattatagattttattccaaccatatcaataattatattaaatgtattttaaatataccaattataagattggataaaaagttaaaacatatctgtaagaaatttgctttaaatacaaagatcttgttaggttaaaagtaaaagaatgcgccagcaatgaataactagagaaggaaattaagaaaaaaagtccattcacagtagcttccaaaagaataaaatgcataagaataaatttaaccaagaaggtaaagacttgtactctgaaaacttgtactctgaaaaaaaggatgtttactcatttgtcaaaataaagaagatataaataagtgaaaatctatctcgtatttgtatattggaagtcttaatgttaagatgtcagtactacccaaaatcacctacagattcaatcctatcaaacctatcaaaattcccatggacttttgcagaaatgcaaaagctgatcttaaaattcacatggaattgcaagtggccttgaatagccaaacaatcttgaaaaaaaagaacaaagttggaggactcacactttctgatttgtaaacttaatacaaagctagagtagtcaaagtagtactggcataaggatagacacatagattaatggaatagaaatgagagtccagaaataaacccatacatctatggccagttggttttccacaaggatgctaagaacattcaatgaggaacgaatagtctcttcaacaaatgatgctgggaaaactggatattctcctgctaaagaatgaaattagatgcctaacatactgtatacaaaaattaactaaaaatattccatagattttacagttttgttttgttttaggcagggtctttctctgtcgccaggctcgagtgtaagggcacaatcagctcactgcagccttaacctccagggctcaaatgatcctctcacctcagcctcccgagtagctgagactacaggcacatgccaccatgcccagctaatttccatattttttaatagagatgaggttttgccatgttgcccaggctggcctcaagctgaactcaagcgatctgcctgcctcagcctcccaaagtgctgagattacaagcataagccactgtgcccagccaactttatgatttaaaaataacatgtttatgtttttaaagccataaaaccctgagaagaatacatagagataaatcttcatgaccttggatttgtcagtggttttagatattggttcttaggcaccaaaggcatgagcaacaaaagataaactggacttcatctaaatgaaaactttttgtgcatcaaaggagattaagaaagtgaaaaggcaacctgtagaatggtagaaaatagttgcaagttttgtagctgatcaggatctaccatccagaatatatcatgaactcttacaactcaacaacaaaaagacaacccagttataaagtgggcaaaagacttgagtggacttttctccaaagaagatatgcagatggccaaaaagcaaatgaaaagatgctcaacatcatttttcatgagggaaatgcagagcaaaaccatgatgaggtgcctcttcacatccattataatggatggctataattttttaagagacatgttggcaatgaggtggaaaagttgaaaccctcatacatttctttttggtaggaatataaaataaaatataaagctgctgtggaaaacagtttggcagttcctcaaaaagttaagcatagaattatcatggtaccctgctattcaactcagaggtatgtaccgcaaataagagaatgcttgtactcaaacaagtatgtgtatacacgtttgtagcagcagcattcacagaaaagtggacacaacccaaaaatccttcagtgggtgaatggattaacaaattgtcgtatacacacaatggaatattattcagccataaaaaggaatgaagtactaatatatggtataaagtagataaacttccaaaaccttaagctaagtgaaaaaagccagacccaaaagatcacatattgtatgactccatttataggaaatatctagaatagataaatctaaagagaacagaacacagattagtggtttccagaaggtggtgatgggggaaagataagaaactgcttaataggtaaggggttttactttagaatgatggaaatgatatggaactagatgtggatggtcatacaacattcttaatatactataagacactgaattgttcactttattttttttatttttttatttttattattattatttttttgagactgagtctcgctctgttgcccaggatggagtgcggtggtgtgatctctgctcattgcaagctccgcctcccgggttcacgccattctcctccctcagcctcccgagtatctgggactaaggcacctgccaccatgcccggctggtttttgtttttttttttgtatttttttttttttgtatttttaggaaaagcaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggcggatcacttgaggccaggagtttgagaccagcttggccaacatggtgaaaccccatctctactaaagatacaaaatttagctgggcatggtggtgcatggtggtctagtaatcccagctatttaggaggctgaggcatgagaatcacttgaacccaggaggtggagtttgcagtgagctaagattgcgccactgcactccagcctgggcgacagggagaaattctataccccccaccccctcaaaaaatgttattgacctcctacctctcctccaagcacccttcctgcccccttcaccttccctcttgctaggtgaccaggaaggaagaagcaatttagtcaggatggctaaaggtgatcccaagaaaccagagggaaaggtgtctgcttattccttctttgtgcagacatgcagagaagaacataagagaaacccagaggtctctgtcaattttgcagaattttccaagaagtgctctgagaggtggaagacagtgtctggcaaagagaatcctaaatgtggtgaaatgacaaaggcagataaagtatgctatgcttggaaggtgcaggattgtgaaccagttaagtgaggcaagaagaaggaccttcatgtctccaaaagagacatgtctgtattcttcctgcactgttcagaatttcaccccaagatcaaatccacaaaccctggcatctttattagagatgtagcaaaaaagctgtgtgaggtgtgggataacttaaatgtcagtgaaaagcagccttgcatcactaaggcagtgaagctgagggagaaatacgagaaggatgttgctgactttaagtctaacggcaagtctggtgcaaagggtcctgcttaaagttccttggaaaaaggtggaagaagtagtcaaagaagatgtgaggaagaggaggaggaggaggaagaggaagaagaaggtgatgatgaataaaaaactgtttatctgtctccttgtgaataccttagagtaggggagggccatgattgacacatctgttgtttgagaaatgtctgttgccctcattaggtttaattacagaatttgatcacaatcatattgcagtctctcagagtgctctaaaaattgtcagtggtttacctgaagtggtcatgtgtgtctggaacactctgaaattgtatcaaagttgtacatatttccaaacatccccaaaacgaaaagataatctcatgttttcctcactctatgcactttgctgttggtgtgacaaagcatttaaagatatttctgacattttaaaaaacatttgtaaggtggtattaactatacggttattggctagaaatcctgttatcaactgtacatatatatagtttataaaaagaacaaaacaaccaagacaaactcttggtgctcgtttcttggcgctgagcctgtgggggacaatgccttttggaggggtcgtagcttagagcgtgcactgtgaggctagtcctgtttcccctgtaatgttcagccatttagcttcagcttgtcttgtttctacaaacggtaatataacagtctgctaccattcttagctgtggacaaagaggggtcagctggcctgagaagtgttgggatttttttaattaagtgcattgtctataaactttttgaacaagctgtagaactgttgtcagcaaagtaaagagccactgcatcaatgaaagttcaagaaagaaccttctgtacttaaatgtgattttcagtgttctggggttttttttgtatgtttagaatgctgaaatgtttttgaagttaaatagtgttaaaaatgattttagaattttgcttcaataaattgtttttaaaaagactaaataaatgataatataaagctcaaagaaactcgacacatttaagtgattgcagtagaagacgagtttatgggagaacgtgtaaagtccctgtgctagaacccattggtgagggtcaggttagaaccaacaacaagtgatctggtttgcagggggagcctgggaggattaggagattcactcagggctggggttgggcatgtcttgatcagagttgtggttgccttgagacttataaaggagaatgcaacgtgaagtgaagcagagcaggttggtggcagcaagagaagtgagttgcaacagattatcagaccaatgacctgtagcccaaaggcaaggggatttagatataagagacattaatttggagtatcagcatttactagattaatgggagagcagcttggacaaggatgaatatgggggctattacccacagctaagatttgatatgatttggggatgtgatatttggataggatagctcaatttaatgtgccagagtagagcagacataaggttctttatgttcctctagttagaaataaggttggtcccaaaatatcagtgaatctgagcctgtaggtaggggtgaaatagtatcagttgcaaagattagaaattacagaggccaaagtaggttgctgtgtagctatggaaatgtgtagagcttgatagctaatgacagtgactttcccccacagtggacttctaggagtgaaggatcaagatggtctgcctataattattggacataatattttaattacaactggaaaaaaattaaaaggatgaaaaagatataatatggaaatctaatcaaaacaaagcctggagtgtctgcattagtatcatagacaaggtggactttagaacaaggaatagcaccaagagtaaagagaactatctataatgatagttcaccaagaagacataacaatcttatttaagattgtatgtgtttaggaatgtatgtcacctaatatatgtatgctaacaggaacagtaacttgaactgatagaactgaaaggtagagtgaacaagttcaggtcttcgacatccctgtctcagtaattgatgaagcaagtaggtagcagaagacctgaacagtactatcatccaacctgccctgatagatatttatggaacactgtacctaataacagcagaatacatatcctttcaaacatacatggaagatttatgaagatagaacatattctgggccttaaaaggaactttatcaaatttgaagtaattgaaatcatacaaaggatcttctctgactctaatatcattcaattagaaattaataataggtatctggaaaatcccctaatatttggaaattaatacgtttttacccatgggtcaaagaggaagtctaaaaggaaattagaacatattttaattaaatgaaaatgaagacacaatatctaaaaatttgtgggacacatctaatgcagtgcttagtggaaaatgtattaagtgcttataatattaagtggaaaatgtattaagtgcttattaggcaagtcagtaagtctcaaaccaataatctaagctcccaccttaataaactagacatataaagaaattcaagctaaccaagcagaatggacaaataataaaaagtgtagaaatcagttaaattgaaaacaaaagtagagaaactttgtcaaaccaaaagctggcttcttgaaatgatcagtaaagttgacagatctgtgtccagactgatggaagaaacaaccaatgtcaggaatgacattaactttttacaggtgtggcccagttgtcttatttcatattctagatttgtctaattccttcctcgtggtgtcattgtatttcttgtcaactggactcagacatctagattatagatgatgttgtaaacttctttttgctttaaatcaggaaggcacatgatataaattgtgcccattattagtgatgctgagtttgatttccatgctaggtttggttatcccagactctctcccttgtaaaagctatgatttcatgtttgccactattaagtgatctgttggaaatatttttgtaccaaataactatcttgttctccatccaccttttacctaatggttttaccctccacaaatgatccttatggaatcagttattacattaggtttccagaatggtgactttcatattctctcatttttctacatttattagttataaacaagaatctttctctttttttcttttaatatctctagctccctctgactcactatgaactctttcatgttactccagatttattgacttttgttcaatatgtcatataattcttaatagtttcaatgctattggtacagtgatatgctatatagttatgttacaatagaatattaaacttcagaacagcagttttttaaaaggtaaagtttatttttaactaattttgagtattggcattatttaacaagtgtttctgcagttccagttatagaatgattgtctttagtagatcactgcttccattttacgctggcacttggtagtttgaacctaatattgttagttttcaaaaatgattgaaggccaggcacagtgactcatgcctgtaaccatagctctttgggagacaagacaagaggattgcttgaggccgggagttcaagaccagcgacacagcaggaccctgtctctacaagaaataaaaaaaattagccaagcatggtggcacatgcctaaaagtcctagctactggggaggctgaggtgggaggatcacttgagtgatcattgatgatgccactgcactccagattgggtgacagagcaagaccctatctctttaaaaaaaaaaaaaaaaaaaagatttgagttaatttattattgaatttgtatttagtgcactaaataaattaagtaaataagtataagatcaaactgagatatagattaaactttccatttaagtattttacatgctccatatgagtttttccaagaagcccctagatgtagaaatcctccagtgatatttcacacagttgcacatctgactcctgctaatgtggggtataacaaatgtgtttatgttggacaacttttcctgatgagaccaactgtctaagtctagcttgatccatttaaaagctttgtgacctacctatgactacttatcattcaggtgtttttattatgcagttttatccagctgttcttggtcttaccattcaggtatttttattatgcagtttagttcatcataaataaggaggaatttgagttaaaagctgctgaatgctgaaatgactgccgtttgaagttattgggaccttcatactaggaagtacttaatgggaggctagacaggatttcttctgaccttccctcccttttctataattctagagagaacatcaaagaattatgtaggacttttaagaaccaaggatttgatatgaagaatataaacccatcttacctggattaaacacatgaataaatgttaataaaattaaaactacctgtttatcagtgaagttgtgaattcttctagataatgtattttagaaaatgtttgttcagcagcatttaggaattattcacacctgatatacctggtgggtttgtttttctttaggaaaatggaagttagttgatataggtctctctaaaaatccaagatagatagatgactttacacttataatttggtaaattctttaacttttggtcactatacctataaatctggacggagattttttccagaactaattttgaccttagtctaaagataaaatgttttacattcgtatgtgattatattttccttttaaataataaatgaggcgttactttaatggaaattgttttcttaacattttcttagcattaacaacaataacaacaaaatcttacagttacacaaataaccagaggtaaatgtcttcttaaaggatgtaatttttggatgttgagcgcaaatcatataaaaattatagatttttcaacaattttttttttttgggatggagtatcgctctgttgcccaggctggagtgcagtggcacagtcttggctcacggcaacctccacctcttgggttcaagtgactctcctgcctcagcctcctgagtagctgggactacaggtacatgcctggctaattttttgtatttttagtagagacggggtttcactgtgttagccaggatggtcttgatctcctgacgtcgtgatccacccgcctcagcctcctaaagtgctgggattacaggcgtgagccaccgtgcaccaccgctcccggcctatttttcaacaattttagtgtagcaaatacttaaatagtacaacagtattgcttgggtttttttaaatcctgtttacagcatgtggtagggaggattacaaacatccttttggggtcatatgctgagggagaggaagatacaactttttatctttttctgctgtgattttgtggtgtagaaacctattccagagtacttgccttgtataacttttttcagatgcttttggatatggcggtccaaatgtgccatcttcccacattattacaaattttgtttctggaacaaatggaaacattgtatcattattttgttttgggaaagtggttcaagattgctacataggcatttcaattaaaaatagattaaccatcagttttatagatttttttttgcagcattcaacttccacttcctatgtttaatgtaaattatataatacagggattttgttgttaaaccaggagttaactgattgattcagcagttaatattttgctaacctacctatgaaaagcactgtttggttctgttaaccaggcagttattgatttataatggtaagtcagtcaaactgtctccagcatttgcttgtatagtatatatagagataaacattttaaaaattaatcacacaattttttttttcaattttacttttaagttctgggatacatgtgcagaatgtgcaggtttgttacataggtatatgtgtgccatggtggcttgctgcacatattgactcatcctctaagttccctcttctccctcaacccccaacaggccctggtgtgtgttgttctctcccctgtgtccatgtgttctcattgctcagctcccacttaagagtgagaacatacggtgtttggtattctgttcctgtgtcagtttgctgaggatgatggcttctatgtccctgcaaaagacatgatctcattcctttttatggctgcatagtattccatggtgtttatgtaccacattttcttaatctagtctatcattgatgggcatttgggttggttccaactcttcgctattgtaaacagtgctgcggtaaacatatgtatgtatgtgtctttatagtagaatgatttgtattcttttgggtatatgcctggtaatggtattgctgggtcaaatggtatttctggttctagaaccgtgttggttgaactaatttacattaccatgaacactataaaagcattcctatctgtccgcagcctcaccagcatctgttgtttcttggctttttaataattgccattctgattggcatgagatggtatctcattgtgggtttgatttgcatttctctaatgatcagtgatgttgagcttttttttgatgttttttggccgtgtaaatgtcatcttttgagaagtgtctattcatatcctttgcccactttttgatggggttgtttttctcttgtaaatttgtttaggttccccatagattctgaattttagacctttgtcagatgggtagattgcaaaaattttctcctgttctgtaggttgactgttcactctgatgatagtttcttttgctgtgcagaagctctttaattagatcccatttgtcagttttggcttttgttacaattgcttttggtgttttagacatgaagtctttgcccatgcctatgtcctgaatggtattgcctaggttttcttctagggtttttatggtttggggttttacatttaagtcttcaatccatcttgagtaaatttttgtataacatgtgaggaagggatccggtttcagtttgctgcatatggctagccagttttccaagcaccatttattgaataggagatcctttccccattgcttttgtcgggtttgttgaagatcagatggttgtagaagtacggtgttatttctcaggtctctgttttgttccattggtttatatgtctttttggtaccagtaccatgctgttgggttactgtagccttgtagtatagtttgaagtcaggtagcgtgatgcctccagctttgttctttttgcttaggattgtcttggctatacaggctcttctttggttccatatgaaatttaaagtagtttttttctaattctgtgaagaatgtcaatggtagtttgatgggaatagcattgaatctataattactttgggcagcatgcacaattttttatttagagttgtgataagtgttacaaaagagatgagaacagggttccatgaaatgtttgggttcctgaaaagagcatataaatgtcatatcttgaacttagttaaaagcttaatgtatacttaaattcaagcaatattggatacatttgcatggacaaccctttttctaatttcaattttttttcacttaataatatgagaaacttcccccaatacaaatatttactttttactgtattactcctatttccttcaaatattgaaattttttttaataatatgagaaacttcccccaatacaaatatttactttttactgtattactcctatttccttcaaatattgaagatttttttttaagctcaagacacaagcaaaaaggattactgaggactttctaacttacctttacctttgtaatttttgcaacaccagaaaagcacataggattgaaaagcagactctgcttactaaaaagaatttctgtcagtttcattggaatgggattgctggtatcacagaaacattatgagattcatttacataaattaacttgatgtaagtatagagaagtcatctgtcatttctatgcttttaaataaacggctccccttgctgagactgccagccatcataattgtggcagttgtcatttggtaaaacaaattgtgtgtctgtccaagttactcacttgaatatgaaatgcactcttctaggaatttcttaatacaagaacattatgtgagatctatatgcttagattttttttagaggtttggatttttttaatattatataattaatttttagaacagtatatattaaaacaatatattaaactcttcaacacctatatggcttaaaggtgaggaacatgggctctgtaatacaaactgtcaattaatagcactatcaactgctgtttgaccttggtgtaccctattagtttccttattagtaagacagtaattgtggtgaaggttaaaggagaatataaagtgcttaacatgtgtctggcacatagtaagtggtgagtagatgttagctgctgtcataattgtcatttctgtcaaacattaaaacatgtttataaaactgttttccccctgtggaaaatagaataaattgaatctacagtggttagcttcaggtaatttatagttcacagcagcatcttttccttagacactgtgtaatttgcagtatgttaattggccaccatcatgatgacctgggaattatattctgtaaactctgtcagtggcaaaaaaatttacataatacgtttagagttattttaatccagaagactaaaataatatgttttagagtataaaaagcataagatatatattatccagaatgacttgttatcagagcatttcagctctctgtaaattttattaataaagatttgtgcccaacattactatagctttttgtacttgattggattagttggtttatgccaatcaagaattccattctcatatgggcctttgagtttgatgttttcttggggatcttctaatataaagtctttgcaaacaaacctgtgctacagttgccagggctttaagttgagggcaaaaaaattcttccagtacccacgaaataactgtgatctaattaaataaattatggcacatctagtttggatgtggtcattccaaaagaatgcctttttcctaattgataaaaggtaagtatttgctaagatgatgtgtctgttgcagatgcacttctcgtattgaaatattgtttcaatagtatcaaaattactagaagaaataatgtataatgcattgaattaaagtcctcatttgcacatctttttttggtaactggggcaggagagtaccatgtattaagcatctggttatttttaatagttttgatttgacatctgttttgttcctaacatattaaagagtaaaaataactgtgctttattcatgctagttcagtagaagattgttttttatgactttattttgaaattttgagttgccacattttctttactacataaattaaatgtgaagtgatagacaatttattttagaaagtattttataatgatgaattacatattgcttttgtacagaagcttttctatgggcactggcttaaaaatgacgacttaagtgtttgcatcaatattcatgttttatagagtaggaaagcaaatgggaaagttgcgtgcttccgtggttaatttctttgtgcagcatctgcgtcttctctacttccagcaattatttctatgtatatcttttttttttttttttcttgagacaagagtcttgctctgtcacctgggctggagtacagtggcatgatcttggcttactgcaacctccacctcccgggctcaagccattctcctgcctcacactccctagtagcggggattacaggcgtgtgccaccatgcccagctaatttttgtatttttagtagagacagggtttcaccacgttggccaggctgatcttgaactcctggcctcaagtgatccacccgcctcggcctcccaaagtgctgggaaaccatgcatatcttttgaagaagatttctacatttctaaggacaaatacaattttgttattttggaatttagatggttcacattattgtaggtaccctgttttttttctattagattaaaatatatttttcagtaatctttacatgtcttctgtagtatataacagtactatcaaatagcaatataatgtgtcacatatgcaatttaagattttctaatacccacattaaaaggagcaaaaaaaggtaaaattaatatttttatttacctcagtatattcaaaatattattttaatgtaatcaatataaaaatcattgagatttttttatttcatattaattcttcaaaatccagtttgtattttatacttataacttgttttaatctgtattagccacatttcaagtgttcagtagccacatgtggctaattgctatcctatttattgtgcagtgtaggtctgtaaagtcagaaaaaattctttgtatctggatggatggacagataaaaggagatgtttatcttatatgaatcagatttgatcagcgtaataactagttaccaaaacccaataatgtggtcatctttatagatatcaaaggtgggcttttttactcattggagaagttaattggaggagatacattggaaatattgggtagatggaacttctcctatttagttgcccttaatgtaatataactgtattatgtggttgcattgtttttattgtatatacatgtttatactttcatgaaatttcagtgtatgtctgtaacctttagcataaatgcagttccaactacaacgaagattttgtgctacagctagagaaggaattggtccaagcccgactgagtgaagctgagtctcagtgtgcattaaaagagatgcaggataaagtcttggatatagagaaggtaagaaacctacacaaatgcagtcattcccaaattagaggggatatgtgatatttattaagtacttactgagcaatttaattgacttggtgtttttatacattagaagccttacatattagttactaagaggaaaaggaaaaaaagatttttaaaattgccagttattccttgttgccttcatactaatcacagccccgtatttaaggataaaaatggagattagagcccttttggaggaaaacgaccagaataattttcataaaaagagtatctaaatgttgcagaagagagaaactcaggtgacagaaattaactgttatcatcaaatattgcaatattttcatgtggaagagatagaataggactaatacatagacatttcgggaaaatttcatctgagcgggtggagccaagatagctgaataggaacagctcctgtctacagctcccagtgtgagcgacccagaagacgaatgatttctgcatttccaactgccgtaccaggtgcatctcattgggattgttggacagtgggtgcaggatagtgggtgtagtgcaccgagcctgagccgcgaagcgcaaggggtcaggaaattccctttcctagccaaggaaaggggtgatggacggcacctggaaaatcgggtcactcgcaccctaatactgcgcttttccgatggtctgagcaaacagcacaccaggaggttatgtcctgtgcctggctcggagggtcctacgctcacagagcctcactcattactagcacagcagtctgagatcaaactgcaaggcggcagcgaggctgcagcgggggcgcctgccattgccgaggcttgagtaggtaaacaacgcggccaggaagctccaactgggtggagcccactgcagctcaaggaggcctgcctgcccctgtagactccacctcgggggcagggcatagcgaatcaaaagtcagcagaaacctctgcagacttaaatgtccctgtctgtcagctttgaagagagtagtggttctcccagcacgcagcttgagatctgagaaccgacagactgcctcctcaagtggggccctgacccccgagtagcctaactgggaggcaccccccagtaggggcagactgacacctcacacggccgggtacccctctgagacaaagcttccagaggaacgatcaggcagcaacatttgctgttcaccaaatatctgctgttctgcagcctccgctgctgatacacaggcaaacagggtctggagtggacctccagcaaactccaacagacttgcagctaagggtcctgactggtagaaggaaaactaacaaacagaaaggacatccacaccaaaaccccatctgtacgtcaccaccattgaagaccaaacgtagataaaaccacaaagatggggaaaaaacagagcagaaaaactgaaaattctaaaaagcagagtgcctcttctcctctaaaggaacgcagctcctcaccagcaccggaaaaaagctgaatggagaatgactttgacgagttgagagaagaaggcttcagacgaccaaactactccgagctaaaggaggaagttcgaacccatggcaaagaagttaaagaccttgaaaaaagattggacaaatggttaactagaataaccaatgcagagaagtccttaaaggacctgatggagctgaaaaccacggcacgagaactacgtgacgaatgcacaagcctcagtagccgatttcgatcaagtggaagaaagggtatcagcgatggaatatcaaatgaatgaaatgaagcgagaagagaagtttggagaaaaaagaataaaaagaaacgaaaaaagtctccaagaaatatgggactatgtgaaaagaccaaatctacgtctgattggtgtacctgaaagtgacggggagaatggaaccaagttggaaaactctgcaggatattatccaggagaacttccccaatctagcaaggcaggccaacattcaaattcaggaattacagagaataccacaaagatactcctcaagaagagcaactccaagacacataattgtcagattcaccaaagttgaaatgaagttttagaaatgttaagggcagccagagagaaaggtcgggttacccacaaagggaagcccatcagactaacagctgatctctcagcagaaactacaagccagaagagagtgggggccaatattcaacattcttaaagaaaagaattttcaacccagaatttcatatccagccaaactaagcttcataagtgaaggagaaataaaatcctcctcagtcaagcaaatggtgagagattttgtcaccaccaggcctgccctaaaagagctcctgaaggaagcactaaacatggaaaggaacagctggtaccagccactgcaaaaacatgccaaattgtaaagaccatagaggctaggaagaaactgcttccactaacgagcaaaatatgctcgttatcagctaacatcataatgtcaggatcaaattcacacataacaatattaaccttaaatgtaaaggggctaaatgctccaattaaaagacacagactggcaaattggataaagagtcaagacccatcagtgtgctgtattcaggaaacccatctcacatgcaaagacacacacaggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatgtgcacctaatacaggagcaaccgattcataaagcaagtccttagagagctacaaagagacttagactcccacacaataataatgggagactttaacaccccactgtcaacattagacagatcagtgagacagaaagttaacaaggttatccaggaattgaactcagctctgcacgaagtggacctaatagacatctacagaactctccaccccaaatcaacagaatatacattctttcagcagcacacaacacctactccaaaattgaccacgtagttggaagtaaagcactcctcagcgaatgtaaaagaacagaaattataacaaactgtgtctcaaaccacagtgcaatcaaactagaactcaggattaagaaactcactcaaaaccgatcaactgcatggaaactgaacaacctgctcctgaatgactactgggtacataacaaaatgaaggcagaaataaagatgtcctttgaaaccaatgaggacaaagacacagcataccagaatctctgggacacattcaaagcagtgtgtagagggaaatttatggcactaaatgcccacaagagaaagcaggaaagatctaaaattgacaccctaacatcacaattaaaagaactagagaagcaagagcaaacacattcaaaaactagcagaaggcaagaaataactaagatcggagcagaactgaaggaaatagagacataaaaagcccttcaaaaaatcaatgaatccaggagctggttttttgaaaagatcaacaaaatagaccgctagcaagactaataaagaagaaaagagagaataatcaaatagacgcaataaaaaatgataaaggggatatcaccaactatcccacagaaatacaaactaccatcagagcatactataaacatctctatgcaaattagaaaatctggaagtaatggataaattcctcgacacatacaccttcccaagactaaaccaggaagaagttgaatctctgaatagaccaataacaggctctgaaattgaggcaataattaatagcttaccaaccaaaaaaagtccaggaccagatggattcacagccaaattctaccagaggtacaaggaggagctggtaccatacctactgaaactattccaatcaatagaaaaagagggaatcctccctaactcattttatgaggccagcatcatcctgataccaaaggttggcagagacacaatgaaaaaaagagaattttagaccaatatccctgatgaacatcaatgtgaaaatcctcaataaaatactggcaaaccgaatccagcagcacatcaaaaagcttatccaccatgatcaagtgggcttcatccctgggatgcaaggctggttcaacatagcaaatcaataaatgtaatccagcatataaacagaaccaatgacagaaaccacataattatctcaatagatgcagaaaaggcctttgacaaaattcagcagcccttcatgccaaaaactctcaataaattaggtatcaatgggacgtatctcaaaatcataagagctgtttatgacaaacccacagccaatatcatactgaatgggcaaaaactggaagcattccctttgaaaacgggcacaagacagggatgccctctctcaccactgctattcaacatagtgttggaagttctggccagggcaatcaggcaggagaaggaaataaagggtattccattaggaaaagaggaagtcaaattgtccctgtttgcagatgacatgatggtatatctagaaaatcccatcatctcagcccagaatctccttaagctgataagcaacttcagcaaagtctcaggatacaaaatcagtgtgcaaaaaccacaagcattcttatacaccaataacagacaaacagagagccaaatcatgagtgaattcccattcacaattgcttcaaagagaataaaatacctgggaatccaacttacaagggatgtgaaggacctcttcaaggagaactacaaaccactgctcaatgaaataaaagaggatacaaagagatggaataacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagaccaatggaacagccctcagaaataatcccacatatctacaactatctgatctttgacaaacctgagaaaaacaagcaatggggaaaggattccctatttaataaatggtgctgggaaaactggctagccatatatagaaagctgaaactggatcccttccttacaccttatacaaaaattaattcaagatggattaaagatttaaatgttagacctaaaaccataaaaaccctagaagaaaacctaggcagtatcatttaggacataggcgtgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctacttatctgacgaagggctaatatccagaatctacaatgaactcaaacaaatttacaagaaaaaaacaaacaaccccatcaacaagtgggtgaaggatatgaacagacacttctcaaaagaagacacttatgcagccaaaagacacatgaaaaaatgctcatcatcactggccatcagagaaatgcaaatcaaaaccacaatgagataccatctcataccagttagaatggtgatcattaaaaagtcaggaaacaacaggtcctggagaggatgtggagaaataggaacacttttacgctgttggtgggactgtaaactagttcaaccattgtggaagtcagtgtggcgattcctcagggatctagaactagaaataccatttgacccagccatcccattactgggtatatacccaaaggattataaatcatgctgctataaggacacatgcacacgtatgtttcttgtggcactattcacaatagcaaagacttggaaccaatccaaatgtccaacaatgatagactggattaagaaaatgtggcacatatacaccatggaatactatgcagccattaaaaaggatgagttccatatcctttgtagggacgtggatgaagctggaaaccatcattctcagcaaactatcacaaggacaaaataccaaacaccacatgttctcactcataggtgggaattgaacaatgggaacacatggacacaggaaggggaacatcgcaccctggggcctgttttggggtggggggagggtggagggatagcattaggagatatacctaatgttaaatgacgagttaatgggtgcagcacaccaacatggcacatgtatgtatatttaacaaacctgcacattgtgcacatgtaccctaaaacttaaagtataataaaagaaaaaaagaaaaaaaaagaaaatttcatctgagtgtagttgttagaactgtccaatctagaacaagttacctcaggatatgtaggaagttccttttagcctgaatgtacttacagaagctaacttcttttcaaggatattaaagaacatcaaagatgagataagtaatgggagtagaagaacttcaggtttcttatagctttcagatttaaaagttctagattacaaactccaaatctcttgtttccttatctgtaaatttattggtggcctgggctctgtgtcgtttgttcctttttactcttaggtaatagctacctactgaatccaaaaacctgatagataatggacataacagtctcaggtgtttttaactattttcttaatgaaacagaacaagtgtaactagaatcagtaatggaataattttgctagaaagctccttcctatttttatatttctggataatgtattatctcgatttgttgagaaaaaaagccagcaagaatgctgaaagaaatggctaacagaatatttggtctttaacttaggcgtattctgggttacatgatttagagcagaatctgtgtcttacaattagaaagattttgaatatttgatagaagtgtatttgggttccattcaaaaatggatttcgtaagtggctgtgttgtttttcatgttataaagtagaaaggaatttgaaaggtagcatgcttcctatggtaatttcttcctgcagcatcctctttttttctgcttccagcagtcttttaaatgaatatgcagtaaatttttggttttcaattgagaagatatttaaagtccattataagaaagtgtaattggtgagaataacttcattccatcatccctatgagcaaaaatttgcatgtgtaccgtgaaatatttagagatagaaaattgcatagaatcaggccttgaaatctcagtgttacctcagtttacctttttatctagggagctttccctacggcctcattttggatctcttggtaactctccagagaagtttgatactgggctaccctgtatcctttttatcttttaatatggtgggaaattgatctaagtcttgtatccgtgtgctgggataattggctagccacatgtaggagaatgaaactggatcctcttctctcacgttatacaaaaatcaacttaagagatggattaaggacttaaacctaagacctgaaactataaaaattctagaagataacattggaaaaacccttctagacgtttgcttaggcaaggatttcatgaccaagaacccaaaatcaaatgcaattagaacaaagataaatagctgggacctaattaaactgaggagcttttgcacggagaaaggaacagtcagcagagtgaacagacaacccacagagtgggagaaaatcttcacaatctatacatgtgacaaaggactaatatccagaatctacaacgaactcaaatcagtaagacgaaaacaatctcatcaaaaagtgggctaaggacatgaatagacaattctcaaaagaagatatacaaatggccaacaaacatgaaaatgtactaaacatcggctgggtgcggtggctcacgcctgtaatcccagccctttgggaggccgaggttggtggatcacaaggtcaggagttcaagagcagcctggccaagataatgaaaccttgtctctactaaaaatacaaaaaattagccaggcatggtggccggcgcctgtaatcccagctactcgggaggctgaggcagagaattgcttgaacccgggaggcagaagttgcagtgagccgagattgtgccattgcgctccagcctgggcgacagagcaagactccgtttcaaaaaaaaaaagaaaaaatactaaacatcactaatgatcagggaaatgcaaatcaaaaccacaatgtaataccatcttacttccacaagattagccataatcaaaaaatcaaaaaacagtagatgttggcgtggatgcaatgaacagggaacacttctgcactgctagtgggaatgtaaactagtactgccactatggaaaacagtgtggagattccttaaagaactaaaagtagaagtaccatttgatccagcaatcccactactgggtatctgtctacccagagggaagaaaaggtcattatttgaaaaagatacttgcacacgcatgtttatagcagcacaattcacaattgcaaaatcgtggaaccaactcaaatgcccatcaatcaacaagtggataaagaaactgtggtgtatatatgtatatatatgatggaatactacttagccataaaaaggaacgaattaacagcatttgcagtgtcctggatgagattggagactattattctaagtgaagtaactcaggaatggaaaaccaagcatcgtatgttctcactgatatgtgggagctaagctatgaggatgcaaaggcataagaataattcagtggactttgaggacttgtggggaagagtgggaggggagtgagggatagaagactacaaataaggtgcagtgtatactgcttgggtgatgggtacaccaaaatctcacaaatcaccactaaagaacttactcatgtaaccaaataccacctgtaccccaataacttacggaaaaatataaataaaccttgtatccatgaatcaagttaatttcagtcatttcatttgaatcaattggtaaattgtttaatttgtattaatttcttgactgttgatgtaaatagtgactaatacacagagatttgatgcctctcaaaaataacatgctgaggaaatacaacaaaaacagattttggactactattttctatgaatatttaaaaagtaaatgatgttcatgctttatctggagtcctgatcagaagttagtaagtttattgccatattgaaaaaaattttaatcctgttgctccgtaactctgattagtattttattaacaaatcagagttagatttctgtgttctcaaaattaagtgcagttcccctcatacattgctagtgaaaatgaaaagcagtacagctgctttggaaaagtttggcagtttcttaaaagttaaacatagaacaattaccatctgagccagcagttctactcctaagtatatcttaagaacatggaaagcctaagtctacacaaaaacttttgcaccaatgttcatagcaacattataatagtcaaaaagtggaaacaacccaaatttctattaactgatgaataaatagattaaatgtggtatatctatacagtggaatatcatttggcataaaaaaaagattgaaccttgaaaacattgttctaagtgaagtaaggttgtcacagaaagctataaatacatatgattccacttataagaaatgtccaggtagacaaactcatggaaacaaaaagtagattggtggttgccaggggatggggaagtggggaatgtagaatgactggtgatgagtataggttttcttttttgcatgataaaaatattctgaaattaggtcatggtgatgtttaaacaaccctgtaaatactctaaaaaccactggctcttgtgtattttaaaagggtgagtttcatagtttgtgaattatatttcagtatagctgtataaaattaaatacatttaagtgtggaacacaatagctgttgtgtgtgctgtattttattccttaaatttaaaaatcccaaattaaattttcttcttctttagaggaataactcccttcctgatgagaataatattgcaaggcttcaggaagaactcattgctgtgaaacttagagaagcagaagccattatgggtttgaaagaacttagacagcaagtcaaggatttagaggaacactggcaggtatattaatatattttgtgtgcttttttaaaagagagtaaaaccgaaatatccaatttgtaagagtttgaagtacctgatgacctatagtagatgagtttaaagtgagagagaccctgtttaatgtcaaaattgagagtatttataaactgaaagtgcacttaagctgtttctccctctttaattcttataataaaataaaagatacagtagacatcagataatatttttgtcattgtaccattgtgccttgtgtaactttttctgcaaactgtgaaagtgttctatataatacatattttgtcttaaactttgatattaagtccattgttggttagtgtgaaacaccagaagggtgacaacattataaatttaatgtataaattagtaacttagttacctcaccagataaatgacatttatctggtatgtgaccacaaatttattcatgtatgagggaaatgttgacaaggaacaaaatacatattctatataaggaccgaaattaggccttgacattgtcatgcctttttttaaaacatgttttgacaaagtatcagattgcaataaacttgaaattttaaaacaaaaaagacaaaacttgtcttttatcacagatattttgagaaacactgcccttaacttctaacattccttccttaatggccccattttttttctaatgtattgggatttcattgaagataatatgaaaaatctctcattaaaaaaattacagtgaaaattgtaatcttttcaagaattaatcctcagtatatagagaaaaaatttgaactgtatttgagtttatatcccagatctgcactggctgtgtgtgatcctcctaaagttacttaatcacagtgttcattttcttacctgtgaaaagccaaaaatgtttccacacacattgccaaatgtcccctggcggggcaaaattgccccagttgggaaccaataatggcaataatgtgaatgatgcttcctaaagttgtttaatatggtgaccctaggcagtgaattctaaaattgcctgtctttcttctcaggtctctcttttctccaataaattcttttttttttttttttttttttttttttttgaagtagagactagagacagggtttcaacatgttggccaggctgatctcaaactcctgacctcaggtgatctgcccgccttggcctcccaaagtgctgggattacaggtgtgagagccactgcgcctggccaataaattctatcttaaatatacttaagatctgcaaaggtctttttatgaaacccttttattcagatgataatagtgcctgattaataggattttctagggattaaataaaataatgtgtggaaagtgttttatatatcacaggcctgaaataagcgctcagtaatattagctcttattttgatactgagagtatttgttgcaatataattttttatgctttagcgccacttagctcgtactactgggagatggaaagacccacccaagaaaaatgctatgaatgagttacaggatgaactgatgaccattcgacttagagaagctgaaacacaagcagaaataagagaaataaaacaaaggatgatggaaatggaaacacaggtatgatgggaaagcccagtatctttaaaaagtatcattagctgatcaagggtttgtgcacagattgtatcatccctagaacagagataaaaggtaaagatatgaagctgtatagaccgcagttttctagcccaaatgaagatggcaaaaaattattatattggatttcagagatttaatccttctttgacccattcaacaaagttcaaggaagtcaaattttatttgacttttttgggtaaaactcatagcattgccctgttgcatgacttgagaaggaacaccatgcagagcaaaatttctcaacctcaacacttttaacatttttggctagaagatactttgttttacggagctggtccatgcgttgtagatgtttagcagcatccctggcctctacccactagatgccagtaacggctctcctacctcaggttgcgatgaccaaaaatgtttctgcacacattgccaaatgtcccctgggggacaaaattgccccaattgggaaccacagatgtatactataatgtgaatgatgcttcctaaagttgtttaatgtggtgaccctgggcagtgaattcaaaattgcccttctttcttctcaggtctctcttttctccaataaattctatcttaaatatacttaagatctgcaaaggtctttttatgaaacccatttgcatggtaaaggcacatttggttttcatgtggtacatttgtttggaccatattcttatactctgtgaatgttgttttttggcttttaaagtatttattcagtcagtagggggcatacttaactcatacatcattctgtattccagtgcaaaatgatcataatctcaaacatggtaacatgaatatgtaatttcttcagaataaatatatcttgttttacattgttcaaagttattttcttatatttttcttgtattattctatataaaatactttccacacgttattttattcagtataattaaaataggaagaggtactattgagattatgaatagtagaaatcttaagttttacaatgggaagttttatttttgtaatcagattttattttagtatagatactaaagatgaaatacacagcttttaagccattgttgaggatttatttcacagtgggtagaggtgaataaatcaaatccagtagacatgattttgagaacttgtgaaacacaaagcactgtctcagccattaaaggacttacacttgagaaatcaggtatgcatagactatatttaatataattcagaaatttggtaagtagagagttagataggaattgctacggagactaggcggggaaaattaatttcaactaggtggtttggagaaagatttcctaaggaatttgtattgtgcttaataccattgctgactaataagtgtgattttggatggattttgctggaagcaggatggtaataggcactggttcctaaatgccagtatttggactggtggtaatccatgaaatttttacattgataaatgaaaaataaataaataaaaatagtatagggtaatggtggtggtgtgtagtaatctaaagattattgtatcaaacacccatgtatttagattaagaaatttgtccatgtttatacatgtaactccagttctgtcattttaaggacttttagaaaagtctgtcagtgactatacctcaatttattgatccactctcctttttgctcttgcaaacagtgctactctgaacattcttgcttatgtttccttgtgtatatcttcaagagtttcttaagtacaaaggttcttaccgtttttgtgtttgtgtctgctatcaacactgttggcagtctggaacctgtggaccccttcttaaaataatattttttaatgcgtaaaaccaagtacaaaggattgcaaaggaagccacttctactgaggtacagttatcaaaatactaaaaacatgtttgtgctgtagatcacatagagatacaacacattcccattgctagattcaggtttttaatattttagatttagatttctttttttttttaatttttattttttagacggagccttgctttgtcgcccaggctggagtgcagtggccagatctcagctcagtgcaacctctgcctcccgggttcaagctattctcctcctcagcctcccaagtagctgggattacaggcgcccactaccacgcctggctaatttttgtatttttggtagagacggggtttcaccatgttggccaggctagtcttgaactcctgaccttgtgatccacccaccttggcctcccaaagtgctgggattacaggcgtgagccaccgtgccctgccttgatttagatttcttaagataaattgtactacattttttcccatcttaatttcagtttatgtgtttatatctctgataaacaacatatagatgggtactttttaaaatgcagtctgataaatgattgttcaactctcaataggctaaaaaccactgaatatatgtacacttgagggaggtcaattttataatgtgtgaaaagtatctcaataaagctataaaaactggctgggtgcagtagctcacgcatgtaatcccaacattttgggaggccaaggcagttggatcccataagacaagaagtagacaggagtggtagtgggcgcgggtaatccccatctctactaaaaatacaaaaaaattatccaggtgtggtggcacatgcctgtagtcccagatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacatctttcaagagtttttttagtggttgttccaggttttacaataaatagagtttaccttcaaataataaattataaataataataaatgaataaataactatacacttcatgtgtaatctaaggctcttacaacagtgtgttttcaaatctttctacctcttttgtgaaattgtcatacattttacatattgtccaaatatatatgctactaattttgcattaaagttttctttcatagaaattgaaaaacttttaatgaaatgtgtttttccttcaagatattctgtttcagcactctttctttgtgcagatccatgtttctgtctggtatcttatcttttctgctttaagaagttcttttatcatttcctttagtgctggtttttgtttgataaaatgtttatttcttcaattttaaaagatatatttgcaggatattgaattctgccttgacagtttttttcttttaacactttaaatcactctgctatcttcttgtcagaaaccatgccagccaggattctgttgtaattcttatttttgttcctcaacatgtaatgtattttttcctctggttgccttcaagcttttctctttgtttgtagcaggtcgaatatgatatacccagatctgggtttttttttctctcttttttttttttctctgagtttctttgatttatagatttgtgtatgccacaaattttggaaacttcttggttgttatttctttcttttttttttttttttgagatggagtttcactcttgttgcccaggctggagtgcaatggtgtgatctcagctcaccacaacctcagccacctgggttcaagccatgatcccctgcctcagcctcctaagtaactgggattacaggcatgtgccaccacacctggctaattttgtattcttagtagagacggggtttctccatgttggtcaggctgttctcaaacttccgacttcaggtgatccgcccgtctcggcctcccaaagttctaggattataggcgtgagccagcacgcccggcccttggttgttatttcttcaagtatttcttctcatgctcccttcttgaggggtttcaattatacatgtgttagattgttcaaggttgtctaacaactcttggttgctctgttctttttgcccctatcatttttctctgtgttttcagtttccattgactaaaacatttttaccgacaaattattaagttcactcattctttccattgctttgtcaagttgtttgatgagccaactgaaggtattctttacgtctgttactgtttttcatttctagcttttctttaacaaaaaaaaaattttttttttttcaaagagaaaaggtctcactgtgttgcccaggtctcgaactcctgagcccaagtgatcctcccatctcagcctccccaaagtgctaggattacagtcacgagccactgtgcccagctcatctctagcttttctttttgactcatagttttcatttttctgctattacctatctaattttatgtttttcacctttcccttagagcctttagcatattaatcacagttattttaaattctctgtcagatgttgtattagtcagggttctctagaggggcagaactaataggatatatatatatatatatatgggagtttatttcaagtattaacttacatgatcacaaggtcccacaataggctgcctacaagctgaggagcaagaagtgccagtcaaagtcccaaaacggaagagcttgaagtccagtgttcaaggacaggaagcatccaggatgggggaaagatataggctgggccagtctctccttttcacatttttctgcctgctttatattcactggcagctgattagattgtgcccatcagctaagggtggatctgcctaccccagcccactgactcaaatgttaatctcttttggcaacaccctcacagacacatccgggatcagtactttgtattgatcttggatactaactcagtattaaccatcacaagtccaccccttgtcagcttgaacttgaacctatgcacatctcctgagatcatacataatcttcaaataaagacaataatgaggtaataattatgcctaacataatacaactatcctttgtacacctggaaacacaccaatccctgactcaaatactattacataaagttaacagtacttaaatgctgatatgaagtcaataaatcttatgtcacatgataaaatatattttcttagtacaaatgtatacatacacaaacatgattttaacaaaagaaggaggaaatactcatgacaattacagtccttgtttctgcagctggtcacgtagtggtatctggtattaatgactaaccttccgttacccattctgtattccctttgccttcagcaagcacctcagcaggtcatgttttttttcctggtggagtgacccaaaccttcattcctgaggggtctgggccatctgtagtcctgcctggattgggatgttgtagtttcccattgaccttaatcacagggcatggtaatactaagatgccctgatggatctcctgtattccatgcatactcttctttacctccgttgtggattagcagactgatttcatcttgatagtccgggtcagtcatcccagccaacactgtaattcccttcttagcttgttgacttaaaggtaggaacagcccgaagtgtccaggtggcaatcttaacttgcagtttaatggagtcgttgttgtgtcttctggtggtagcgttcctccctctggaactaagacctctaggccagcagaattaatgttgagggaataggaagcaaaaattttgctagtgggtcactaggggtgatggtgagtggtgccacttgcacttccaccccttgattcctggacccgtgaatcgtggctatgggagaaacagtaccatatgttggatgctgattcagagcatacatggccttctggagaactttgccccagccctgcaaagtattgtcacctagttgacattgtaattgtgacttcaaaagcccattccaccattctatccatccagctgctttaggatgatggggaacatggtaagaccagtgaattccatgaacgtgagcctactgcaacacttctttggccataaagtgagtgccttagtcagaggcaatgctgtgtggaataccatgatggtgtttaaggtattccgtgagtgcacagatggtggtcttggcagaagcattacatgcaggataggtaaacccatatccagagtaagtgtctattccagtgaggacaaacctctgccctttccatgatggaaaaggtccaatataatcaacctgccaccaggtagctagctgatcaccgtgaggaatggtgccatatcaagggctcagtgttggtctctgctgctgggaaattgggcacttagcagtggctgtagccaggtcagccttggtgagtggaaatccatgttgctgagaccatgtgtaacttccatccctgccaccatggccactttgttcatgggcttattgggcgacgatgggtggcttggaaaagaggctgagtggtgtcctcagaacaggtcatcttatccactcaataattaaactcctcctctgctgaggtcacccgttggtgagcactcacatgggatacaaatgtcttcacagattttggccactcagagaggtccatccacatacctcttctccaaatttctttgtcaccaattttctaatcatgcttctttgaagtccctgaccatccagccaaaccattggctacagcccatgaatcattatataatcacacatctggccatttctacttccatgcagagtgcacaaccaagtgctctgctcgaagttctgcccactgggaagatttaccttcaccgctgtccttcagggatgtcctagaaaggggctgtagtgctgtggctgtccactttcaggtggtgcctgcatatcgtgcagaaccatctgtgaaccaggccctggtcttctcttcctctgtcagctgatcatagggaactccccatgaggccatcagtgcgggctggagaagagaagacagggtggcaggagtggagaccatgggcatttgagctacttcctcatgaaacttacttgtcccttcaggacctgctcaagcctgatcacgtacataccacttccatttgatgatggagtgctgctgtgcacagcccacttcatggctagatgggtcagaaagcacccagttcatgataggcagttcaggtcgcgtggtgacttgatgacccatagtcacttcatgactatgatgaacaatggttcagtttccaccaaagtccagtaacaggccaacagctgtctctcaaaaggagagtagttatctgaagaagatggcagggtctcgctccaaaatcctagaggtctctgctgtgattcacctatgggggccatgaatctctgtttttataattcaaattagtattttgctcatttgacctagaagttttctgcttgtataaattaagtaggaatgagcagacttcctatcaatttcacttctaggaacaccgtgattaattagccaatgccagagctctacacaagtcagactattctgattgccgctttgccgctgctgttcatgacagtagctatgcctaccttgcgtttgatggttgagtgctgccacttggccccggcacctcagtattcaattattcccattgtatttaaattttgtagttgagtaactgcggttcccaccattagatctgacatactaagaagagcaattacaggcctcttcaaagatgcaggtgctgccctcacaaatctatttcaaaaggcattggtcaagagtacgtcttctggaccctcccagctgagatgagtaggtctaaagtgactaatccactccaccatcccagtctccctaagcctttggattccatcctctacattaaaccaagggagatcaggcgtttccagctctctcacagtgggccatcttctagtccgtctttcaactaaccaagcaaataaactattagaaccttttttaactccccaagttgcaacattgaatgcagaatccctacttagtgggcccaaatcaataaattcagcctgatccaactctgttccttccaccattatcccatacccttaatatccattcccatggtttgttttccagatttctgtttatataaattagagaacttggtttttttcaagtgtagcacacctcctcatgggtcacactcaacctcaccctctagggtcccactgagactttaacttagttataggtctagaagcaaacaggtgttgggggtggctcctgaggagaatcaacattatcttccctggcaactgcctcaggggagggcatcaatgttgcctcaagcagcgcagggttcatctcctcagacaaaggcagaaaggctgatggcagcatgggttggggaggggttgtttccactactggggatggggaagttgttccttctgacaaaaaaggttcatcagagtttacaaacctctatgtccccagcttcatcagggtcctcccacatgtccccattccaagttttagggtcccattcttttccaatcaatgccctcactttaacagtagacacctggcaaggctgtgcatgcatctttcgttgcaggtcagccactcgcatgaagagcttgtgactgtctactctcattcagggcaatcttagcagatttgaggcgtagtatctgcttctgaagcagggggacagaatcccctgaattcatcattttctttcatcaatttgtccagtgaacttaggagcaaccaaccaacttcattacattccttggttctccacatatagtcaaaggtattatgtatagagtcactaaactgcttgcctctcacaaatagtaaatcaggagtgtcaaatgcatttattttgcgtaactctctacaaacagttcatgccaagaactatcagtgtgctccatactgttagaagtagagtccttagcatttttgggtcttaccgtattaagcagccaactccagaaacccccaaaccaatttaagaactccatccttaatattctgttcctctagaaccactcctggtaccaaaatctatattagtcagggttctctagagggacagaactaataggatatatataggaataataggatatatatatatatcctatatatatatacataaaatataacataaaatacatgtatattatatataatacacatacatatatataactcatatatatatatatgagtttattaagtattaacttacacgatcgcaagatcccacaataggccgtctgcaagatgaggagcaaggagagccaatccgagtcccaaaactgaagagcctggagtctgatgtttgagggcaggaagcatccagcacgggacaaagatgtaggctgggaggctaggccagtatctccttttcacatttttctgcctgctttatattcgctggcagctgattagattgtgtccaccagattaagggtggatctgcctttcccatcccactgactcaaatgttaatctcttttggcaacaccctcacagacacacacaggatcaatactttatatccttcaatccaatcaagttgacacttagtattaaccatcacagatatttttaacatctgtgccatatgtaatgctggttctgttgattgctttgtcttttgggagtgctttgtttttccttgccttttcctatgctttgtaatttttttgttgaaagctggatatcttgtgtaggactgcagactgagtcaaatagtttttctgcctggaaatgggcacatttttccttctgctaggcctttaaagtgggagattcaagttaatatagtccagagatgggttgagtttgaggtttgttgtttctgtggtatcatcagtgcaccataggcttcaaattcccttagcaatactttatttttcccttagtaataccttatttttagagtaggagctgtttgccagaggaattttgtgtctttaggttttccctttgcataacattttaaaagggtctgtcttcagcagtattccatttgttacttattacagaagagttggaggggcaacagtgttttctattgttctgatgaagcctcagtcttagacaggcacagtggctaatgcctataatccccaacactttgggaggcccaggcaggaggatcacttgaggccaggagtttgagactagcctgggcaacatagtgagaccctgtcttgtataaaaatttttaaaaattagccaggtgtggtagtatgtgcctgtagtcccagctacttgagaggccgaggtgggaggatcgcttgagcccaggagtttgaggctgtagtgaactatgacacctctgcactccagcctaagccacaaagtaagatcctgtttctaaattaaaaaaaaataaatggctgggcgtggtggctcacgcctgtaatcccagcactttgggaggctgaggcaggtggatgacctgaggtcaggagtttaagaccagcatggtgaaaccccatctctactaaaaatacaaaaattagccagacgtggtgctgtatgcctgtaatcacagctacttgggaggctgagggaggagaatcacttgaacctgggaggcagaggttgcagtgagccaaggtcgcaccattgcactccagcctgggcaacaagagtgaaactctgtctcaaagaaaaaaataaattaaataaataaataaataaattcagtcttaggcttcattatgtcctttgatctggtgtgtttggtctttagtgctcctgcccaccccagatgtagtactaggcacaaaacgcagttctgccccttccccaagatgcaatggctttcaccagtgccccaaagacagcagcgtttcttggccctgatccacacagatgaaagcatatattccctagaggagacaggcaaggtttagcgccttcctatagtgactgctattccccttcttgagtcctgtaccatgaaggtttctttctcaagactcaccagtcttttgtgtgtgtacccgttggggtacctgaagaaaagtgtgcaagagtttgtgaacttagactctaagtctgctgcctcctgcgccttcacactgtctagccagccaatacttagcttccaccagtctgatatttattctagctgtatcattcttagcttgtggccgtatctgcctcaggtgagaaagtgcttaaatcccattgcatctctcctggaaggctccgggtttgaacttagtttggctggctttttttttttttttcctttttttttttttttgagatggagtcttattctgtcacccaggctggagtgcagtggcgcgatctcagctcactgcaacctccgcctccggggttgaagcgattcttctgcctcagcctcctgagtagctgggactacaggcgcatgctaccacatctggctaatttttgtatttttagtggagacaggggtttcaccatattggccaggctagtgtcgaactcctgacctcaagtgatcctcccgcctcggcctcccaaagtactgggattacaggcatgagccactgtgcctggccttccttcttttttcattggaagggtaggagcagttctttgaccttctacatcccagatcacaaatcaaaagtcctgattatgatgtatttgtgattgttttgtttggtacttttggtttctttcttttttgttccttttttcttcctttcctcctctttattggatttagttttttctttcactttctctgtactggtttgactcttataattccttttgttttctattaatgtttgctacctgaaaaaaattgaaaatgcttacctgggtgaacaaagtctaaacttagtcatcatctctgtatcctttccaaacatttagaagggcctgtgaataacttcatgtgttcttctgtcttacaagttattattgtacatcttttaatacctccaaactactagatattattattttatggagtcagagcttatctggatttgttcacctgttagtcagttatttttgctctgaattcttttttttctatttaatttttttttcttttttaaatagggtctcactgttttgtccaggcttgagtgcggtggctgttcataggctccatcgtatctcactacagcctcaagctcctgacctcaaacagttctcctgccccagcctcccaagtagctgggactacaggctcttctctcttcttatatttgacagtttctggtttccatcctgcattctaaatctgtcactctttttttttttttttttttgtgacggagtctcactctgtcacccaggctggagtgcagtggcgcaatcttggctcactgcaagtcctgcctcccaggttcacgccattctcctgcctcagcctcccgagttgggagtacaggcgcccgccatcacgcctggctaattttttttttttttttttagtagagacagggtttcattgtgttagccaggatggttgcaatctcctgaccttgtgatccgcctgccttggcctcccaaagtgctgggattacaggtgtgagccaccacgcccggcccactttcttaaaataaatttacttttctttcttgtatgatagtttagctcagtatactactatagggtgaagattcttttttaagcattatgaatttttgccattgaaatatctgctagacatttcattacccttcctttatagatctcagtttttcccttgatttgcctctttagcattctaagttttgttacagtatatattggtggggatttatttgtttttatcctggttggaactagttgtgtttcctaaattgtagatttatatcttttatttcttttttttttgggggatttatttttttatttttattttttattatactttaagttttagggtacatgtgcacattgtgcaggttagttacatatgtatacatgtgccatgctggtgcgctgcacccactaactcgtcatctagcattaggtatatctcccaatgctatccctcccccctcccccaaccccacaacagtccccagagtgtgatattccccttcctatgtccatgtgatctcattgttcaattcccacctgtgggtgagaatatgtggtgtttggtttaattgtaaaaaattctcaactgttaccatctcttaaaccatcatatctcacttttttttttctattttatcctgcaacccatattaggtatattttggaccttattctcttttctgtgtctaataacctcttctgggacactaattatttcttcagtatagctaatctccaatctaacccattcattgaattcagtggctgtatttatagaaattttctttggttatttttctgatttgcttaattttttttgatagtgacttgttctttgcttatgttttggcattttccttttatgtcattaatactgtaattttagacataacctatgttaggtaaagtcctataattatctctagagttcttaaaatatattttttctgtctgctgtctctcactcatggtcaattcttgggttttatgtgtattatttatcaaccataatgttgaattatggtcttgtgttcagggatgcagggaagggttttatctatggacattatttgcagcttatgtcaaagatgggtccctctgaagtgtagttatttgttttaatggtagcaggtaagacagtaaaaagaggctgtgatacattttgaatacggcactaagaagtttagttaattttgtagacagacttatttgttgattcaaaatgagaaagaggccaggtgcagtgactcatgcctgtgatcgcaggattttgggagaccaagatgggaggatcacttgggctcaggagttcaagactggcctgagcaacatagtaggacctcgtctctactaaaaataaaaaaaattatctgggcgtagtggcacatgcctgtggtcccagctattcaggagaccgaggtgggaggatagcttgagcctgggagattgaggctacaagtaagctatgattgtgcctctgcactctagcctgggcaacagagcaagctcctgtgagaccctatctaaaaaaaaaaaaacaaaaaagagagagagaatgagaacgactagagtatgtgttacaggaagacaagtaaaagtaaagatgaagaaagttctaagtggttgaaagttttggagcttacatctattagatgatctacattttttcattaaaactggaggggggtctttttcatagggcgaggtaaagtaggtataataatggcaacaactgaacatttattaagtatctaaaatttcccgggtgcagtggctcatgcctgtaatctcccagcactttgggaggctgaggcgggcggattacttgaggttaggagttcgagaccagcctggccaacatgatgaaaccctgtctctactaaaaatacaaaaattagctgggcatggtggtgggtgcctgtaatcccagctacttgggaggctgaggcaggagaatcacttgaacccaggaggtggaggttgcagtgagccaaggtcgtgccactgcactccagcctgagcaacaaagtgagactgtctcaaaaaaaaaatgaaatgaaattacatgacatgacatgattgtgtgagactgctttcataaacttttcgcccataatctaatcttcacaacatagtctcaaaaggcaagtagtactatctctactgaaatttggtaggattaaannnnnnnnnnnnnnnnnnnnatttttacttctttctgttatgaaagtccctactatttctttcaggcctctgatagaataatttcgggttgagagaattctggctgggtcatacctgagtgtgaaaactacctcatgttagttcaaggtctatatgtttttttagcacattctgtaattataatacaataaacagctagcatttattgctacatatttaggccctgttatgcatattatctcatttaattctgaagacaccaaactgagaaatagaaactattttatatgcatttttcaaataaggaaatagagactcagagatactagcttgtttgcttaatgaccaaatattaaaaccaggattcaaaatctgtgtgcttcataaaaagagactgtgctagacattgagagcatgtagaaatacacatatgccgtattgtgtgacatcaagtttacagcccaataaatagtgatggtacctttttttttttcctttcctttttttttctctgagacagagtcttcttgtcacccaggctagagtgcagttgcgtgatctcagctcactgcaacctctgcctcctgggttcaagtgattcttgtgcctcagcctcccaagtacctgggattatagacgtgcaccaccatgcctgactaatttttgtatttttagtagatacggggtttcaccattttggccaagttggtcccaaactcctggccacaagtgatctgcccaccttggtctcccagaatgctgggattagacatgagccactgcactggccatgatggtaccttttgactggtttgtgctttctttctggaactggaaagaggaattaaactcaccattcctgtatctatccattttgtactcccattgccaatcttagaaaggaataccttcaagttgtgtataagaatttttatagtttacacctattttttgtataaatggtatattgagctatattgagagtctctaatattgacagtatgcattcctttggatgacttgattttatttatttatttatttatttttaattttttttttttgagacggagtctcgctctgtcgcccaggctggagtgcagtggctcagtctccgctcactgcaggctccacctcctgggttcacgccattctccagcttcagcctcccgagtacctgggactacaggcgcccgccaccatgcctggctaattttttttttttgtaattttagtagagacggggtttcaccgcgttagccgggatggtcttgatctcctgacctcgtgatccgcccgcctcagccttgaatgacttgattttaaaggcagttttatcttattttttaatgttgattttgttgaataacagtgacctataactagtaacatttttaataatgttatggtataaaatggataggtaattttttttaatttttaggtcttgtatctatagtctcagtatttatatttctgattattagaaccagatcaatagtaaccatcttcgaagagcagaacaagaggtgattagcctacaggagaaagtgcagtatctttctgcacagaacaaaggactccttactcaattaagtgaagcaaagcgtaaacaagcagagattgaatgcaaggtaaatatgtcaactaactgattttgttttttgtcaatataataatgccttttttttgtttgttttatcgtgattagattatcttaaaaacaaaacaaaaaagctcgtcctattttctacttttcctgaacttgttttggtagttgctttcagaccaggtcagctcatcttgcttctggggtggattttagtcaagaaacattttcagtcacttccttggttaatttaatttcctggattggcatttactagtatttctttacagtttttcttttgactggtaaccctttaaaaccagagcttttaatggcttgatcaaaaaagatgggtcatttagagaggttaggcctcctctgctttgattggtatcttattagtgggcagtaatgttaataacattgatacatgttttctggatagactagagagcaaaagaaatgtgtatgtaccagtgtgttgggaaaaatgggtatattacccattattattttaatcagttatatactttacttttttgtgaagtgtttggattcaaaaagcatcaaaagtatttgaatgcaagtacattctttcctgaaataaatttacaatatagcagtggtgagagagtgggggaaaggcagtgagatggaaggagaggagggagggtttgggtgtgtgtgtgtgtgtgtgtgtgtgtgtgtgtgtgtgtgaaataactaaagagatgactgtagactgggcattagaatggattactaaaggcaagttatgggatttaaaaaaataaactaggcatccacctttccatggtgagatagtaggaatgatgccctttaaagattccagccttattattgtataagaaataagacttttgatggcacatgtaaagctgtaattccatcagcttattctggtgacattaaaaaccaagagtgaagcttgaatggtttatcagtgtcactgaaatccagagatgaaattacatccttataaatatgcatggctgttacaatgtatactgacagaaatctgtaggcagtactgaaattcctactaaaagcacagtcacttttgaaggatatgactaaactataaataaaataatattaaatgaggttgtatcagtctgatttgtcataccaatatctgattgagtttttatgatgctaaattgtctgtgttgacatcttatagataactaaatttaatcttttatttattattggtgttagttttccttaaacatattttgataatggtgttactagattaaatattgctcctcaaatgccttagtacctgttgagcaaagtaaagtgttctttggaaataaatctttgaggaacttgctgttgaaaataataattttctttgaacttgtctaagtaatgggctcagatttagaatattagaggattttatgaactaatatgggattttatttaatttttaattgttcattaatacctctgtgaagtatgttacagatgcaaactctgatatctcccctgtgtttaagctgtgtgttaatttattcaatctttcgtgatgcctttgcaggttttgagaatgaccaatgtattgttaccctagcacctagtacattctgattaaatgtgtatgttttaccctgttatgttggaataattcgggaacaaagttaatttttcaagaaagccagtccgtgaattatgtaaatctgattcattttcatttagtattataagattatagcttatgattaatttataattattaaagcttttttatttttagttgtgtaaaatgtgtggatattgtttataatattaatgttattttccctctcaacttaatttgaatgttctcacttaaagttgaaatattacaagcctgtgaaccccagtttcaaaatgcaaaacactctaaaaccctggagttttttcataaatttcacacaaattcctttggaggcaaaacttaatttgaattgatatatggccatttataattgttatttattccacttgatgtgaacatttatatctcactgcttcgttgtatgtattgagcatattgtttcattatggatgctgccttagaccctgctagataatacttaaagtatggtttatgcaacctattacttttctaaaatctgaattccaaacacacctggtttattttgtttcggtttggtttaccacactagaataaggaagaagtgatggctgtgaggcttcgggaagcagatagcatagctgctgtggctgaactacgacaacacattgctgagcttgaaatccaggtaccatatgaaaataataaagtacatgtaaaaatatagtttcttctatcctctttgtctgaacagtaacttactctttatcctcgtgactgtgattcttttttcagtaatcattcatttccaatttttttttattgtggtaaaatagacataaaacttaccattttaaagtatacagttctgcagcattaagtatatttgacactgttgtgcagccatcaccaccatccatatccagaactttttcatcctccctaactgaacctctttgcccattaaacactaacttcccattccccagcaactggcaaccaccagcaactggaaaccaccattctactttgtctctatgagtttgaccactctggttacctcatataagtgggatcatacaatacagtcatatgctgcataaggacatttcagtgacggacagcatatatggtaatggtcccataggatgataatgaagctgaaaaattccttttgcctagtgactatagccatcattatgttatagtgcaacacattactcatgtgtttgtgatgaggctggtataaacaaacccactgcactgccactcttataaaagtgtagcacgtacagttgtgtatagcacataatacttgataataaatgactatgttactggttcatatgtttgctatactatttgttgttttgctatactaatattgctattttagagtctaattctacttatacaaaacaagagttaactctaagacagtctcagatccttcaggaggttttccagaaggcattgttttcataggagatgacagcttcatgtgtgttattgtccctgaagaccttccagtgggacaagatgtggaggttgaagatagtgatattggtggtgctgaccctgtgtaggcctaagctaatatcttattttaacacaaatgttttaattttttttttttttgagacaggatctcactctgttgcccagaccggagtttagtggcacagtcatagctcactgcagactccaactcctggctcaagcagtcctcatcagcttcccgagtacctgggactacaggcacacatgaccacacccagcttatttatttatttatttatttatttatttagtagcaatgaggtctccctttgctggccaggctggtttcgaactcctgggcttaagtgatccgcccacctctgccttccacagtgctgggattacaagcatgagccactgcgcccagccttaatttttttttaacttaaaaaattttttgttcatcaggtgtaatgactcatgcctgtaatctcagcactttgggaggctgaggcaggcatatcttgagcccaagagtttgaaaccaacctgacaaacaaagtgagactccctctctacaaaaaatacaaaataaaattagttggacctggtggtgcacctatagtcccagtcgcggttacttaggaggctgaggtgggtgggttgcctgagcctgggaggtcaaggctgcagtaagccatgatcacagcactgcactccagcctgggccacagagtaagaccctgtttcaaaaaatatatttattaaaaattaaaattaaaaatagaaaaaagcttatagaataaagatataaaaaaaaattttatacacctgtacaatgtttgctaagctaaatgttataaaagagtcaaaaagtttaaaaaattggaagtttataaataaacttacagtaagttaatttattattgaaagaaaaaccattttttataatgttatagtatatttacaaattttcttcatttttaaagctgaataatattccattgtatgtatataccacattttttatctgttcattcattgatggacatttagggtgcttccatgtttgagctattgtgaataatgctgctatgaatacaggtgtacaaatttctgttcaggtccctgctttaacttcttttgagtacgtagaagtggaattgctggatcatatagtaattgtttaatttttttaagaaattgccataccattttccacagaacctacaccattttacatttctaccagcaatgcatgaggatttcattttttccgcatttgcaccaacacttgttaattttctgttgttgtttttataagtaccatcctaatgggtgtgaagtggtatctcattgtggttttgatttgcatttccctaatgatgagctatgttgggcatactttcatgtgcttatttcgcatttatatatcttctttggagaaatggctattcaggtcctttgcttaattgaaccaggttgtttgttgtttttgttgttgagttataggagttatttatatattctcagtatcactttcttatcatatatatggtttgcaaatattttctcccattatgtttgttgccttttctttgttgatagtgtttttatcacaaaagtttttaattttgctgaatcaacttacctgggttttgttttgttttgttttttttggtggtgttgactgtgctccaagtccattttttagtgaaaatttatcatatttctatattatcaaaactatcttcaaaagaaaattcaaagctttaaaaataaatatgtttttacagggcacagtaactcatgcctgtaatcccagtgctttgagaggccaaggtcaggggattgctggaagccaagagttcaagaccggcctgggcaatagaataagaccctgtctctacaaaacaatttttaaaaattagctgagggcatgatagtacactcctgtagctctggctacttggaaggctaaggtggaatgatcccttgaggccagaagtaggagttccatattacaaggagctatgatcaagccactgcactccaatctgagtgacagaatgagaccttgtctcaaaaaaaaatttttttaataaaaataaatgtgttttgtcacttcttatgccttacttcttgtataatatgataaaagtagtaagttttccctatggacaaaatactatgtttaaaatcttatgtctttcaaagtctttaattatattgtactccaagtcacaatagtctttgctgtaacatctagaattttcttcccacctgaaatttccttttgtctttaaatttcaatttaaaatgtaattaatttccaaacttacatattatattataacttcattttttgatctggatcaaaagtaaccacaacacattatgatttgtatgtttataaaaaggtatcctttatgttctgctggtagtagtccccataaagtgcacatattcaggaaaacctcagacatgagccaactgcataatatatttgtaatcagttgtttaaatcatgctatcgtatgtgattttagcattagtctgtacttttctaaacatcaagaaaatcctaagaatttgccatatttctatacatcttaatcacaaaatagtaaaatttaaatcactctttttgttgattctgaaatatttattaaaacgaagaacctggtgtgcaggatttttgtttaaaatgaaatgtaatgtgttacattatttttgaaaaatagaaaattcatggaattttttttaacatcttccaatcctttacccctaaccccgcatctagcccctggtaaccaccattctactctgtacttttgagttcaactttttgtatcccacatgtgagatcatgtagtgtttgtctttctgagcctagcttatttcaatttcacttaaggttctccaggctcattcatgttgttgtgaatgacagaatttccttcctttttaagattgaataatattccattgtgtatatgtaaaccactttttctttattcattcatctactgatggacatttaggttggttgcatgtcttggctattgtgaataatgcagtgaacacgggagtgcagatatcttttcaacatactgatttaatttcctttggatatatacccagtagtggaattgttagatcatatcatctgtttttgattttttgaggatttacatttctacccacagtgtgtaagagttcccttttcaccacatcctctccagcacttactgtctttcatctttttgataatggccattctaacaggtgtgaggtgatagaattgttactgttattatagtaggggtatattatcatcaactggctcttgataaagtggtcactggaatcctaattgccaaatttgttgctattttttcagtatttgcctgctcatgcttattgcatttgtttttgaccatttcgtcctccttgcattctcacctcccctaactttgctaccaccacttacttttgactctcttttttcttgtttaactgttgtttacagtcatctttatcagtcgtggatgtgtgtattcctctgaaatccgaggttttggcttttacaaactatacccaaatgaagggtctcacttacatggcttcaggaaccatctttaccagggtttcccaacccccaggccacagacaggtatcagtccatggcctgttaggaaccgggccgcacagcaggaggtgagcgggcagccagcagcatactgtctgagctccacctcctgtcagatcagtggcatcattagattgtcacaggagcacgaatcctattgtgaactgcacatgtcaggggtgttggttgcactctccttatgagagaatctaatgcctgatgatctgaagtggaacagttcatcctgaaaccattctcccaccctctctatggactacgaaatctgtcactagtaccaaaaaggttggggaccactaattgttgcaacagtgaatcataatttatctccagccccagcctgtttccccttaccaataattttctaaatggtttaataatttaaaaattatgaaacatgaggtacagagaagttaataaaacaaagtacattgtatgtgtacaaatattatacataaaacttctaaccaaggttaagacagacaaaattgcctgtactcaagaagtctattcagtcacaccctgttccctatcctgacttttatgacaatcactcttttgcctttccttatgattgtgtcatcttcctatacatttctgatctatacagtttagttttcccagcttctcagttttgcatatcgccaactcttcaatctttcaaaatagaaaagtctaagtaagtataaaactaaataaaaggtaatttgagtcatttttcaaacttttttgagtctataataacatttctcttctccctaccactccgttagttcatctgcttaccccttacctgaactgttgttgtaacctcccatccagtttccttttctccagcttcagctcttctacagattaaaaaagctgtctctctaaaacatagaaatttcattgactaccttttaaataccaatcatatcgaaactccttagcataaaatcctttttattattgcccaaactgaatttgtagcttcatctctcaccattatctccccatcctcatcacctacacatacatgctgtattctgcccactgtgaattatcctattcctgcacctatcacattctttcagaattctgtgccattctgcatgttgctgcatcttcctaaattgctgtatttttctgaacttcttactcctctacttttgaagtatttctgtttctctttcaggtcttaggactgagtgctttttggctaacttgctgttaatttgcttagtaaatgagttttcagtagatgtcttaaggtttcaatatttaattatatgtatatgtctatataaatatagatatatagaggtatatttttaatacagattaagattcataaatagatctttcattaaaacctgaaacttttttcagttatcaaagtaatatattttaggttattttcttagtcatggaaatatcttagatcatattcaagttccactagggggagaactcaacttagtctaagatttttgtacttcagatgtcttcagattaactcttccaattactggtactctcttgcgagtaaaatgtttttgcacaaaccgaattctttcaaactcttcttttaataaattattatttaatctgttattcatataatgaaagcctgctttttaatgtagttatgaaaattatacttttgtaaacatctcatttagatgagaaaatacattacatgaagaaatactcatttttataaatactataacattgtaatatatagatacttacatatagatatatagtatatttatatacatgctatgtagtatatagatataggtagactgaaatttattaaatttattttcaaagattaatcagtctacttagaacttttaggtctaatttaagaattatcatctactgccatgttgttattctgacataactacatctgtaatctagttatattgtttataataatgcctcctccaccaccctgtctttgtattcgcgtcttacagtgaacttaaccatttttaagtgtagcagctttcaaattttagacattttcctagaactgtttttaaaagttactattacctagttttcttctctaaatgaatgacaattatttattggtgggttttttgctataaaattattacactgttgtgctataatgctcagttgggaacagattatacaacctgtaaaattaaggagttgaactctaaggttctatcacatataaaacaatactatgccatgtatagcatttaaatattttttgacaattctgagttaccatgaattttaattattatgtactcatctcactttattaatacctccatgactttctctttggccaaatttttaccttaaataacattcctattctagttactagactcttatgttggtttattttttcttcataacaattattacttttttcataaattatacatttctttttaaattttagatgtgggggtacatgtgaaggtttgtagataaacacatgtcatgggggtttgttgtacatattattacatcacccaggtattaagttcagtacccaatagttattttttctgctccactccctcctcctacgcttccccctcaacatatttttatttttaattttccacattccccactagagcataagctccatgggagtgcaagagtggaatttttatctgtcttattcattactatattctcttttgggcagtggtgggggagacaaggtctcaagatcacgccactacaccccagcctgggtgacagaacgagcctctgtttcaaaaaaaaggtctcactttgttgctcagaccagagtgcagtggtgtgatcatagctcactgcagccttgacctactgggctcaagcaatccccccacctcagcctcccaagtacctgagactacaggagcacaccaccacacctggctaatttttatattttgtgtagagatggaatttggctatgttgcccaggctgatctagaactcctgagctcaagcgatctgcccacctgggcctcccaaagtgctgggactacaggtgtgagccactgcacacagcctcgttgctatattgggtgcttactgtataatgtctggtacataaccgtcattcagtagatatttgtatttgaccaaatttgaccagtagatatttgaattttgacaataattcattcatcttctgatgttgtttctacaataaatgatttttaatgtatgcagttgtcactatattcacacatttatcaacttgtatatgttcttttattattaggtcactaccagttaggaaggagaaaatgaattcagcctctgtccaaatgaatttaccattacagagtaggagtgactgagcttaggtcccttctctgaaatgttttttaatggaatttaaacctctgaaaattaatgtatatttattgttggtattaatgactgtaataacatgcaagaagatgccaactattatcagaatttttttgctatcctcacatatgctttagaacccagttttctgtttgaatgtctcagtctaaaggaacttcttttagtagcctgcaaaaataaatatgacatatcttaatcagaataaagagcttcaagaaatttagttatgaagaacaagaggattttaaaatcctgaatgtctctgtggtcccaactttttgtctttttgttttcttctaattgctagagattctgtattggttaaaagaatggatttttgagtccaacctcttattagcctcttatctttgacaagttttttaatgtatttgttggttcactcattcaaaactgaggattctaaagctatctgccttatagttgttgggatcaaatgagaaaactcatgtaaagtgttctttcttgcctacataatatccggaaaaacagctcgtagaccttatgtaaaaagtcacattcaatattgtagagtccccaaaattacaaccaaactagaaagttctgaaactctttgagtttccttaaagatagtctttaacaacctcagatactgaatatatatccctttccaaaaattatataaagcctgaaattaagaattatcttggggccaggtgtggtggctcacacctgtaatcccagcactttgggaggctgaggcaggctgatcacttgaggtcaagagttcaagaattatcttggctttttgttttttctgtaatatatacttaagtaagcttctttctgtccaccatgaaaccctgtttagttacacttcattttttgtgtatttgctgtatttggaaatatagagcttattacttaacaactttaattattccaggatactaataataagagtaataatagctggcattactgaacacttggtacataccaggcagtgttctaagccatttgaggatattcacatatttaatcctcacaaaaatcataggagatattggttttggggttttttttgttgctatttttgttattgttttcaagacagggtctcacttcgtcatccaagctgtaatgcggtggcgcagtcacggctcattgtaacctcgacctcccaggctcaagagatcctcccacctgagcctccaagtagctgggactacaggcacatgccaccatgcccggctaatttttgtattttttttctgtagaggtggggtttcgccatgttccccagactggtattgatctcctgggctcaagcagtgcactcaccttgacctcccacagtgctgggattacagacatgagccaccaagcccagcaaaatattgttaatatcttcattttatagttgagaaaactgaggcatagagaaaattttaaaatgagattttgttgtttgtatgaaaacccacttttgaattttttccaggaataaaaggaatttcttttcttcagtatttcaacatactgtcatggtagttatataagttttcttaatagcatattgacagcttcctgtgaatttgcttattatacaactaaagttactattagttccctgttcattacttaaaatttttcagttgtttcccctagcgttggggacaaaattcaaactctggccctccttgtaagatccttcctgctcgaattgttgcctacttttctagctttatttcccagttaccccgacatatatatacccggtacttgaggcccagtataccagttaagaatccttcaaatctgtcatctcattttcctccatgtttttctccctcctcctttgatcttgctttttatttcaaaagtcagcttttctttttattattatactttaagttttagggtacgtgtgcaaaacgtgcaggtttgttgcatatgtatacatgtgccatgctggtgtgctgcacccattaactcgtcatttaacattaggtatatctcctaatgctatccctctaacctccccccaccccacaacaggcctcggtgtgtgatgttccccttcctgtgtccatgtgttctcattgttcaattcccacctatgagtgagaacatgcggtgtttggttttttgtccttgtgatagtttgctgagaatgatggtttccagcttcatccatgtccctacaaaggacatgaactcatccttttttatggctgcatagtattccatggtatatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtgatgggatggctgggtcaaatggtatttctagttctagatccctgaggaatcgccacactgacttctacaatggttgaactagtttacagtcccaccaacagtgtacaagtgttcctatctccacatcctctccaggacctgttgtttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatccttcacccactttttgatggggttgtttgtttttttcttgtaactttgtttgagttcattggagattctggatattagccctttgtcagatgagtaggttgcgaaaattttctcccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggggttttggtgtggatgtcctttctgtttgttagttttccttctaacagtcaggaccgttagctgcaggtctgttggagtttgctggaggtccactccagaccctgtttgcctgtatatcagcagcagaggctgcagaacagcggatattggtgaacagcaaatgttgctgcctgatcgttcctctggaagctttgtctcagaggggtacccggccgtgtgaggtgtcagtctgcccatactggggggtgcctctcagttaggctactcaggggtcagggccccacttgaggaggcagtctgtcggttctcagatctcaagctgcgtgctgggagaaccgctactctcttcaaagctgtcagacagggacatttaagtctgcggaggtttctgctgccttttgtttggctatgccctgcccccagaggtggagtctacagaggcaggcaggcctccttgagttgcagtgggctccacccagttggagcttctcggctgtgttgtttacctactcaagcctcggcagtggcaggcgcccctcccccagcctcgctgccgccttgcagtttgatctcagactgctgtgctagcaatgagcgagactctgtgggcgtaggaccctccaagccaggcacgggatacaatctcctggtgtgctgtttgctaagaccattggaaaagtgcagtattggggtgggagtgacttgattttccacgtgccatctgtcacccctttccttggctaggaaagggaattccctgaccccttgtgcttccctggtgaggtgatgcctcgtcctacttcggctcacgctcggtgtgctgcacccagtgtcctgcaccccttgtctgacaatccccagtgagatgaacgcagtacctcagttggaaatgcaggaatctttcatcttctgcatcactcacgctgggagctgtagactggaggtgttcctattcggccatattggctccacccccaaaagtcagcttaagcttgaccagttgtgatcagcattccctgttaatgccatcttacctgatttcgtgtatctctgctcttctaataccctttgttagagatctttcttataccatctcacactactgtagttaattcttttcaatttttctgtccaccatgtgcagctgaagttcattgaaggtaaggaccattatttgactttatatttccaatatcggcatactagccacagtcaaaatatgtttatttactgaaataatttgtatgtaatagtttattttttgaaatatcaattagactttaaatgttattctaattttaaaacccacatgtgaagaacagattaagtttctaatttaaatgaagtattggtttcaattttgtagatatttatggggtacttactatgtgcctgtcactattctaaacactacctggattagtgaacaaaatacaaaaatccctttcctcattgagctttatggtagaatgagaagttagatgaaaaaaataaatcttatggtgtgaaatttagacagtggaagacaacggagaaaaatgtgagaatgagaagatattggtattaggggtggaggactgttgctattttcacaatgtggtttataaaggttcattagaaggggatatttatttaaacaaacatttgaatcagatgaggcatgaagatttgggggaagaactacttactaggagaatagtacaggcaaagggcctgacataaggagcaagtctgaagtagagtctgggtggagtgagacatgggaattagaggaagtctgagaggtaaatagagccaattatgtaggacctaaaactttgacctttcccgactcagatggaaaatcattggagggttttgagcatgggagtgatcagttagatgacatttaagctgttaaaaagatttaattgaactgattcaaaaaatacttgtaagaattcatggtatttagtttggagggaaatgaggttaaaaaattaagtttcctcttattactggagttttccaccatctaaatgctatttattatttgaagactttatttttacattaatactaaatggagctatctctaaattccatggagtagaacaaaacatagaaaagtcaattttttcctcagttagttaaggaaaataggtgagaattaaacccaagccttctagtatttaacctgggattgagtttgtattttggttattataaagataagcatattgatttttgtaactatgttaaaagcttctgtgggctaagcacatctataaaattaacgccactttgttacaagtaatggaaagtttttcatttaaaagagtgtaggtctactcaaatccaacttttggtttttttcctggtacccagtaacatttacccattttgattagtttgcccaacagataacctctagggatgcctcagatgggcaataccccaaccactcttggcttaaaaacgcccactcaaaattctgttctgacatagaatgagggtgctaggtttaaatcactgtgctcagatcagtatgtagttttgacagagatggagaggaagtgataaaacctttaccattaacttaaaaatattatattttttaattatgtgaaattaccatgacattactaaatgatggaatttatcataaagctttgtgattagtttgtactttccagtttcctgagctaacttgttaatagttttttttttttttttttgcccctgaagcacaatcgtttatggctttcgttttgagcaatttacctaaatattaaaatatttttcatttttctttaaggcatttctcaattttaagcatttttaatttgaaaaaatatcttctgtaattgtatcttgtcttaatattaattgtcaggaaaatacgtacatagactgctttacctagcttgctatctagtcattagggattgcgagattctgtttaaaaacttttttctgaagtgttcagagattctttggtgtccaacttcagtacacagttaaatttaaagggatgaagtatctagaggtttttaggatattgctatatctagaattgaagaacatcatttggatcccccaagatgagctcatagtaagatctcagttaagaattaggggagtttggactcttaagtaccataatatatatgctcacttggtgttattaaaaattagtttatgtacacttagtgcccagattttggtttttaataccattctccagtgaaggggaccagggcttctcacagaaatggctgattctgtgcagcacaccagcatggcacatgtatacatatgtagctaacctgcacattgtgcacatgtaccctaaaacttaaagtataataataataaaattaaaaaaaaaaagaaatggctgattctaggacggggacaggaaatatagaagataagcctggagcaccttataatgccaataagtaaggaagtactcaaaatgcacacacacacacacacacacacacacacacacagccaaaaaaaaaaaaaaaacctacattaattggagtgtgttgaagggacagaggagccaactgaaagagttcccaatgaccaaaggtagaacaatttgagaaaaaaaaaattttgaagtattacatacttgaaatacacaagccaaagtataataacccaaagtagattataacccaaagtataaaataaatatccatgagcctatattgatttaaatgatgattaaattaataaatgtgagttaagagacaaatatgcagaagaattctaaataatttttgtagatactccaccctcaaggaggggaagtataaatctccactccataagcgtgggctgcacttagcaacttccctccaaaggaaaagtatgggagacaaaaagagtaactttacagtggagaaacctgacaaagattacctaagccaggtgattaagattaccatcaacagtcataaattacactgatagtacatacccttgatatcatgtgacatgatgaaaatggcactttacctctctggtattcctcttgataacccataaccctagtcttaccatgagaaaactatcagacagattccccttgtggagatcttacaaaatacctgaatagtaatgactcaaggctgacaagatcatcaaaaacaagcaaagtctaagaagctgtcacagccaaaaggaacctaaggagacattacaactaaatgtaatgtgtcttggatagaattctagaaacaggaaaaaaaaaaaacaggttaaaaaacaaaggcaaaggaaatctgaataaactaaggactttagtagtaatgtatcaatattggttcattaattgtaacaaaggtaccacactaatatattaataataggggaaactgtgggagggtatgtgggaactctctatcttctcaatttttctgtaaatttaaaacttttctaaaaagtatctaattttttttaaaactagtttgtgagtccatagtttttaggagccattggaattatatcaaattttaagtattggtcacaaaattgatttgtttccaattaaattatgatttatgaggaatattttctaccttttagaccttgtgtgaatgctgacttgttttaagagagggagagtgtcttgctctgttgcccaggacagagttcagtggtgcaatcacagcgtactacagctttgaactcctgggatcaagcagttctacctaagcctccctagtagctagcaatacaggcacaccccaccatgccctgctaatttttaaattttttgtacagatggggtcttgctatgttgctcaggctgatcttgagcttctggcctcaaataatcctgactcagccctgcaaagcactgggctgatttttttttttttttttgagatggagtctcactctgtctcttaggctagagtgcaatggtgcaatctcggctcactgcaacctcagcttctggttcaagcaattctcctgcctcagcctcctgagtagctgggattannnnnnnnnnnnnnnnnnnncatgcacgtcattcgatatagaagatccctggaacagatggggtcttgctattttgctcaggccgaccccggtccctggcctcaaataatcctgactgggcccttcaaagcactgggctgccccctttttttttttgagatggagtctcactctgtctcttaggctagagtgcaatggtgcaatctcggctcactgcaacctcagccttctggttcaagcaattctcctgcctcagcctcctgagtagctgggattacaggtgactgctaccacacctggctaatttttaaattttcaatagagatggggtttcaccacgttggccaaactggtctcgaacacctgacctcaggtgatctgctcacctcggcctcccaaagtgctgagattatgggtgtgagccaccacacccggccttgggctggtatttttaaactgtgcctttagctagtcctgtgtatatgtatatttctcttctgaaatggaattaaatcagtcttaatactgaaaaatactagccaaatatttgatttcttttatcccttatatatttttcagatttcattattggtttttaaaagacatttatgtgtacttttactttttctaattactaagaagaatattcaaacctttgtccatgactttaaattacaggaaactgtttcaaaaacttatcagtagtacatgatatgagtatgatttgtttttagaagtttcaaatgagtcaccttgaagtcatggagaggctaccgcttaccacatttaccattctgattaatttttcttttggcaaagtacaaatcagtaataacctactaaagcctagtggttgctgttgatatttcagtaaggtgatgttgattaatcagagtgattacttaccaagtgttacagatttactcaaattattgggttttcttctactatagtaatttcatatgcagtaataatttgcttaagacattttgcttcatatgtgcgttgaaaatatcaatgtagaacttaaaatttgtatccatgctgcaagttaatgtggttgcctctgtgaccgttgaacatagtttcataataaagcctggaaaaaaaaaagcattatttaaccttttaaacaatcaagagattgctttttaaattgtctctaaaaaggtttgattttttacgaaagagagagcacttgaatatatctttatgtaccaccgtgtctctttttgttagatttttcatctgtgggtataatataaaatattcttaaaatgaaagctttacgcttgtgtttgagactaagcaacttgcattgtgtcatgacccttctaataccacaaaccttctgtaatactactcccggagaaaaacccacatcctatgcataaccttagatttattttgaaatctctatgaaaaagaacagagagagattactaattgtttctgttacttcctttagaggtatgatacctatttgtaacccatgttgtaaatgttaatagccaggagtaaaatgttaaaatatattaagtagtggtttcctatcctaaagttaatatgtgaaaatttaataactaattataagtttcagtttgttatattagatatctggaaagaatgtaaaaaaaaaaaaaaagagagagagagagaaggcattggtacttccagtagcttatacttctaataccattggccagtacaatactagaaaataattgcaaatttaaataagccatctttttaaaaattttattcctattctgattttttccttctattttagatttctttgtattctttatgtaactgatgaaggtggatgaaaaatctaatttttttttttttttttttttttttgagacagagcctcactctgtcgcccaggctggagcacagtagcgtgatctcggcttaccgcaacctccgcctcccaggttcaagcgattctcctgcctcagcctctcaagtagctgggattacaggcacgtgccaccatgcccagctaattttttgtatttttagtagagatggagtttcaccatgttggccaggctggtctcaaaacttctgacctcaagtgatccacccacctcagcctcccagagtgctgggattacaggcatgagccaccgcgcctgaccccaaggttatttttaatatttagaaaaaatagtaactacccatcagtaggagaatggttacactatagtatatttatactctggaatattctgcgtctttcagaaagaataaagatctacaagacatactaggtgaaaaaagcaaattataagcagaatatatattcccatttgtatgtattaaaaagcatttgtgagtatatgtattgtatttatatatattaagtacatgtgcatgttaatatgtatatatgttacatgcatatgtacttaaatgcattgaaattggctgcagtgatcctgtcaaaactgttgaaatattccttcaggagatagtaaagggcttggtgcaaaagagtagaggatatgagttcactttttattctttatgaatttatatgattatcattataatattttatgtatatttaaatgacatttaaagtaactgttgctagaaaggaaataagaactagaacttccagataattatagggaaaaagtaacaaaggaaacttgggctaccaagcaaaagggccacctttttttctggccttaaagtccctgagtgttgtctggctcctgcccatttctctgacccattttaaatggcattctccttcaccagttagttctagcaactactcacctcctttttttttcttgaatcaagctctttcattcctacattaaggcttttgcttgtgctcttttttatgattgcaattctgtgctccctaatcttcccatgactgataccttctcatcatttaaatctcagcctagatataagtcactgcctgaccacctttgtaaagtaggcccctcacattgttactgtgtctcattatcatgtcttatattctttatggctcttgtcagtgcctgaaattatttttactttaaaaattaactctcacaccccatgatgtttcagtcaacgatggaccacatatatcatctgggtcccataagattatgagacagtatgtgttctgtaccttttctatgtttaaatatttagacacacaaatacttaaccactgtgttacagttgcctacagtattccatacggtaacatgctgtacatatttgtagcccaggaacagtaggctatactgtatagtctaaatgtatagtgggcactaccatttaagtttgtgtaaatacaccctacggtgttcacacaacgatgaaatcccctaacaacacatttctcagaatgtatccccattgttaagcgagtcgtgactacattagaaccttgtttgtcttatttactgctgtatgcctggtgcctggcatatcacaggtgctcaacaaatagttgctgaatgaattttaggagggagaaaatagtcatgtattgaccttctatgccataagagcaggtagcaggttttaagtactttctgtgtaaagattcctttatttaaataaatgttgcaccaaagatggcttgaaactcccagaattacctaccccaactatctaacaaaatagtaaatagtttttttttttttaaagcaaaaacttgcccaataaacctgagaggaaaaggaacataacctaatgcaataaactttaaaaagtgacagctaacaaaagaagcagacagtggtagagcagagaggcctgccagggcttggcttctaaccttgactatctatcccatttccaggctgtgtaagtcagcaaaatcccaggagaattcatttatatctcacatgtggagagaaggaaaatgagtatgtaatcttctgactgaggagtggtagaaacttctgcaaaggataaccaagtgaaagagatcagaaaagtgacacctcactcttaagtgaaggccctagggcaacacactgaatatgggaaatgatctgaatcctaaaactcaggttttgtgatatattcccccaactaggtagtacaagatatttaacaaaatctcagaagagtaagaagagcccttgtttagctaggttttttctttcactgtgcattttcctgagactatagaaaagtgagaacaagcttgagcttggaaggcaaaggaaatagatctcaaatatggtggagagatagttagtgtcatccatatcattagcgtacttggaatatgtggacaatcacctagccatgaacatggtgaaaagaaatagcacaacaatttagtttatattatttattaattattattgattattatttagcagaaagaaataccattcacaaaaccaaaaatcccaaccaagaagaaaggtaattcaaggataagaagaattacagttgcttcacactgtaaaacaacttaacattaattcagtaaaattaacagattgaaagataagatagccctttgaacaagtggctggtagtccacctacagagtgctgtgtccaggccttgtatagacatatcttgcagctgcacctggttctgcccccagacatcaaagccctgggcaaccagtgcatgaaggactaatttaggagacataagactgttggttctgacaaggctcagtgtatttgcaggaatggaaggtgtatgcagcaatgttatggcaagcaagataaagaaaacacaaaattcaactgaaaaagcatgttttggcacctccctctcagaagaaaaacctaatgactttggtgatgaacgaattggatacttacaagaggtgatacaagaaactactaaatacaataagcaacttagtaatactgagcctacaaaaccaaaattttagtctgtacaataaagcttaacaaaatatgtaaaattgagaaccccttactttaactatcattgattggtttttaaaatttattacttaagctttgaagcttttagaatgcctagtgttaattaaatattcttttatttttggttgttatgaatgcaatatatgaatcaggatcactagcagacaattgcaaaagattacaacattattggaatagcagtccttgctgggtggaatttgatttttggactaaacaggaaagaatgactctaaaatggacaaacttctagaattttgctgaaaaaaatgtttacatataaattagttttaaatgccattcttgttcaagcattagcctcatgggttttctttagcttgatcagataagtgtatagcgataatgatagatacaaaattccaacaaaaatacattgtcaatctgaaggtttcattgtttctactttaataatacatatatgattattattctaaatgttccttctccctgagtcattgtttattcacaatgaaaggttaaagagaagcttgaagattcagtattatcatttgtaaaatagatagtacaaactataatacatttctactttgtttattaatcacaagcgaccgtttaagttaaataatttaggttgggcacgggggctcacacctgtaatctcagcactttgggaggccaagacgggtggatcacttgaacccaggagtttgagagctcatatctttcttttgttttttagttaaaactattttttctagttttttcccctcaaacatttagatctttctatacaaaaggtgaactcccatttataagctaaaagtaataaatagtaatggagaaatgtatacagaggggaaaaatggctattaataactgtattagtcacagtaaaaccaaaccatcacattaaaattgctgaaaaaggaaattaattttatagtatattatttccgtgaaatatataaaataccattgatattttttataggctgtctttgatttatctttgttttattttttgtaccttggtctcccttgacttcatatgagaagggatttgtaagtaattataatctggttttccacactggcctccttccattggctctcttattaaatttgaatacactaatagtctgatcagttgatttaaatattttttggcaaaataaactcttcataggccattcagacagactagggaagggaatggtttattaataagatgaatatttaggagccatctgatcatccaatgctacagaagatacacgagaaactttgacagctttgcttcccaactttgacttgatatcactctttacagagggctcaagaaaagatacatgaataacataaaataagtactgcatttttagaaaaacaattctagcacatgtcctgctatgatctgtctcaaatcaaaatcctgattttaggtttaggctgggtatgatgactcacacctgtaataccagcactttgcgagactgaggcaggaggatcacttgagcccaagagtttgagaccaacctgggcaatgtagcaagacttggtctctatttaaaaacaaacaaacaaaaccatggtttatattggagccatttataatgatataaagagaatgggactaagagtgaaacctggcttctactccttgctttttcctggctagtcatgtggtccttgataagttacttaaccactgagtccattttcttttctttttttttttttttagacagagtcttgctctgtctcccaggctggagtgcagtggcgcgatctcagctcactggaagctctgcctcccgggttcacgccattctcctgcctcagcctcccgagtagctgggactacaggcacccgccaccacgcccagctaattttttgtattttgtttagtagatacggggtttcaccgtgttagccaggatggtctcgatctcctgacctcgtaatccgcccgcctcagcctcccaaagtgctgagattacaggcgcccggccgtccattttaaatctctagtgcttttggggccaggcccaggctatgttcagttcaagccacctatgaggatacacacaggtaaagaggccatgccaaaaaaaagaggatttagtattaatttttcattccagaatttctccacactttagttttgctaaaagaaagaaatggtgacaagaatccaccatatgggggtaatagttctagaccataatagtcatcaagctgggagaagagcatctagagaaatagcaatgtggattagtagaatgacagaaagatgaaatagcgttcacatggatccagaaagggcttttcaaactaattctttaaaagtcatggtatgcagtgcaccaccacccaaaagacttgtcagaatcttaacttaatctagcatgacagtgtttatcactagtaaatgaaatatagcaccatagcgcctttccttacagggaaaagacaaaagctaccttgcactaaacaaaagcatctgtttagagtttatggtatccaaaacaaacaaaaaaacaacaacaaagccagaaagcaaaaatgggtctaaaactttcactgagataatcccatgccgtggaatatgaagatattaaaatatctgtctagaagatgaatcacattttcttcagctacagaattttccagctgtgtgagcaatgtctcatgagcaaaatgaagcttaatgagtggatatttgatgctttccttttatggcagatcctccctttgttagaggtttctttgtgactaaccctatgctttcccagaatttaaagtcatccacctactctataaaatattttttgcaaagagacaaatgatagaacaggctgaaaggctttgttgtgtatttaaagtgatcccaacagtttgaagaaggcatcttaggaaccggctttggttcagatgaaaacttatgaagcattcactaaccagctttcctcaagacagcctgctggcccgccctactgattctaccctgcagcatcaagtctgacctggatttcctggacttctgccctgccggcaagccgtacaaaaacttccaggctgccagtccctacaagtggtgtgagctaatcccttaaatttatatttcaaatcagaccagcatattctgaagtgaaaattaagggaggaggagaaatgggcaggatcctggggaagatgagcaagcctaagtctgcctatgcctgacagaacaggagaagcttcatggggtgaaaagggaagcctttgttccttaaagggaattatattggggcccttctgctgaactggtagactaacatgtatagaggctgatttggacttggcaagagtatggcctagagttctctcaccctgttatagagataatgccattttctcaatatattctgaagtcttaagtatcttacaaggtttttttcatgtccttttgtggcactcagcacttattttcatgctttggacattactggcaatcctagccccaaagctacaaagggaattccaggtttctgacaagttttaaatgctccccatgttattccagtgaatattccagtggttatcattgaactaccaaagatgacaatgaaaatgtaagattgacaagaggctcagccattaagagttgtatcaaagggctcagattcttatttttaactgggagaatacatatcactcttgtatttgcccagcgatatagacagaactaggaaccagaatcagtgggctagcagtctgtcagatgtcttaaactacaggtaaatttgtatgtaaaaatcagccattcaaaagccacttctgtaccagacattctagtaggaatgctgctctaaaaattattcagttacttgcctaccagtattttgtatttgacctttttactctaccccgttagctatctctcttgatacattttatcaatattcttcttaataattttacttatattttagtaaaaatttaaaaataaagtcatgttaaatatggagagaattctttggacttcatagcactgaaaggtgtaaatctataggttagtctcttaataagaggcaaaaaatttaaaaattataactaccaatacttgtgtttaacataaggcaaaaaaatttaaaaattgtaactgccaatattatgtttaacttttaatgtacatatacaaaatatgtatgttaactaatatacatatgtacacatgacatacatatgtgtaggacatgtatacataatatcatacatatgactctaaggtagaatacatgtcatacatatttaccagtgtcttttagcactgttcctatgttttctgagtccttcacttcagatatttaagttttagtgcccatgtcttctatacttaatcctttgatttacccaacccttaaatatgcattgtattagtttactctgctgcctatttggtttgggaacaaggaataaaaacagtattttatttggaataatgttggaatggaaaatgtttctgtttcagcttagataatatacaatctacagacttggactcttccaaaaaattaacaatatgataaaaattctaaaatgcataaggtcaggcaaggtggctgggattacgcctgtaatcccagcactttgggaggctgaagtgagtggatcacttgaggtcaggaatttgagaccagcccggccaacatggtgaaaccctgtctctgctaaaaatacaaaaattaaccaagtgtgctggtgcatgcctgtacttccagctactcgggaggcatgagaatcgcttgaacccaggaagcagagattgcagttaaccaggatcatgccactgcactctagactatgcaacagggtgagactctgtctcagaaaaaaaaaaaaaaaaaaaaaggcacagggactcttgtagattaaaagaggctaaagggatataataacaaaatgtaaccatgaaccttggtttgattatgggcagttataaaatattttgagtcattttggggaaatctgaaaaaaaactatcttcagtgatattatggacttactgtaaatttaagtgttatgatgacatttggttacatagggcagttctttattcttagaggatgcatgatgaaatatacggtagtaaaatgtcatgacacctgcaatttacattccaatggttcaggaaaaaaatctgtgtgtgtgcacacatatgtacacatagagagcaaaagaacgaaagcccacgtagcaaaatggtaattggtgaatatagctgaagggtatatgggtgtcattgtactattatttctgctcttctatagatttgaaaagtttgaaaactaggggaaaattttgtaagttgtaaaataatggactcgatgcttttatatttgcctcctagtctggggcactttctactacttcagttatgcatctgatacactaactaggtgttaactgattaaatgctcaaaaaataaaatcacaacttgtaagcaacctgtccaattgtgtagtgtattttaaaacctatggcttgaaacatagcttttaaaatctgctgtcttcctacctaagaaagtttccaagatagggtaagttataaccaatgttaaaaacacagatttttaaaaattcatttttaggaccttataaattatgtatagatttatttataaacagtttattgtatgttttaaaatgttcccccactctgtttatagaaaaacaagcacaaacagattaaaaaacaagaatggactcttaaggataccctttacaacttctctttaaaaatgagcctgactaaatgtatggatttaaacatgcttgagatccacttcttttctttctcttacctccccagtgtttttcaatattatacactactaaaccccacctttatcccaaacacttgctcaaagcaacttgacattctattcgtctcagttttgctgcactgtaacatgttaaaaccatgctgcttagaactgtagagaaaacctttctcattttctcttcaatctcttaggttgatgcaccatcacatttaattgttcaactttttaagtggtatgttgtagtgcagctgatacaggtgaagacacctctgaataaaatgcccactttctactgtggccatatacacattgcacaaatacatattcactttttattttcctgtggattgcagcatttactgatttttcaacaaacagaatatgtgacacatcctgggcacattccatcttgtcttcatcctttctctaattacagctctccatgattgcagggataaaacaagtgaatgtgtgtgcgtaggtcgttatcaaacaatccaggtaatcaaacaccagaattactgctcttggtacaatattcttctacatactcttatgtgttatattagaaaacacagctttttactattacctatataatatataggttagaaaataagattcattgtttccatatttattgccatggtctctttacagatacaacgcttttgagtgctaaaagaattattttgctggtccccaaatgtttgggttttctttgttccttagaatgattatcttagttttcagtgatggaagtcatatatgtggaattttctcagatcctaaatattttatttagttcctcatcatatgttactaaactttaaaataatattttctgcttgagagctgggttaaccaagaaagggatttgagttcaaaattgaaccaacctctgtagacagggaactgaccagctgaaaactaacatggaaataatgtgaagtgaaactgatagcagaattgaaagaaattaatttaaggacccttgacagttttcctctatttttgtttttagatatattcactctggaaatgtggagaccatttgtaaataagtgtgtgagccttggtcatggccacatttaccatggtgggggtagttaaaggaaatatttatctctttgttatatgtaaacctatactaaaaatctgtaatgagattaaacttataaaataatatttgagatcctcaggaaataggataaaagcatttattattagcatatacatagaattttgaatttatgttttaaaaaatagttaattttcaaaggttattcaaaccagtacacttcaaatgtaggtcactggctgtgtcagaatcactctttgtgtagctttcaaaatacacttattttcaagtcctgttcctagatatttattagaattaggaggtcggggtgagtttccttaatctgtatgtttgtaaaactcctaaagtgatacttctctaattatctttggggatcactgttttaaatattttctagggtatgttgttcatattactatattcatttccttagccatttaaaaaatatttattaggtagtatgtttttgttgcagataatagaatatccagttcaaactggcttaagtaataaaggggatttattggcttatatagctaaaaagtctagaagtagaatatgcttcagaaaaagtttgatttgggctccaacttgcaactaatcatgattctgaaggctctgctgtttttgtcatttctatcctcaggaggttttcctcattatattaaaatggctaacagatgagctttatattcatatatcatagtgtccagaataagaagctgtactctataattaccagcaaaagttgtgagtcacactatttgaacaccccctgaacccatcactgtacaaaacagatatggttatcctgtttggtttagacttgaccagtcagatcctacccatggagttagggtggtatcattccaatcctatcaccactacataatgggggagagcatatagatcttgaagtaataaccacaaaacctactgtaaaatattaaagggataaactaacggagcctactctaaagtaatctttgggggacttatatcttttcatatatgtaaatgaagtgcagtgtagaccagtgtttactttttagcagatgataggaggaaagaggggatgaattgtttttcatcaataacttttcctcccagtattttactgtgaaaaatttcaaacatagaatttgaaagaattgtacagtgaacacctataaacccactatctccactctattaatattttggtatattttctttttctgttgctttatcagctgttcatcttccattgtagggatcttattttttaatgcacttcaaagttactttgttatactttacccctaaacacttaaatatgcatatcattaattgagttattgatgaccatttgattaagaacctcatacatacaaagctctcttggcttaaggccttaatatgaatcagatttgtatggacgttgtaatggtaatttctgaaagaattattcaaagatagaaccaagagtgaaatatgcatttacaccttttacacatgttatgttatgccctctttataaagtttcatttgtggtatatgacaaaacgtatgtatttaaggtctcttcagtgaaagtacggaataccaaagttgttgatatgttgggcgtctttttctttaagtttgttacttacctaattagttttacttaggaaaccagttaactggcaatctgttgttatcagctagaccaaaagaaaacctcaagaaaatgcaggtttctggtaaatttattagtgtagttgacattttcccacctgcttatcagaaacaaccatgtggacactgtttgaaaatagaaagttataaaaatacttaggaaaaaattgtaaacattagataattgaatgaactgtcccagaactaaaattaaattgatacccacttagaatatagtaattcattgctatgtcttttggtattgtaaatatagttaccctgttttaacttttaaagaggatcctaaaaggctttgaattaacaagtttaaatgagagcataaaatgtagaacataaaaatcacagacttttgataaatggttattgatacattttaatttattaaatagcatttaggacatctcactttttacttctgtttttggaatgtcagctatatttccttaaggcagactgttgaatcagaatatcccattcagagctttctaactggtctgtcacactggtgtgccactaatgtgtgacaaataagctgagatagtaattttcttgcccaggggttactgccatagcctggagctgcttaatcaccctttctctttcctcagtttatctagtgtgccttagaagttgttttctgagtgtgtgtgcatgtgtttatgtatgtgtgcctcaccacagaagcaatgacttaatggtcattatagtccaactttttgtttgtaaaagttttgcggaagaaacccaacattaagctttattaaattttatttaaatctaaataagacaactatataattggatttaataaaaaatatagttttcctttttgaaattcttttttccacagtgaatagaagttcaagaaacacttttaaagttaaaaatattccatctgttttatcataaagtttcttagcttccctgttttatccatctttattgttgtaaaatttcttagcttcactgtttttcatcaaatgctatctttcctccaaagaaatcaaagtgctattacaaagtttttagctagaccctactaagacccacctttggaaaaaacatctttggagtcacttggtagcttttgtataacaactttaatgatttttgttttaccagaattttttttcattgcaagtttctctggaggaaagaattggtgttaattattgttactagtcattctacagcctttcaaacctaaagtctttctgcattcttgaacttctctcttacaatgttagaggttaccttggcctttgtcatcttatttgccctgaaaatgttatattatcccacatattattgctatgagatgtccaaaatcctcaagaactttacctttattaaggacgagattcaaagatacttttctccaagttggattccatattgcaaacatctaacctttctatctcatccagacgggtttcttcctagtagtggatttcactttttcatctaaccaaccaagggagtgagtatgacctcataccaaaattaggccccccctgcccctcgctcccgccaaaaaaaaaaaaaaacacctaaaaggacagctgagcatatgtatccaaatgggtgattcttatcaaattagtcccccttggaagtatatcagtttactgacatgcttactcagacacttcttatgtcacatatgggatttggagaatacctcctatgagaataatgattttgtttcttttatatgaatgagcattcttcctcgtgttttttttccccttatttctacattcttcctgtttcactcactctcttattctctgtttgatgtcatccttttccactttgagggtatacagacagaactgacaatggagtaagtccagagccaaggaaaatcttagggtgagatagttatgaaacagactgaattttaatggtgagtttatctttcttatattactcttttgttcttattctgtgcctttgaaatatttctttttttttttttttttttttttttgagatggagtctccctccatcgccaggctggagtgcagtggcgcaatctcggctcactgcaacctccacctcccgggttcaagcgattctcctgcgtcaacctcctgagtagctgggattacaggcgcatgctaccacatctggctaatatttgtatttttagtggagacaggggtttcaccatattggccaggctagtgtcgaactcctgacctcaagtgatcctcccgcctcggcctcccaaagtactgggattacaggcatgagccactgtgcctggccttccttcttttttcattggaagggtaggagcagttctttgaccttctacatcccagatcacaaatcaaaagtcctgattatgatgtatttgtgattgttttgtttggtacttttggtttctttcttttttgttccttttttcttcctttcctcctctttattggattnnnnnnnnnnnnnnnnnnnnctggagtgcagtggcgcaatctcggctcactgcaacctccacctcccgggttcaagcgattctcctgcgtcaacctcctgagtagctgggattacaggcgcctgccaccatgcctggctagtttttgtatttttagtagagacagcgtttcaccatgttggccaggatggtctcgatctcttgacctcgtgatccgcctgcctcggcctcccaaagtgctgggatttcaggcatgagccaccgcgcctggcccaaaatatttcattttaaaaatgggtgattaaaaacaagaggcagacataagcgcatgtaaatggtattggacagcttgtgtgtttaatatgagtcattagcttagtgccattaatgcaagtagctgtagcatttcatcttcaattctttatatattgtagttcccatttaaattatcagaggctaaaataaatattaaagtaaatacatagacttttgtaacaaatccaagaaagaaaatttgcttgattctttgcataaatctctatctgcttaattgtttctcatgttcagaatgctataaattaaggtgaaaaatgtattgaccatctgtatgactcttaggcaaccagttcactcaatctttcatttacgtttcctcatctatgaagtaggaataataatattacctgtcacacaggatcattgtgatgattacacataagcagcttagaaaactcctggcacattataagtgccagtatttctccaccagagctccacaagagaattaaactctacagaaaatggtttgagtaaactacattgactcctgaacaacacagggattaagggtgctgatccctgcacagtggaaaatctatgtataacttttgactcccccaaaacttaactactaagagcttacttttgactagaagccttattgataacataaacagttgatgaacacatttcgtatgttacatgcatcatagactgtattcttaaaataagctagaaaaaagaaaatgttattaagaaaatcataaggaagagaaaatatattattcattaaatggaagtggatcatggcgacagtcttcattcttatcttcacattgattaggctgaggaggaggaggaagagaaggggttgtcttgctgtctcagggtggcagaggcagacgaaagtccacatatttgtggacctgcacagttcaaagccatgttatgggtcaactgtattttctcagttcttccaaggatggtacctggtagtactctagatgcacaggcatgaaatcatacacatacaatgatgctttagacgttagggcttaatcctttgggaatctcaaatgagaagggctcataagtgttgtaactgttcaatatataatagctattattattttggttgcaagtggcaaaaatctgtatttttttctttttcttttttcctttttttttttttttagataggtttttgctgtctcccaggctggagtgtagcgacatgaacacaactcactgcagcttcaacctcacagactcaagcaatccgcccgccttaccctccctggtagctgggaccacaggtgcccatcaccatgcccagctaattttttttaatgtttttgtagagacagggtcttgccatgttgcccaggctggttttgaactcgtgggctcaagcagtcttccaccttggcctctgaaagtgctaggaatacagtcataagccaccacgcccagccagaaatttatttttaaactggtttaaataataaagagactttattgttccatgtaaatgagaaaacagggaaggcctcagagattatttgattaggactctgacttagtatctctgttagttattctgttagttcagccttttctctggcagttgggtcaaactaatatttctaaccaaattttcaaaagaataatatatatttttcctaaatatgggcttgtggctaaaaagcataaggtgtattttgtatatattttagaagcctagcatatttggaatatagtaattgttaaataagacagttttggcttagataactgtatctgatattagtatgtgtaaatatgcagttatgcattgcttaactagaatatgttctgagaaattcatacttaggcaatgtcatcagtgtgtgaatcatagagtgtgcttacacaaacccagatggtatagcctactactcacctaggctatatggtatagcctatttctcctaggctacaaacctatacaacatgttactctactgaatactgtaggcggttgtaacacaatggtcagaagttgtgtatctaaacatagaagaggtacagtaaaaatatgatataaaagatttaaaatggtacacctgtatagagcatggtaccatgaatggagcttgcaggactgaaagttgctttgggtgagtcagtgagtgaatggcctacattactgcacactactgtagactttataaacacagtacagttaatctatactgtaaatttattttctttttcttcaataataaattaaccttagcttagtgtaactttttcactttataaacttaattttttttaactttttgactcttataataacacttagtttaaatatattgtatggctgtacaaaaatatcttctttctctgtgtctttattctataagctgtttttttaactctttaaacttttttattaaaaacttaggcacatggccgagcgtggtggctcacgcctgtaaatcccagcactttgggaggccaaggcgggtgggcggaacacttgaggccaggagttcaagaccagactggccaatgtggtgaaaccccgtctctaataaaaatataaaaattagctaggcatggtggtgtgcgtctgtagtcccagctactcagaaggctgaggcacgagaatcgcttgaacttgggaggtggaggttgcagtgagccgagattgtgccattgcaccccagcctggacagaggggcactctgcctcaaaaaaaaaaaaaaaaaaaaaaaagcaggcacacacattattctctgcttacatagggtcaagatcatcaggatcactgtcttctacctctacatcttgtcccactggaagatcttcaggggcaatagtattacacatggagctgtcatctcctatgaggaacaatgctttcttctggaatatctcttgtaggaccaggctgaagcttacagttaatttttcttgtataaataaaaagaatacactaaaataataaaaaatatagtatgttaaatacataaatctgtaacatagtcatttattattgtcaattattatccactgtgcataatcgtatatgccatacatttatacaactggcagcacagtagatttctttacaccagcaccaccacaaacacgagtaatgtgttttactatgacattgtacaactacaatgtcactaggcattacgaatttcttattataatcttatgggaccatcatcatgtattcattccgtcattgaccaaaacatcattatgtggaacatgactgcataagaaaaaatttttaagtctatagaagctgtagttgggcttttatatctatgcaaatattaattacactaaaccacttcagcaggccatattctagtaaaaggtttttaagacagattgtcaaaagaaagagaacaaagcaaaacaaacaaaaaacagggagtttttaggaataagtcgatgaaaggagttgaagaacaaactaagggtagttagagatgcaatttgggtagggaggacagttaacacagaacagcagtgttgttggaaagatgcttgaccctataggagtgctacccactctgtcgctagaacatttcttttttttttttttttttttgctcgggctggaatgcagtggcgcaatctcagctcactgcaacctgcgcctcccaggttcaagcgattctcctgcctcagcctcctgagtagctgggattacaggcacacactaccacacccggctaatcgtttgtatttttagtagagacagggtttcaccatgttggccaggctggtcttgaattcctgacctcaggtgatccacctgcctcggcctcctgaagtgctgggattacaggcatgagccaccgcgcctggcctgttgctagaacagttctatttggtacttcctgccaatgatgttagtatacagtatgtaggatgaagttggagggtagagttgaccagtcagaggactaagtcagaggatgttcaaggtcccttctgactgtgattttaaatatgggaggaatctccacattgacaaatgcttttcacagcaacccatttctctcaaggtaattgtaagacacgttttaaacctgcttttaaaaaaacctgtaaatacttggatattactaaggtaacttttacaggaatttcaaagctctctaaagttagaatgtgtatctttctgctccatatgtactgatattgaatgatcttcaagttgtattattgagagataatagcaaagtacagagtagcatacatagtgtctgtagtatggataaacgtgtgcatgtattcatgtgtgtttgattatatatgtgtaaaatatcgtggaaagactacaccaaaaaactgttaacaattgttgtctccatgaaaggaaactgggtgattggcaactgttaaaagtaagcccatactcttttggtatcaggagttactcagtagtttcagtagatggctccggatcagagctgcttaacattttaagcatcaacacatggcttcctaattataaataatctggagacatcaaaaacaattctagtttcactgtttaataagttctttatctaggccaggcatggtggctcacgctgtaatctcagcactttgggaggccaaggtgggcggatcacctgaggtcaggggttcgaaaccagcctggccaacatggcaaaaccctgtctctactaaaaatacaaaaattagccaggcgcagtgctgggcacctgtaatcccagctactcaggaggctgaggcaggagaattgcttgaacccaggtggcagaggttgcaatgagccgaaatcgcgccattgcactccagcctgggtgacagcgagagtccatctcaaaaaaaaaaaaaaaatctttatctgaaaaataatttatgttcgttttcaggtggtataagaaaaagtgcctctcttcaccaatctatatccctagaaaatagtcccagtgctcacctgaaacaaactcttaggatcagaagcagcttttaatcagctgtatctgggacttccagtccacatcgagagctaattaaccagaggagactcaaagttgtcctcccctttttagagtgatttggacaactttttcttttttttccccccttttctgttccccaagcaaaagcagattcccaagaatgaaagaatatgggaagcttgccatcttcttgactaagtattgaatcccttacggtatgaatagaaaatcatctgccctcaaaataactagataaattactttgaaattctagggtaattttttcatcagtagatccattcaattactgatttctgagactctttcaaaagatatattttataaattatatttattataaacaacctttattaagcatttttaaagaaataatcacacctgaggtcagaagtttgcgaccagcctgaccagcatggagaaaccctgtgtctactaaaaatacaaaattagccaggcgtggtggcacatgcctgttaatcccagctactctagaggctgaggcaagagaattgcttgaacccgggaggcagaggttgcggtgagccgagatggcaccgttgcactccatccagcctgggcaacaagaacgaaactctgtttctaaataaataaattaattaattaattaaagcatagttcattatgaattgtttgtcagaggtagtttgagaatggatttgttcagaattcaggtgattaaagggtatgtgcctatgcttttcctataccttgaactatttgagtacatgctgtgaaaaattgcctcttgtttttgctttgttgttttgtcacaaaacagaaagaagaaggaaagcttcaaggacagcttaacaagtctgattctaaccagtatattggggaactgaaagatcagatagcagagctgaatcatgaggtaagtgataaattttgatcttcacatattgctttcttccttcctctgtattgtaacaacactttattactggttataagactgacactttcatgctgaatatcttctgtgaattattggttataattaataacatttttgaaaattgtctttttagcaaggatcttctgttctaatattggggatttatttcccttaacctcattagcatgacctagaatgataaattaatattttcatggcaaatattttatttttttattgtggtgtaaaaactcttgatagtttgcatagatgtcaaagttactttaactaaactaaaattttgcttatacctatagaatagatttgtggtatttaccgttgcatgcagaaggaagtctttttactcttgtcttcttttaccgctcatgatggtattactgagattgcaaaaaaggatacttgcctaatatcagttaacagatttcttagtatctgaatgctttttaaactggtactaccttgaatctgtgagattcaactcacaaaattttcagttttaccaagtactatactgagtaatttaaagtatttagtatgttttgattagagagatatgttaatgtggctcgaggtcaattttcttatcctttattattttctgttttaatgataatatttggctaaacactaatggaataccatctttcttgttttgaattatttataaaataatgtttattcacagtgatgagatttgagagggtagtataacctttatttgtttaaaaagaagaagaaagagaaattttgaccactagatgaatttaaacctcacaggaaaaagtttagacgttaccctttcctggtattacacccttcagttaaagtctgtatgttttgggtaatacctcctggaggtagtcagtctaagagttaattctaaatgaagaagaaacaaaacataaacaaaaacagtaaatcttagatgtggctcagtttaatttgttttgaaatttggggaatcattcctgtaaatatcaattttcagccatgataacatatgagggattcaggatcttacatataatctttacctatttgtgtgtatttattataatttttttttttagacggagtctcgctctgtcggccaggctggagtgcagtggtgcaatctctgctcactgcaagctccgcctcccaggttcatgccattcttctgcctcagccttctgagtagctgggactacaggcgcccgccaccaggctggctaattttttgtatttttttagtagagacggggtttcactgtgttagccaggatggtcctgatctcctgacctcatgatctgcccgtctcagcctcccaaagtgctgggattacaggcatgagccactgcacctggcctattataatatttttaaatcgatagccatagtgtgaaagaacaagttacaattaagtgtgttgtagaaatctttattcttttgagaaccccaggaattatttatgttcaaaaggtgttctcagaggaaattgtgattaaaataaagcaacctcccatttaaaattttgatgtctcattataaggaagctttaatgttgctgaaacaagaaagttacgtatagattgactttatttctaaaactaatgtaaaagtcagtcaacaaacattaactttccctgtcatatgctttgactaaaaataatgatattctgaccaggtgtgggcgcacgcctataatcccagcactttgggaggctgaagcaggcagatcacttgaggtcaggagtttgagaccagcccatccaacatggtgaaacccctatctctactaaaaatacaaaaattagccaggcatggtggtgtgtgcctgtaacctagctactggggaggctggggcaggagaatcgcttgaacctgtgaggcggaggttgcagtgagctgagatcatgccactgcacctccaggcagcagagtgagactcagatagatagatagatagatagatagatagatagatagatagatagatagatagataggatagattagatagatagatagatagatagatagatagatagatagatagatagtctcatcaggactgccagaaaataactcacatgaagtttaactttaatgtcagttttttacgtgtggcctaagaaagcagtcttaccttatacaaacatgaaaagaaaattaatcaacagagtagaattttctactgttaaaattaaaagctagattgtgcagatttaaagagtggaaaccaaactgcatctttttgaaaagaaaggaaaaaaaacctttaaagcatttttatttattaatacccttccttgttgcagatccaattaaggaaatttgcaactgctacaaaataataaactacaattttgggagaaaaaggaaagaaaaaaactgtagaaatataatatggaagcatgaataagaccattataaaaatgcttaccataaaattatctctttcctgtaagtgggcctcagatttggctctaaggcttttagcagccaacgcaaaagaaaacctggtcacttaaacatttcagagtgtctatgtgatgaaaacagaccaattagctagaagagccacatctattcctgatactaagattaaataacaagttctccactgcttcctcacaaaggagacctagtgagttccctggttattatccttaacatttgaatggcttcataatcatgaaagttagataaagaacagaagctttaaaaaaaaaaaaaaagcttttgtaggctgggtgcaatggctcatgcctgtaatcccagcactttgggagaccgaggttggagggtcactttagcccaggagttcgagaccagcccgagcaatatagggagaccccatctctattaaaaataataataataaatgccaggcctggtggcatgcacctgtggccccagccactccagtggccgaggcaggaggatcacttgaacccaggaggtcaaggctgcagtgaaccgtgatcactgaaacgtgatcaccactgcactccagcctgggtgtcaaagcaagaccctgtctcaaaaaaaaaagaaaaaaaagttttgtatagcagcatagcatacagagacgtgtccaagtcaaaagtttacagctcaataaattatcacaaaatgatcacactcatgtaggtactacctaggtccaagaaatagacccaagagccctgttcatactctttcaacccgtactctctcccttctactcaaaggtaaccatgatctcagacttctaatacagtagtttaactttttgaactttatataaatggattcttgcagtatgttttcttttgtgtcttgcttgttttgctcaacattgtttgtgagattttactttgtcattttaaaatgtagctgtaggttgttcattttcatcactgtgtaattttcctttgcataaatataccatgatttattcatctactgtgttggtgaacatttggattatttccagttggtctgttaagaacattgctttaagtgatttatgccagtttatactgtctataagcagtgaagaaagttcttactgttctacatcctcatcaacatgtggaattgtcagtctttcttattttagccattctgtgactatgaagagatttctcattatggttttaatgtgcatttccctgattattaatgagattgagtacttttcccccagtatatagaacaatgatggcatgtagtaggtactatgtgaaaatgtttctaatgaaaaaatgatgtttgtgaaaggttttgcagatgaggtcacatataagttgcatgggaatgccaagaagctttttttttttttttttttttttttgagagggagtcttgctctgtctcccaggctggagtgcagtggtgcgatcttggctcactgcaacctctgcctcccgggttcaagcaattctcctgcctcagcctcccgagtagctagggttacaggcacacaccaccatgcctggctaatttttgcatttttttagtagagacggagtttcaccatgttgaccaggctggtctcgaactcctaaccttgtgatccgcctgcctcagcctcccaaagtgctgggattacaggcatgagccaccatgcccagccagaatcctcttaatgtgtgaaaatcagtggaaagagtattccagacagaagaaacaactagcccaaagaccctagaagaaaatgaaatggttattttgagaaacaatgctagtgtggctggagtatagtgaagggtaggaaaaatggtataagataaaattagagaggcaagtgaggtcagattgcaattggtcctctgtatccgtggattttgcatcagtggattcaaccaatcgtggatcaaaaatattttttaaagactattgcatctgtatctgtactgaacatctacaaattttattccttatcattattccctaaacaatacagtataacagtttatattgcattaacattgtattaggtattataagttatctagagatgatttgaagtatacaggaagtcaggcataggttatatgcaaatatgccatttgatataagggacttgtgcatccatgggttttagtatccttgggacatcctggacccattctcccacagatactgagggacaactgtatagtgctttgtaaaccacggtgtatagtggaaagcctttggatgtttgttgttgttgttaggggtttttttggttggtgttgtttgggtttttttgttttgttttgttttgccctttttttttttttttagagatgggggtctcactatgttgctcaggctggcctctgactcctgggctcaagtgatccttccaccttaacttcctgagtagctgggactacagggctgcaccaccatgcctgccttctttggatggtttcatacagaaaattttataatttcatttgctctgcctgctgtacagtgaactgattgtagaagagaaagagtgagaacagggaaattcatcaggagtctgttacaatggtccagataagatcaaacatggcttagaaggatggaagaagtggaaatgtaatgcggctgtgttagaagtatgtttatctcataacaaaaaacattcattggctccagagagttttggcttgagtaattgagtgaatgattggttggtgccattgaccagcatagagaaaggtaaacaagagctctatttttatgctaagatttgtagtaaggttgagattccttactgcaaatgaagatatcagataggcagtggatatgagtctgaaattctgaagagaggtcagggctaaaaataattgtagccatcactggcatgtgaatggcgttcatatataaagagaagggtgtccaggagcaagttctgaagttctcccaacctttagggtcaagagagccaggagaggaccaaaaccaccagggagataggcgggaaactggagagtatgaagacacaggagtcccagaaggaggaagggatcatttcagcgtagttatttaaatcagattttaaacttccctgatccttttgaagaataaacttattaagacagattttttggccaggcacggaggcccatgcctataatcccagcactttgggaggctgaagcaggtggatcacttgaggtcaggagtttgagactagcctggccaacatggagaaaccctgtctctacaaataaataaataaataaatacaaaaattggctgggcgtggtggtgcgcgcctgtagtcccagctacttgggaagctgaggtgggaggattgcttgagcctgggaaccagaggttgcagtgagcagagatcacaccactgcaccccagcctgggcgacacagtgagatcctgtctcaagaaaaaaaaaaaaagttttcttcggaattttttatgatttgtcagagaacaatggatgatttaagaaagaacttgaaaggagaaatgttctatctctaaatactactgactgaaacacccttcctgaagaaattagagaaacagcccttcatggtggctcatgcctgttatcccagcactctgagaggctgcggcaggcagatcatctaaggtcaggagtttgagactagcctggccaacatggctaaaccccgtctctactaaaaataaataaataaataatacaaaaattagcaggacatggtggtgcgtgcctgtaaccccagctactcaggaagctgaagcacgagaatggcttaaacctgggaggcggaggttgcagtgagccaagatctcaccactgcactccagcctgggccacagagactccgtctcaaaaaaacaaaaaaagaaaaagaaaaaagagaaatgtaagctatttcaagataaagctggaaaaaaaaaagaactattttggtatgctataaacaaaataaaactcaggtagataaaaccaacttactttgtaggaataatcattgtattggtttctactacccagaaggtcttctgtcatcctgtcttttttgttgggaaggcaatttttctaagttaaattatgtgtcacaggaagctttttttaagtaggtgattaggaatttgagtaaataaaaagaaatctaaataaagcctttactgaagtttgacttagaaaatgtttatatagacaggaatggtagtgtgggccttgtagttctggttacttgggagactgaggcaggaggcttgctctgaacccaggagtttgaggttgcagtgagctaagatcatgccactgcactccagcctaggtgacagtgagaccctaactctaaaaaaaaaataaaagggtaagaaaaaaattatgtgaatattccttaagtttttaaattctgatatctgtttatataaacctgagctatggatttaaatatatatcaaaaagtatttttaatgtcctagatattcttaatgtagtttttaatacatgtactcattttgttactaaactggaatttttgaaataaggaactttaacaatcagatgacaatacattaagtcctcacttaacattgtcagtaggttcttggaaactgagacttcagagtgaaagacatataacatgtccatgaataatgtcgttttgtttatgatgatgaggggaaaagtttggtttctttatatgtcatcttacttaaaatgacagtttccaagaacctatggaaaactttaagtgagaacttactatatgtcctcttatatttctttggatttttttttccttatgcttgtatttttctatttaaagcagtggctcacgcctgtagtcccaacactttgggaagccgaggcgggtgaatcacaaggtcaggagtttgagcccaggctggccaacatggtgaaaccccgtctctactaaaaatacaaaaattagccaggcatggtggtgtgcacctgtaatctcagctactggggaggctgtggcaggagaatcgcttgaacccaggaggcggaggttgcagtgagccaagatcacaccactgcactccaggctgggggacagaacaagacttcatctcagaaaaaaaaaaaaaagaaagaaagaaaaaagtggttaataagatctttttaaggctcattcagcattgctcttcatctagggattaaaactaaaatactaaaggtagaaaagaacttagtcatctggttctgtagttgttggcagctattttttttctttatttcatactgaatgatactgttttttggtttatttaacttcatgcttattcctttttttttttttttttttgagacgagtttcannnnnnnnnnnnnnnnnnnncagtggcacagtctcggctcactgcaacctccacctcctgggttcgagtgattctcctgcctcagcctcctaagtagctgggactacaggcacatgccgccacacctggttaattttttgtatcttagcagacacagggtttcaccgtgttgcccaggctggtcttgaactcctgagctcaggcagtctgtgcccctcggcctcccaaagtgctaggattacaagcatgagccaccacgcccggccatgcttattcttatttctatttctaccagtctttatttccttttaggtaacacaaagttccaagtatgttacctagtttacagagtggtactcaagaagagaattaacattcttactgtaaaacttcattgataacaatagtctacttctagaaacagaaataagaattaaaaacagtgctatctatttgtactggtgagtgaattttaacttttaagaaaattttaatgtttaagaagaacttcagtgtatggagttacaagctatcctgaatatttttataatagaaagtattagttttcccagtgtggcagcttcttaataaaagaaattattcccttaaatttgttctttctctaattagagcagtgtaaagtaccatgcagaagtttcaggatctcatacaaccaagtaaatagggtttttatccccctacccagaaggtcccatgtagataatgaaagattgtatttgccattctgtgaaaattgctttaagcccatcaaatgcatacactgctttttaatcttacagcctccacttatattttaaaaacccattcttttctttctttctttcttttttctggagacaaggtcttgctctgtggcccagctggagtgcagtggtgccatcaccactcactgcagcctcaacctgctgggctcaagtgatcctccgacctcagcctcctgagtagctgggactacaggtgtgcgagactgcacctgggttggttggtttgtttttgtttttgtttttgtagagacagggtctcactgtgttgccaaggctggtctggaactcctgggctcaagggatctccctgtcttggcctctgaaagtgctgggattacaggcatcaactactgtgcccagcaaaaactcattcttaatgacttctttaaatgagtagctattactccttttcctcttatatgttctgttttatcttggataagcagtttatcttatttaaagtccattttagaaattattgtgcagatttttatatttggaacaatagcgctatgtaaaatacttaaagctgagatttaagaatcatattttttaaaccagaagtgttcttaaaatttatcttgtttttcatttgataaatgaggaagctgaggtcctggttaagggacttacccaaagttacaaagctagttcgtagctgagatggaactcatgcctgggcattctaacttctgatctgctgcatcccactgccctaccatgatcctgctggcccatttaatggcgacatattaaacatagtaggagttctataagcatttgtttaattgaattaaattgaattgcttctctcagatgagaacctaacatctagttagtaaaaatctactcatagctcatattctttatttttctttctgtagcagcttctgcacttctattctatctaagactgcagaatttgtccaacttgacattcagattctgcttcaatttccatttggtgctactagcattgtagcttttaaatatttgatgactttctgaaaacaggcagttttcctagccatgtttgatgttttgagaaacacagaacttgacaaaaagtcaatccaattcatatatgcctcttatttaggaaatacaagcttattcaaagacacaaattagctttgctgttaaaagcattctgtttgaagagtttgaagtttaactggtggcaaacttccaccaatgtttccagattaatttttttaaatctccaaggcaatatgtttctccatgtatttcttgccatttaaaagaatgtataacatactgtagtctgggaagaactgtaataatcacatacaggggcagggcgtggtggctcacacctgtgattccaccactatgtgagaccgaggttggctgattgcatgagcccaggagtttgagaccaacttgggcaatatggcaaaaccctctaccaaaaaaatacaaaaattggctgggcacggtggctcacgcctgtaatcccagcactttgggaggccgaggcagagggatcacaagatcaggagttcgagaacagcctgaccaacatggagaaagcctgtctctactaaaaatacaaaaattagccgggcgtggtggtgcacgcctgtaatcccagctactggagaggctgaggcaggagaatcgcttgaacccaggaggcagaggttgcagcgagccgagattgtgccactgcactccagcctgggtggcagagtgagactccatctcaaaaaaaaaaaaaaaaaaaaaaattggccaggtgtggtggcatgcccctatagttccagctacttgggaggctgagatgggaagatctcttgagcctgggaggcagaggttgcagtgagccgagattgtaccactgcgttccagcctgggtgacagagcgaaaccctgtctcaaaataaataaataaataaataatcccacacaggataccttactttattcaagactttcagaccacttttcagttttatgttatattcataaagtataattggtgttctacccattttatgcatctgtgtatgtaattcctgcaatgggtaaaaaaaaaaattttaacttgttaatgaaaacatgtgcctctcatgatagtaatttcattaagaaactggggttaattaatgaaaacatgaacacaaagatctagtaggagaggggtaagatgctagataaggaaaccacctagaaaagaaaaaaatcgcaattaaaaatcaggtgaggaaaaatattcgaacttaaaaatgtaagaaaccaagtaaggaagtctcttaggaatattaactaaggtagggtatgcctccagagggtttgttaagagatttctaggaaaaaattcgagtgcgcagccaacttaaagaatacagaatcaacgtaaaacaagggatttgaatctgatactcagaggaccaaataaatatcttcaagggatatatcacactggtcaagaaacagaaccaggtggaattgtaaagtcagtcttggatattaagctgcattagatggaattttttctaacattgtcctagacacaatgagaagagtggccctactctcagggaacttttagtttggtggggaaaagtggaaaagttaatttgataaagactatgtggttggcactgatagagagtatttaatagttcagaaatgggagataacacagcacttaatttcatttattctaattaatggttgttatatcctctctgatgttcagagtcaagctgaattgtgaatttcttgacagcaaagattatcttattcagccttatatttcttagggtcttttgaaagtcctggcacagtagtctgaactcatgaattcagtcagttcccttggtgttcatattgtcccaaatttggccagtgggaactctttgaagctggctccagtgtcttttttttttttttttttccctacagccccattagtcctcgaacacatctgtgtttcctggcactagatggcaagtatttttaatagtactttacatcacatgggtagagctagatttcaaatgtagccaaaaaactgaaaaactgtttattaatacttatcagtaaatttctgaagagatggtcccaacaattactctttgacaattagaatggaaatataaatcatgagaaaccacttcaagggaaactggaagtcaagtgtttatgaaaaataaaggcagatggtgataagcattttttgaaggaaatggagctaactatcaagcctgtagtgacaggttttatagttttttacagcaattcttaagcagatttaattcagtaagggtgaaagagacttctatttcttttagcattcccaggaagagaccatactggtaacatactcttactaggtcgcagacatgagaaaatgaaatataaacatctaaaaccattttaattatatctaaacttttagcatgactgtagtattaagcatatttatcatttgagtgatactaataggatgtgctcaaatgtgtcattcaacttgatatatgggatgctaaaatgagctacagttttaaaatcttgtgaacttactctggttttagggcttgagtgttcatttttaaatttttttccattcattcaaagctgattattcctactcttcatctaactcccattcttttcttccattatcatgtcagtacttctaagcatatccataaaatggagaagggggaggaatagaaattcatgcagttgccgagcacagtggctcacgcctgtaatcccagcacttagggaaggcagaggcgggtggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaggttcgcttggtgcagactgattcaattcctggatatccttgttaactttctgtctcgttaatctgtctaatgttgacagtggggtgttaaagtctctcattattattgtgtgggagtctaagtctctttgtaggtctctaaggacttgctttatgaatctgggtgctcctgtattgggtgatacgtgtttaggatagttagctcttcttgttgaattgatccctttaccattatgtaatggccttctttgtctcttttgatctttgttggtttaaagtctgttatttatttattttttttgagatggagtcttgctctgttgcccaggctggagtgcagtggcgtgatctcggctcactgcaacctccgcctcccggattcaagcaattctcctgcctcagcctcctgagtagctggtattacatgcgtgtgccaccatgcccggttaattttatatttttagtagagacggggtttcactatgttggccaggctggtcttgaactcctgaccttgtgatccacccgcctcggtctcccaaagtgctgggattacaggtgtgaaccaccgcgcccagcctattttttttcatttggtaagtttagttttgtttccagattttgtgtgtctttgttctccgtcatactacaggtgattgagaaactatcatctttataacagtggacttcagtcaggggacctggattctagttctgtctttgtcactgattagctgggtgaccttaggatgccaattcacttcgtatatccatttaatcagtgaatatttgaacatcttttagttcacacgcatgccttaggccatgcctcagtttcttgatcacaaagcagttatactaaatggtacttaaagccccttccatcccagtgctgtgctaggtgtataaaagtcatagttccagttgatgagtttagactgataaggaaaagcagttcgtgtgggcagtactgtagtagaaccacacggcaccatggcctagaaacatgtcagaaaatctctgatcatggggctgcctaaatcgtgtattagagaaggagtagaagattgccaggaaaaggagaatagaggatatttcaagcagagaggcgtatatgcagaggcttggagtcaagtaaagatttcataaaggagactgagaaggattagtatgaaaggtaggaggaaaatgagtagagaggggcactcctgaagccaaagtgagagagagacttgcactgctcagtttgtttttagagtgtggtaccgaaaataacattcatagagattgatctaatggctgaaagtaaagcttttttaatcaaacgaggaaatctataaaatataattactttcttgattgtgtttttaaaaatcgtttgggattgtgttacttctggagtcttggtccatatgaggtgtgtttcagagccaatctgaatactgttatccacgaagctacccaatacatcatgcttcttttttaattctctatgttcttaaatataaaagtcttatttctttgactataccatgatttttgaaatatagtaattcactttaaaaaccttttttttttttttacatcaagtagtttgattttaaaatactagtttttaaaagaaacaggccaggcacaatggcctatagtctcagcactttgggaggccgagacaggaggatcacttgaggccaggagttcaagaccagcatgggcaacaaagcaagaccctgtctctcttttaaaaaattaattaataatgttatttttaaaaataaacaataacagtattgacagtttttcaaattgaaaatgtgctccactaatttactaagtgtcaattaaagaggaattgataaaagatgaatatgtagctctctcagatttacaaaaactaaaattttaaattgtggttgggagtctgtagtacatacagtaaatcatgtgcttcttatgaaccatatcttacagatgcaggtggacacgagatagtcagattttcactccccacaagctggacagctagaaatgtcatgccaatagtacgtgtcaaagacttagtgctactttgctgcctgtctgatttaagttattgtggtcagtctgaggaacctgtgatatgataagatagcattcatgaggtcatgtggtttgcaagtgcccaatcttgactgagcagcctgtgagcacctcaggaggaggaagagagggatactaactttatttgcaagcttatttgggttcagtggcagaatagtgtgggtatgtggctatatgtttatattacatattttaaaaattatttttctatcaggagttataatttctgaaaaaaagtgaatactacaaatgcattcatctccttctacttattaatatttcagtctaaaccattaaactttttattgcaaatattttcctacaacttcattttaaattttaaatgaagttgtaggaggtcatcatatgtcttttctgttgaggaaaaaactggatgtagaagatttatgttgttggtgaatattttttaaatatattaaaagttatttctacattttctaattagaaaattacttattttcaatctggtatcctttccttagaaacatacaaaatgctgtctgattttatctgtataacagctttactgagacattatttacatatgatacaatgcacccacgtaaagtttacaattcagtggtttttaatatagtcacagttatgcagctatcatcacagtcaattctagaacattatctctccaaaaagaaatcctatgctcatttagcttgtcactccctatttctctccaagccttattcccccaaccctaggcaacccactaatctactttctgtctctacacatttcccaattctggacatttaatataaatggaatcatagaacctgtggttttctgtgactggctttttcacttagtataatgttttcaaggctcattcatgtcgtagcatgtgtcagtgcttttatttatttttgtcacctaataatgttctactgtatggataaacaggcatacctggctttattatgctttgctttattgcgcctcaataaatggttgttatatcctactgtgtttttacaaagtgaaggtttgtcgcaatcctgcattgagcaagtctttcaatgccgtttttccaacagcgtgtgctcacttcatgtctctgtgtcatattttggtaattttcacaattttttaaactttttcactattataccttctggtgatctgtgatcattgatcttcgatgttgctattgtaattgtttttgggtgccacaaattgcactcatatagtcaaaagccagaaatgattaagctgtgaggcaggcatgttgaaagctgagatagcctgaaagctaggtctgttgcaccaaacagttagccaagttgtgattgcaaaggaagagttcttgaaggaaattaaagttactactccactgaaaacacaaatgataagaaagcaaagcagcctcattgctgatatggagaaagtttgagtgatctggatagaagatcaagccagccacaacattctcttaagccaaagcctaatccagtgcaaggccataactctcttcaattctttgaaggctgagagaagtgaggaagctgcagaaggaaagtgggaggctaacagaggttggttcatgaggtttaaggaaagaagccatttccgtcacataaaagtacaaggtgaagtagcaagtgctgatgtagaaactgcagcaagttatccagaagatctagctaagatcgttgatgaaggaggccaccccaaacaacagattttgaatgtagatgcaacagtcttataccggaggaagatgccctctatggctttcctagcgacagagaagtcaatatctggcttcaaagcttcaaatggctctctcgttagggcctaatgcagctgttgactttaagttgaagccaagtgcacatttaccattctgaaaaccctagggttcttaagaattatgctaaatctactttgcctgtgctctgtaaatgaaaaaacaaagcctggatgactgcacatctcattacagcatggtaaaataaatattttaagcccactgttgaaacctactgctcagaaaaaatgatttccttccaaaatattactgctcagaaacaatgcaactagtcacccaagagctctgatgcagatgtacatggtgattaatgttgttttcatgctgctaacgaaacattcattctgcagcccgtggatcaaggagtaatttcaactttcaagtcttattatttaagacatcatttcataaggctccattacataaaagtacaaggtgaagcagcaagtgctgatgtagaagcagcaggttatccagaagacatatagtgccatatatagtgattcctctaatggatttgggcaaagtaaattgaaatcctccgcaaagggttcaccattctagatgtcgttaagaacatttgtgattcatgggaggaggtcaaaatatcaacattaacaggagtttggaagaagttgattccaaccgtttgagggattgaagacttcagtggaggaagtcactgcagatgtagtggaaagagcaagaaaactagaattagtaatgtagtagagcctgaagatgtgcctgaattgctgcaatctcatgatcaaacttgaatggacgaggagttgcttcttagggatgagcaaaaaaaaaaagtggtttcttgagctagaatcttctcctggtaaagatactgtgaacattgttgagatggcaacaaaggatttagaatattccgtaaacttagttgataaagcagtggcagggtttgagagcatttactccaattttgaaagaagttctactgtgagtaaaatgctatcaaacagcatctaatgctacagagaaatacttcatgcaaggccgagtgaggaagtgcagcaaactttattgttgtcttactttaagaaattgccacaaccaccccaaccttcagtaactggccagcctgctgccaccagcatcaaggcaagaccctccaccagcaaaaagatccattacttgctgaccactcaggtgatcattagcattttttaggagtaaaccatttttaattaaggtatatacattgtttttaaacatatactgttgcacacttaacagactacagtataatgtaaagataacttttatatgcactgggaaacaaaattcatgtgactcgctttattctgatatttgtatttatccattcatcagttgatagatatttgctttattcccactttttggctatcataaataatattattttgagcattcatttacaagtttccatataaacgtatgttttcattggtctgagtatatgcgtagtaatggaattactgggtcatatggtaactgtatgtttaactatttgaggaactgccctactgttttccaaagtagcagtaccagtttacattcccaccagctgtgtatgagtgttttgatttatccacattcttactaacatttattatttattttttcgattaagtagtatctcattatggttttgatgtacattcctggtggctaatgatattgagcatgttttcatatgcttattggccatttatagcttcttcagagaaatgtcttatttagatccttcgcctatttttaaattggattgtctttttataattgagttgcaagagttctttacatattctaaatatgtgttccttatcagatacattatttctgatttttaaatatttttcttcactatattttttaaactgaaacaactatatgactagaatgattttcaggctttcttctatggaacactaaaagtgagagtggttgactttatagattaagcttctgcttttttgtttatttgttttttgtttttttgagacagagtctttctctgtcactcaggctggagtgcagtggcacgatctcagctcactgcaacctccgcctcccggggccaagcaattctcctgcctcaggctcccaagtagcttggattacaggtgcctgccaccacgcctggctaatttttgtatttttagtagaggcggggtttcaccatgttggccaggctgtactcaaactcctgacctcaggtgatcctcccgcctcggcctcccaaagtgctgggattacagacatgagccactgtgcctggccaagcttctgtttttataggaaaaggaaatgagacttacggaaaaattcattgtcttagatatgacattaaaggcacaagcagcagagaagaaaatagataagctgaacatcatcaaaatttaaaacttttgtgcttcaaagatcaccatcaagaaagtgaaaagacaacctagagaatggaagaaaaaaatcaaatcatttacctgataaggggcctgtatctagaatatataaagaactcttacaattcaattataaaaagataacccagttataaaatggataaaggatctgaatagactgttttccaaaaatgatataccagatggccagtggacatgagaaaatatgcccaacatcagtgatcaagggaatgcaaaccaaaatgacagtgagattccacttcacacttactaggatggctataataaaacagataataaaaatgttgcaaggatgtagaaaaattggaaccctcatacacagctgatagaaaggtaaaatggtacagccactttgaaaacagtatatagcaggtcctcaaatggtaaacatagagttgctatatgacctagcagttccactcctgggtatatacccaagtaacatgaaaacatgtctacactaagacatctgcataaatgttcatagcagcattattaataatatttagagagtagaaacaactcagatgtcaatcatctgatgactggataaataaaatgtggtatatccatatgatcaattatgaggcaataaaaggaatcaagtgctgacacatgccacaacatggatgataaatttttcaaaaatcagtcacagaaggccacatattgtatgatttcatttatatgtccagaatagataaatttatagagaaagaaagtagattagtggttccttggggttggaggggaagagaggggttttaagggatgacagctaagaggtgtgtggtttatttatggcatgataaaaatattctaggattggttgtggtgatggttgcacaactctatgcatatactaaaagccatcaaattgtacactctaaatgggtaaattgtatggaaggcaagttatatctcaaggtcattttaaaaattcatagtctttctcttctggacagtttcctaacctggggcccatggatggggtctattaaagtatttacaaatattttatgtataaacataggcggatctttgggagaatgggttcaagattttttttttttttttttttttttgagatggagtctagctctgtcgcccaggctgcagcacagtggcatgatctcgtctcactactagttccgcctcccgggttcccgccatcctccagcctcaccctcccaagtagctgggactacaggcgcccgccactacacccggctaattttttatatttttagtagagacggggtttcaccagtgttagccaggatggtctccatctcctgacctcgtgatccgcccgcctcggcctcccaaagtgttgggattataggcgtgagccactgcgcccggccgggttcaagattttttcagatttcttgagtgatttgacacctaaaaaaaagttttcctccatccctcaattatcttgtgggagatattgggggaattaagtaaattaatgctggaaaagcacttaaaacagagcctgggacatagtaagggctaaataagtgctcttattgttccagctataccacaaaatacttatgtagtcacagtgtgatattataaaggattagataaaatctaatgacactactccactgcctcagtgactcacccataaccttcgtgataagttctaattctttaacatggcataagattcttcatagtttagccccagctttctttcaagtttcatctctcacctctcattttgagacctatatccagccacaccaaaccacttgcagtttcctaacacataatacattctctggccttaggcttttccccatgccacctgtgcctgatttctcctccctccacctctgctcatccttacagacccaactcgaacatcatcatcttcctccttccctaagaattctcccttctagccagtgtattgcttctcctgtgggtttacttaacagtgtgccaccttggaatcagctgtttagtttttttgtcttgcccttcagatttttaactgagggcaggagccttgtcatttgtctttgcctttccagcatcacaacacttgtcacctaaacactaggtgcatatttggttaattgattgatggactgaaaaaacacatgatatagctttagagaacaagaatttcctctgaacagaatccaatccaaatagaaaagaagtacttcattttcatgagggtgttttgctaaaggtttgaatttttaaatgcttcattttgctgaaggttaaatcaaaggaaatctacatggtactttgatgtagctttaaaagttcagagtgaaacaagtgtgaagtgatttatttcctgtaattggtcataaatttacatagaacctcacatattcgtagcctcatcagcgttgaccttagagtaccttctaaataatgttaatggtttcaattttatcaagatgtgtcagctgccaggaagaagacattcagtggcagtttcattttgtttgcccacaatactgaatacatctaagtatgcactgtagaaagactaagaattctctgtaaatgactccccctctcttcttctcaggtaaaaagtgtgcagttgtaagtttcttctattccaaactttcctctcctttctaccttttttacttattaatgtgggtgcatgttttttccttctaaaaacgtcagctttaactattgcattatatacagttttacatgaaatctacaattttttcattctaaattttatattttttatgatttacttagcttaaaaccaaaaacattttcagcattatgtacctagtattatttcaataaaattcttgaattttttttagttttttttttttaagtactgtagattagaattttggctcttgtctgtgtaataaagtaatgaagaaatcatgacctccagtcgatcacttttactgatttcctgttctgattctctggaaatcattttgtttgtgtggttattactagtctaacctttgtcatgtttacaattcagtgtttaaagaagctgataattgagaataaattttgcatatcatctcccattacatttattttagattttgaaaacagaaaactattaaaggtattctataaggaatccaacaaaattactgaccaaactctgaggatggaaaaaaaagtaaagcctctagaacttagaaatacaaactatgtgattattagatctttccatgaaaagtaaaatacattgttatttaaaattgtatatattacatatcacttacagaaatgctacatttagctcaaaaagctatagctctttgttttataaagattaattatacaaactcaaatgtacgaataggagcttttataatctgatatgactcagtcttggaaacttactgcaactgttttgcagttcacttggtgtcacatgattcacttcaatggtttaaaccctgtctagtagtgatcaaagttcatttggttaggggttttttttggtgtgtggatgacttttttccactttgttgtggattgattgtctttcaaaatacccaatgcagcccttcctcttattcttttgaatctcagaaagtggtagttgtctgcacagtgcaacctccagtcacacacaggggaaattttttttaagttgaaataatatgcatgaaagcacttttaactgtaaagcattatataattataagattgtattattaattccattaccccaatgttaaaattgaaggataacttgttacgtctctttaaaaccaagtgtaaaaaaaaatcaactgtaattttttaagttaccagtgtcctatgatgtgctaaaagaaagcagacacacagcacattgtctcctctagccacacagacacttgcccaggtgatcatattttctcggcacagatttctttatcacttataaagaacctacatttaaagactacaaaactctaaaaccatgacacttctctatttcacaaaagaaatttctgtcttaatatctactggtttagccaataaagtagactaatgaaaaatttaaaaatacttatgtatccttaatgatgatgaagtcctttggggcttcagaatattcatctttacaggttatccctgctgtagaatttcaatgataacttgcgtggaatagctgtaatcttttataaatagtgtttttttagtgtttgaatttttactatcatacagtaagaaactctgctgtttcctgtcaaaacctttcatcagactatgaacatgacagtttcctgttttcttattaactatactgcatttttatgctttattctttgtaaattgtataataacttatcgctttccttttctcattactaaatgtttttgggggaccagcattgtttaatacacacagagaaattctaaaatccgatctctttattgataatgcaaagttaagattccattaaagtagatttagatgttataaaaaaagattttgttaactattaaacttgtgctgagtgtgtcagatgtcttaaatattatttaaataaattctacatgtttttactttttatactttgtctcttaatgcataacatgatgaagcagtccacatcaggtaagaacgaatatgttatttgggtcttgtattgttagtactcccatctgtctgcttattaatgttctccttcagcatttaaaagggtgggataaataattagtacctagggctttttctttttttttattatactgtaagttctggggtacgtgtgcagaacatgcaggtttgttacataggtatacacgtgccatggtggtttgctgcacccatcaacccgtcatctacattaggtatttctcctaatgctatccctcccctagccccccaccccacgacaggccccggtgtgtgatgttcctctccctgtgtccatgtgttctcattgttcaactcccacttaagaatgagaacatgcagtgtttggtttttctgtttttctgttagtttgctgataatgatggtttccaactccatccatatccctgcaaaggacatgaactcattgttttttatggctgcaaggtattccatggtgtatatgtgccacattttcttgatccagtctatcattgatgggcatttgggttggttccaagtctttgctatcatgaacagtgccgcagtaaacatgtgtgtgcatgtgtctttatagtagaatgatttataatcctttgggtatatacccagtaaggggattgctgggtcaaatggtatttctagttctagatccttgaggaatcaccacactgacttccacaatggttgaactaatttacactcccaccaacagtgtaaaagtgttcctatttctccacatcctctccagcatctgttgtttcctgactttttaatgatcaccattctatgagatggtatctcattgtggttttgatttgcatttctcaaatgaccagtgatgattagctttttttcatatgtcttgggtgcataaacttcttcttttgagaagttcatatccttcgtccactttttgatgggtttttttttcttgtaaatttgtttaagttctttgtagattctggatattagccctttgtcagatgcaaaatataaattgcaaaaattttctcccattctgtatgttgccttttcaccctgatgatagtttcttttgctgtgcagaagctctttagtttagttagatcccatttgtctattttggcttttgttgccattgcttttggtgttttaatcatgaagtctttgcccatgcctatgtcctgaatggtattgcctaggttttcttctagggtttttatggtttcaggtcttacgtttaagtctttaatccatcgtgagttaatttttgtataaagtgtaaggaagggatccagtttcagctttctggatatggctagccagttttccatttattaaatagggaatcttttcccatttctggtttaggtcaggtttgtcaaagatcacatggttgtacatgtgtggcgttatttctgaggcctctattctgttccattggtctatatatctgttttggcaccagtaccatgctgttttggttactgtagccttgtagtatagtttgaagtcaggtagcgtgataccttcagctttgttctttttgcttaggattgtcttggctatacgggctcttttttggttccatatgaaatttaaagtagttttttccaattatttgaagaaagtcaatggtagcttgatggggatagcattgaatctagaaattactttgggcagtatggccattgtcacaatattgattcttcctatccataagcatggaatgtttttccatttgtttgtgtcctctcttatttccttgagcagtggtttgtagttctccttgaagaggtccttcacatcccttgtaagttgtattccctggttttttctctcttactagtagttatgaatgggagttcactcatgatttggctctctgtttgtctgttattggtatataggaatccttgtgattttttgcacattgattttgtatcctcagacttcattgaagttgtttatcagcttagggagattttgggctgagacaatggggttttctaagtatacaatcatgtcatctgcaaacagagacaattttacttcttctctgactaattgaataccctttatttctttcttttacctgattgccctggccagaacttccaacactatgttgactaggagtggtgagagagggcatccttgtcttgtgccagttttcaaagggaatgcttccagtttttgcccactcagtatgatattggctgtgggtttgtcataaatagctcttattattttgagatacgttccatcaatacctagtttattgagaggttttagcatgaaggctgttgaatatagttgaaggccttttctgcatctattgagataaacgtggtttttgtcattggttctgcttgtgtgatggattacgtttattgatttgcatatgttnnnnnnnnnnnnnnnnnnnnttttcacagtattgattcttcctattcatgagcatgggaatgttcttccatttgtttgtgtcctcttttattttgttgagcagtggtttgtagttctccttgaagaggtccttcacatcccttgtaaattggattcctaggtgttttattctatttgtagcaattgtgaataggagtttgctcataatttggctgtctgttattggtttataagaatgcttgtgatttttgcacattgattttgtatgaagttgcttatcagcttaaggagattttgggctgagacaatggggttttacaaatatacaatcacgtcatctgcaaacaggagcaatttgacttcctcttttcctaattgaatatcctttatttctttctcttgcctgattaccctggcgagaacttccaacagtatgttgaataggagtggagagagagggcatccctgtcttgtgccggttttcaaagggaatgcttccagtttttgcccattcagtatgatattggctgtgggtttgtcataaatagctcttattattttgagatatgttccatcaatacctagtttattgagagcttttagcatgaaggactgttgaatatagttgaaggccttttctgcatctattgagataaacgtggtttttgtcattggttctgcttgtgtgatggattacgtttattgatttgcatatgtttaaccagccttgcatccctgggatgaaactgacttgatcgtggtggataagctttttgatgtgctgctggattcggtttgccagtattttattgaggattttcacaccaatgttcatcagggatattggcctgaaattttgtttttttgttgtgtctctgccaagttttgttatcaggatgatgctggcctcatgagttaaggaggattccctctttttctatcgtttggaatagtttcagaaggaatggtacaatctcctctttgtacctctggtggaattcagctgtgaatctgtctggtcctggactttttttggttggtaagctattaattgctgcctcaatttcagaacttgttactggtctattcagggattcaacttcttcctgctttagtcttgggtgtatgtgtccaggaacttatccatttattctggattttctagtttatttgcatagaggtgtttatggcattctctgatgatagtttgtatttctgtgggatcagtggtggtatcccctttatcattttttttattgcacctatttgattcttctttcttttcttctgtattagtctggctagtggtctattttgttgatcttttccaaaaaaaaaaaaaagttcctagattcattgatttttttgaagggttttttgtgtctctatctccttcagttctgctctgatcttagttatttcttgccttctgctagcttttgaatttgtttgctcctgcttctctagttcttttcaatgtgattttagggtgtcaattttagatctttcctgcttcctcttgtaggcatttaggtgctataaatttccctctacacactgctttaaatgtgtcccagagattctggtacgtgtgtctttgttctcattggattcaaagaacatctttatttctgccttcattttgttatttacccagtagtcattcaggagcaggttgttcagtttccatgtagttgtgcagttttgagtaagtttctgaatcctgagttctaattttgattgcactgtggtctgagcagactgtttgttatgatttccgttcttttgcatttgctgaggagtgttttacttccaactatgtggtcaattttagaataagtgtgatgcggtgccgagaagaacatatattctgttgatttggagtggagagttctgtagatgtctactaggtctgcttgggccagagctgattttaagccctggatatccttgttcattttctgtcttattgatctgtctaatattgacagtggggtgttaaattcccccactattattgtgtaggagtctaagtctctttgtaggtctctaaggacttgctttatgaatctgggcgctcttgtattggatgcatatatatttaggatagttagcttatcctgttgaattgatccctttaccattatgtaatgcctttctttgtctcttgatctttgttagtttaaagtctgttttatcagagactaggattgcaacccctgcttttttttgctttccatttgcttggtaaatactcctccatccgtttattttgagcctatgtgtgtctttgcacatgagatgagtctcctgaatacagcacactgatgggtcttgcctctctccagttcgccagtctgtgtcttttaattggggcatttagcccatttatgtttaaggttgatattgttatgtgtgaatttgatcctgccatgtatgatgctaggctggttattttgcccgttagttgttgcagtttcgtcatagtgtctatggtctgttacaatttggtatgtttttgcagtggctggtactggctgatcctttccatgtttagtgcttccttcaggagctcttgtaaggcaggcctggtggtgacaaaatgtctcaccatttgcttgtctgtaaaagattttatttttccttcgcttgtgaagcttagtttgtctggatgtgaaattctgggttgaaaattcttttctttaagaatgttgaatattggcccccaatctcttctggtttgtaggatttctgctgagagatccgttgttagtctgatggacttccctttgtgggtaacccaccctttctttctggctgcccttaatattttttccttcatttcaaccttggtgaatctgatgattatgtgtcttgaggttgatcttcttgaggagtatctttatggtgttctctgtatttcctgaatttgaatgttggcctaccttgctaggttggggaagctctcctggataataccctgaagagtgttttccagcttggttccattctccccatcactttcaggtacaccagtcaaacgtagatttggtctctttacatagtcccatatttcttggaggctttgtttgtttcttttcactctcttttctctaatcttgtcttcttgctttatttcattgagttgatcttcaatctctgatatcctttcttctgcttgatctgtttggctattgatacttgtgtatgcttcatgaaattctcatgctgtgtttttcagctccatgaggtaatttatgttcttctctaaactggttattctagttcgcaattcatctgaccttttttcaaggttcttagcttcattgcattgggttagaacatgctcctttagtgcagaggagtttgttattacccactttctgaagcctacttctgtcaattcgtcagactcagtctccatccagttttgttcccttgctggcaaggagttgtgatcccttggaggaaaagagatgctctggtttttggaattttcagtctttttacactggtttctccccatcttcgtggatttatctacctttggtctttgaagttggtgacctttggctggggtctctgagtggatgtcctttttgttgatgttgatactatgcctttctgcttgttagttttccttctgacaggcctctctgctgcaggtctgctggagtttgttggaggtccactctggaccctgtttgcctgggtatcaccagtggatgctgcagaacagcaaagattgctgcctgtttcttcctctgaaagctttgtcccagaggggcacctgccagatgctagccagagctctcttgtatgaggtgtctgttggcccctactgggaggtgtctcccattcaggacacacaggggtcaggaacccacttgaggaggcagtctgtcccttatcagagctcgaacgctgtgttgggagatccgctgctctcttcagagctgccaggcagggatgtataagtctgctgaggctgtgcccccaaccgccccttcccccaggtgcttcgtcccagggaggtgagggttgtatctataagtcctgactggggctgctgcgtttttttcagagatgccctgcccagagaggagggaatctggagaggcagtctggcctcagtggccttgctaccactagggctttttcaagaatcctaccgtcttttcagtatagttcatgtgcctgctcttgtcaagtcagagtactaagttctaggatataaatatgattaagaaataatccctaccatcaagggtctaacagaagagagagaatacatccacacctaccaattattccatatttttctaaacagtgcttattttaaatatttagctctaatgtcaaatcatatgatttagaaaaaatttatctacatatattcaatcatgtgttaataagtacaatatttatgaaagtatttatgaaaatacagtaagcataatttttatgaaagtatttatgaaaatatgcccattgatttattttaaatactataaacattattttaaaatggcttataaaaatgctaatagtttaacaatatcagcataatactagaaaacaaaaaaagacttttaaaatgaaagaagcaggtttcttgtttgtttttattttgttattggattagggatttggttctggctagtctttctattattgtctaaatggtcaagctaccaataaatgtggagccatatttgattgttttattaatcaccttattcttagaatacaaccaaacaaataattgaaactgagactgattatgcacagtgacaaatatttatttttatatttataccctaccttgttccccatagatttttaggcagtttgcatgaatacatatgacacaaaaataatcaaacattaggttaaaccaaaataaattactgatacttgacattcacttaaaaagtggcaatgtatgcttcagtctgacagttaaaagaatcactgctaaggtgaaatctggtaagatgagagttcatgttagcaaacagaaatgcatacagtatcaaagtaggtcacatatttggtagccaaagcaaagtaaggagcataatatgttgaagagtgtgtctagtaagacaaagccaaaccagttattcttttcctatttctaaactttgaaagaagtttctcttatgggtctatatgaagaggataagaaaatgtactaaacaggaaagtgttaggctaatggtctaacatataaagagcaattttgtaatgggcaaaaacagtgggatctaaatacataacttactggtcatctggttagatcaagaggtatgctagtggaagaatgaatggcagttgcatgtctttccaacaatcttttatagatattatttcttagacttttatttaggatacatttttattgaagtatgagatatgtacagaaaaatacacaccataagtatctagcttgatgaattatcacaaaaatgagcatgcccatttaatttcaactcaggtgaagaactggaacattaccagaatttcagaaggccctcgttactcctcccacactctctctctcatctcctcattttcctgacttctaacatgacaaacgagatccctggtttttaacattttactaatgaaatcatatagaatgagttatttggggttttggatctttcactcaatgctgagatttacccacgtagttccatgcagcagtagtctgttcatttttgctactgtatagtagtatctcatatgaatatattgtagtttgtgcatttgactattgtaaacatttgagttatttccatttggggttattatgaataaaactgttatgagccctgttataaaatttttggtgtaatgtatttatttctatttttcatatgcctaggaatggaattgctgggtgactactataattgttcaagccaggacacttttgagaatgaaaataattaaaaattactgtgtaacaacaggcataagccaggactgtcccaagcacactgaagtgtatagttattctaggtataaagtgtgtagacattcaactttagtcgatactgcgaagccattttccaaagtgcttataccaatttacactcccaccagcaatgtgcaagacttcctattccgtatcttcactaacgtgattggatagctgaaaattcagtgttgtattttctattaagaacacagaattaagttattcagtgtggtcagttaagggaccattaattggctttgacagttaactaggcagaaggtaaggtaaaagttctcttgcaaaaagtaaggagcctattacaaactctgtggaaaatggtttggcagtatttactaaatcttctttattacgcagaagttacactctagagaaatgagtacatatactgaccaaaagacatgtttaagaatgctcatagcagcattatatataatagattggagacaacccaaatggccattaacattagaaaggataaattatgatgtaatcacaaatgcaatactatgccacaccggaaaagcataagctaccatgctatatgccaacattggtgaatctcacagacaatgctgagtaacaggatacagaaacaaatgcataccatataatcctttatattaaatacaagaatagacaaaactattgtgtgatggtagatatcagaatggtggttacctttggacgagtgtagggcagtttctggaggaagacacatggaagtcttctggggagtggaaaatgcactatggctcaatctgggtgataatttcatgactatgtatgtaagtaaaattttaccaacttgtacacataaaatctgtacattttgctgtgttatatttcacttaaaaatgagcctaaatacatactttttttttcttttcttttatttctttttttcttttcttttttttttttttttgagacagtgtctcactctttcacccaggctggagtgcagtggcaccatctcagcacattgcaacctccacctcccaggttcaaccgagtctcctacctcagcctaccaagtagctaggagtacaggcgtgtgccaccttgcctggctgatttttgtgtttttagtaaagacagcgtttcaccactttggccaggctggtcttgaactcctgacttcaagtgatccacctgcctccacctcccaaactgctgggattacaagcatgagccaccgcacctggccctaaatacattcttgaaacacacatagcctcaaacttttctcaagcggttttgctattagagtgttatggccataggaaaaaaacactgaacatcttaatcagtagacttcatcttgggggacagtcagagttacagaataattaaaaattaagtggaaaattaagagagttaccgtatgccccttcaacaccttctgcctttctcctgtaattgacatcctgcagtagcttaatacataagttacaattgatgagccaacattgacacattattattaactgaagtccatagtttacattagggttcattctttgtgttgtacattctatatgttttgacaagtgtataatgacatgtatccaccattacagtagaatacaaaatggttgcactgcctaacaatcccctgtgttccacctgttcatccctcttctccttcctgaactcctgcaaccactgcttactgtctccataatttttccttttccagaatgtcatgtagtcataatcatacactatctggcctttttcagataagcttcttttgctttgcaatatgcatttaaggttcctccatgtcactccccctaacccaaacaccctcatacactaatattaaactgcttaacagctcttcattaaactgcttaacagctcttcagacctaccatgctctcttgcctccatattttaagcacatgctttctgtatctaattaggcttttcagatgtgacaccatgtgataatttctagctagaaagaataattggtggctgggcacggcggcttatgcctgtaatccctacactttgggaggctgaggtggaaggatcacctgagcccaggagttcaagaccagcctgggcaacatatcaagacctcatctctacaaataatttaaaaattagctgggcgtggtggcacatgtctgtgatctcagctgctcagaaggctgaggcagaaggctcacttgagccagggaggtggaggctgcagtgagctgtgatagtgccactgcactccaacctggatgacacagggagaccccatctcaaaaaaaacaaaaacaataataggtacagattccattgttctagaagccagaaccctactcaaagtcttggaaagggcctgcccttaagaaacatatatttcatttgtatgtttgtgtgtgtatacgtttatattaaagctcctgggtttccatagagataatcttctgagacctatctaaaactgggttggtatggatatctggtctaagaaaaaagtaaaaataaataaaatgggaacataattacagcaaaactttcctactgttctaatgagagcctgggtccgaaagaagcagtaaactgatggtataataatagtaccagcgtccgatgagctaatcatgaagaatgttttttaaaatgttggcagtggtacctaatcatttttattccacaaatttcaaacaaattattataagaatattccaaaagtcaacctaaaattactaacctagtcaacaaacatcaagatacattagtgggattttatcaaaatagcattgttggccgggtgcagtggctcacccctgtaatcccagcactttgggaggccaagacaggtgaatcacttgagtccagaagttcaaggccagcctagccaatatggcaaaaccccatctttactaaaaatacaaaaattagccaagtatggtgacgtaggcctgtaatcccagctactcgggaggctgagcaggagaattgcctgaacccaggaggcagaggttggagtcagccaagattgtgccactgcactccagcctgggcaacagattgagactctgtctcaaaaaaaaaaaaaaaaaaaaaaggcattgtcattggcactgattctgaactgactcatatcttattataacaaaatgtcccttgcaacctaccacacacgcacaccccgatgtatgtgtctctcctatggctgttgagttgtattaaaaaatacttaatctggctgggcgccagtgattcctgcgtgtaatcccagcactttgggagaccaaggcgggcagatcacttgagatcaggagttcgagagcagcctggcctacatggtgaaaccctgtctctaccaaaaatacaaaaattagctgggtgtggtggtgggcacctataatcccagctactgaggaggctgaggcaggagaattgcttgagtctgggaggcagagagcttacagtaaactgagatcacgccactgcactccagcctggaacacagtgagactttgtctaaaaaaaaaaaaaaaaaagtagttaatctatcagtgtctgtaaactaagactatattcctaagggtagacatgttattccttaaagaatatggcttgtcacctggatatgaagctgatccttggaataaaacttgaagattgacacttagtaggaagaagaaaagaaaaggttctgatgctgtttcacccaaacacacatgttctctcaagtgtagactgtgattgttgagatgtctaaaattgggtggtgcgcttcagtgatgaatcccacaaaacaccttaatgggcctagacttgaaactagatggtgaaggtgtctgtaaaccccaaagaataggtcatatcttaaaggtaatatttactagcctcatgtttattttcattttgatttttccctgctctggttggttgtgtggccacatttaggccagagtattttaaaaatatgacagtggacagtgtgaaaatggaagtgataaattaacaaggaatctttacatctaaatttatttacccttatcagattttcttaacatggtctaatatagtcaattcccaaatccagttcctttagagcagtgtatggaccaccgtcttcagaatcacctggagtacttgtttaaaatacaaactcctgggcctgtcctgctgaattcatatgttcaagagtagggctcaagaatcttttttttttttttttaaataataaacccaggcagtttcttttttttttttcttttatttttttttagatggagtcttgctctgtcacccaggctggagtgcagtggcgctatctcggctcactgcaacctccacctcccaagttcaagcaatcctgctgcctcagcctcccaagtagctgggactaagctgggactacaggcatgcaccactacacccagctaatttttatatttttagtagagtcagggtttcaccatgttggccaggctggtctcgaacttctgacctcaagtgatccaccagcctcggcctcccaaagtgctgggattacaagcgtaagtcaccatgtccagtcacccaagcagtaattatacataccaaattactggtgtagagaattagcaagtcagaagggtactcttaacatctctaatattctcacagaagtaaggactccagagcagctcgctgagttgaatagccagtgagaatgtctctctggtagttgtgactctttgctgatgttatttggaagatagcaaatctaatgaatacctaaaatacattatttttaaatgttacagaaactagaagacattcattagaaagaaacaaagattgtaacataaacttgtttttacttactttatatacccgtatttgaagataaaataatctgaaggactgaatttgattatgtaatatattttttaaaaaatatattaataaattttttaaaatgttgaaatataactatttcaacaggccaaggttgttatttaaaaatcctttttcatttgcttccaattaaatagtccatggttgccagggtgagggtgaaggggggatgttaacatggaaacaaagtgcatattttaatgattgttagagctaggtgatgacaacatgggggttcactaaattattcactgtatttttaaaaaaatattccataataaaaagttaaaggccaggcaccgtggctcacatctataattgcagcactctgggagtctgaggcaggaggattgcttgaggccaggagttcaagaccagcctagggagcatagaccttgcttctacaaaaaaagttagtcacaggctaagttcagtggctcatgactgtaatcccaccaccttggaaggctgaggtgagggaattgcttgaggctagtagttaaagaccagcctgggcaaccgagtgaaacctcatctctacagaaataaaataaatactagttagtgtggtggagtgttcctgtattcctagctactcaggagcctgaggcaggaggatcacttgagcccaggagttcaaagatgcggtgagctgtgattgtgtccttgcactctagcctaggtgacagtgggagaccctgtctcataaatgaatgaatgaatgttttaaactttttacttacctaactgacaaaaatgaaaaagcaaaaaagtgatgcaaagttgtagggaaaccagaactttacagtgttgttgagggtgtaaattctttttttttttttttttttttttttggagatggagtcttgctctgtcacccaggctggagtgctgtggcgtgatctcggctagtgaacccccgcctcccaggttcaagcagttctgcctcagcctcccgcgtagctgggattacaggtgcctgccaccacacccggctgatttttgtatttttagtagagatggggtttcaccatgttggccaggctggtctcaagctcctgaccttgtgatccttctgccttggcctcccaaagtgctgagattacaggcacgagccaccacgcctggcaaaggtataaattcttagccacctttctggaggacagcttaaacatagaaatcaaagttctgtgttcaaagttcagtgttaaaactcatgctgtattttatatttctggccatatatcttaatgaaagaataagacggctctgaagaactgtgagttcagaaactgagttcatggcagtgctattgtgaggagatggaaagctaaatttccaaacaaaatcagttaagcagatgatgacatgttgctaaatgagataccgtgcagccagtaaaagattatgacaacaagaaatgtttgatatgttattaagtgaaaaagcaggttattaaacaacatgcgtaatgaccaatccatttttgaaaagtcaataaggttagagaaattatcttgaaagctatattaaaatgttaatggattatctccggattgtgggttgtagaattgctttattttctaaggtgcctttagttgaggtatagtttatgtagtaaataataaaactaaaattatatggaagaccattttttgacaatttccagtagtttcttatgctgttaagcttttaaaatgccctcaaaaaaagaagtccatgaaatcattgataattttttgacattatttgattattatttaatgtcagtctttgaattttttttttttttttgagacggagtctcactctgtcgcccaggctagagtgaggtagcgcaatctcagctcactggcaacctccgccttctgggttcaagtgattctcctgcctcagcctaccaagtagctgggattacaggcacacaccaccacacctggctaatttttgtatttttagtagagacagggtttcaacatgttggccaggctggtctcaaactcctgacctcaagtgatccatccgccttggcctcccaaagtgctgggattacaggcgtgagccacaacacccagctgttagtctttgaattttggataaagcatatattttatttcttcttttgaactggaggttttaattttttaatgtttacatttatcatacacataaattaaaaagtcaaagaataattaaaaggcttttacaaaaagaagcagtcttggctgggcagggtggcttaatgcctgtaatctcagcactttgagaggcaaaggtgggtggactgcatgagcccaagagtttgagaccaggctgggcaacatagcgaaactccgtctgtaaagaaaatacacaaattagccaggtgtggtggcccacgcctgtagtcccagctactcggaaggctgtggtgggaggatcacctgagcctgggaggtagagtctgcagtgagctgagatcgtgccactgtactccagcctgggtgacagagtgagaccctgtctcaaaaaaaaaaaaaaagaagaagcagcaatctcatacgtgctttttgcaggccaaagaagaagaagcaatctcatacttgctttttgcaggccactattttcaaactaatttctttttttttttttttagacagggttgcactctatcacccaggctagaatgcagtggtggtgggatcatagctcactgcagccttgacctcctgtgctcaagcaatcctcccacctcagcttcctgagtagttgggactacaggtacacgccaccacgcccagctaatttttgtgttttttgtagagacagggtctcacattgttgcccaggctagtctcatactcctaggctcaagtgattcacccgccttagcctcccaaagtgctaggattacagatgtgagccaccatgcctggccgctaattcttgagtgttcagttttggcatctttacacggggaaagatttatctctttttcattctcctcacccccaccatgaacccacagactttttatcccaccatgctactaatgtaatgatttttgttagattaatttacaggatctacatcattagtttacatttacatcattagaattatataactgtcactcacaacagaacagcaagcttataggtgcttaagtatgcctcttctcaggcctctcttctggaatggagactgaagacaggcctgggaaattttatttttcacaagtttccaagatggtgttatgaggggggttggaaaataatgttcttgtttttctggctctactttaaaaaaaagctttattaagatataacttacatattataatattttaagtgtaaaattcaatgggttttgcatgtttgcatagttttgcaactatatgcacaacttttagaacaccccaaaagaaactgcatgcctatttgcgatcaccccctttcttttctctcccccagtcctaggcagccactaatctactttctgtctctataagatttgcctgttctggacatttcatataatggaatcatataatatattgtctcttgtgtctttcacttagctttcatattctttttttttttttttttttaaagacagagtcttactctgttgcccaggctggagtgcagtggcatgatctcagctcactgcaaactctgcctctggggttcaagcaattctcatacctcagcctcccaagtagctggaattacaggcgtgcaccaccacacccaactaatttttgtatttttagtagagacgacggagtttccccatgttggccaggctggtctcgaagtaccgacctcagctgatccacccacctcagcctcccaaagtgctaggattacagtcatgagccactgcacccggccaacttaatatttttgaagttcatccatatatcagcacttcattcctttttattgccaaatagcatcagttgtatggaaatagtgttttaatgtgagtgttttgctggtatacatttgcccaaaggattgccttggttttttcatttgcttggtgtgttcttttatgtgtaactctcctctagtgtcacgaaatctccttttatgtgttaatctcctctatccaaacaatttaggtgttctatgaatttcatcttcttgaagaaatctttcttctgactgctccagtctctagtctgggctggatgcctctaggtctcttgtacagctgtcatcttggggacatttttcattaccctagggatgattccctttgccatacttttgtactggacttcctctttcttccatcaaagacaaaagatgccttttttccttgatgtactttattttggtggagcatattatctactttcctgaaaaaatggtttatgggagataaatcataaaaaggttttattagattctacatctcatgattgatccaaaagacgttttaaaaacaaaacaaaaaaaggccttgtaggtcttaactcttacttagcctcacatttatttgatagtttgagtgagtatcttaaaaattgaagatgattataaaaattttaatgtagacattattttttctcagaattttgaaggcactgctctgtcttttgcagttggagagtctgatgccattctgattcttaaatcttttatacaaaacatgtttttgcttttggcaggaagctttaccttttctttctttcaagtgtcctgaaacttcactgagatgtatcatggtataggtccactttgatccactgtcctggacacttgctaggccttttcagtctcgaagctcatgactttcaggtaagagaaatttacgtctaagacctcttttttttttttttaaagcatcccttctctcttaactgagttttttcccggcttctcggagatactatcctcgaattctctggtaatatgtgactctgctcaaacttcaagactagggaactaaagactgacaggtgttttgaattcttgggtaggacttgttgaccttcattgtagggtgatcaaactgagatccttttggggggaatcccagattccctcagataggagtcttttactaaaaattacagagagtgctggtgcctctatttccttagtgagtctcaaaaatacttccatgcacattcagtgactttaaaaaacccgtgtctcattttacctggaaatataatactttttgtttttactggcatttcacaaaaaatttttgttgttgctcagtgtttgaagatactcatgtagtatgtattcaaaaattaggaaagacaatgggcctcaaaagcatatgctttgccagtcatgatggttcacacctgtaatcccagcactttgggaggccaaggcaggcagatggcttgagctcaggagttcaagaccagctgggcaacaatggcgaaaccccgtctctacaaaaaatacaaaagttttccaggtgtggtgccatgcacctgtagtcccagctacttgggaggctgaagcaggaggattgctcaagcccaggaggcagaggttgcaatgaactgagtttgcaccactgcactccagcctgggcaacagtgccagaccgtgtctcccccgaccaaaaaaaaaaaaaaaaaaaaaagcatataatattgtatgtgtaattttcaagtggatagtttttatcagattcctgattccctaataagcccaaagagatttcaaacaaaaccaaaatacaaacaaaagccattgcctagagtagtggtccctattctgagatgtgcatcagagttattcaggtctttagcccctacctctataccacaagaagaaagttgcagaaaacgttcatttaaacagttttccttgtgtcaaccatcaggtggtagaattggcccggaacagcttggttgtactactggaaagatcgcatccatttctacataccagacactagtcagatgttcatagttcagaagcacttttgtcctaaataattaagagttccatttcagctaaatcaacttttttctgtctcagccccattttatttgaaccagagggtctaccacggtgattctgagagtttagagcactgtcatcccttggtatctatgggggattggtttcggatccctatggataccaaaatccatggatgctcaagttctgtatataaaatgatgtagtgtttgcatataacctacagacatcctcccatatactttgagtcatctctagattacttttagcacctaatccaatgtaaatagttgttatactgtattgtttaggtgatgatgacaagaaaagagtcggtacatgttcagtatagaggaaaccatccttttttctcctaattattttggacccacaattgtttgaatccatgaatgtgggtcgcactgatacagagatccgaccatatttcaaaatttcctgaatgcgtgtaaaaaatgtatattctgggatttcacttttcaaaaggattcaaaatccttggatctcaagagggattctacatttttgacagagatcctcagttcttatgcagatgactagtggattacgttttgaaatatgctaatctcagtttgctactgataatacccataaggatttttttctttttttttttttggaggaaagggagagttggaaaggttgattgtctgcctgctttttgttgttgcttaaatatagtttgcccctgaaagtctggtaataaggataagcagtatatcatttagatcagatagccaggactgcactttagagggcccagctgtggctttcttctagccaaacccctttccacaggatgaggactcccagaagacatgtctacctgaagttcatgcagccccttctagaacatattctgggtagtcagtaccctggaattccttccccaaatgcccacttccagacctagtacaggactcctccctcatcagatccagtgtgcacacacctaagtctaagggacagataaccaagggatagcttcagttttaccacatagtcgcttaccttcaccattttttctctccaccaataaattcctttacgtttgctattccatattaacagctctcaatgagattcctttgatgttgaggaaatgacccttcaacctatagttaattttctataattacatctgatgatgaggctgcagtgttttaattgcaataaattttgttagagcaaaggaaagctgcagctttccaaacagttgggaagttgtggttcttctgccatactcctcctttataacagccaggaagaaggaagacacatgttccatatgatttcttcaaaaaggtctgggggaaaaagagaaaggaagagattaactgacttaatttaacacttggagctataaattgtgtgttgcaatattgcgataggatgttgcatcagaacgtggcagttgtaacaatgcagtgggtatcataaccttgaggaggcctttgtggtgctatatgcccttttcctaaagattcaactccaagtatagatccctctgttctgccaaggagaatggtattatttaaattacgttgtacctcactataaatttgtccacttggtctagggcacaggaatatagttgaaggtctgcttgggccagacatcattgttctgagtccctgcatccctgctgattcttgttgtcatatacaagcagggaagtgctgaggtttcttcacttcttcctggaagtctttcaggaaagctgggaggtattatggtgaggctgtaatgtctttattctcaggaccgttagttttgaaagtgtatgtaatatttcctgaatatttcacattgcctttatctaaagaattgaaagattgtgactaggagtttgtccctgagaaacaaggatgagggtaggagacgtggagcatattttagcaagattcttaatagtcagagtagatatttggtagctaattcttgtttttggttttggttttttactcttccactttattgtaggagaaaattcatggtgcatgagagaaatgaaataagtgacagaatgtcaaaatcaaactttaaaacataaactcttgagggcagagctgatgacttaattgtatgtgagtagaactggtactgtcatggttgtggatttgggagtttgaggaaacttgagcaaagaagtggcagatgatgaaaataaatcagttttaattctgataaaactggttttggaaaatgtggtttagatttaaatgtggcacaattttttcaatactaaactctagaattagtcagacttgcccacccagtaacaggtagcttttgacctccttaagcctccttatgtgagggtcttgtactataaaactccagggattgaggactagagcctcattctaaaagatgggaagaaagggaaaagagatgagtgaggcataccattcctctctcctcctccccactaagagaagcctcaccttctccccagggggagttggggagagaaggcagaaatgttataccggactggcactccccccatgcagaaggaaacctcatgagtgggaagcagcattcctctcccacagtaagtgacggtgatatgctggcctttgggctattataacaggatggagactcttagcaaagttttaatgatttataaatcattttcatcatttacagaactatggagacattctctcaagatagtgtgtgtgatagtatggtttttaagttcataccttctagaaataccagcaaaatatttacagataaactgataggatgtctggggtttacctcaaaattatccaggaacaagaggtgtgtaatgtaaaaagattgtccatgatgggtgttacttgttgaaattaggtgatgggtacatggagtccattatattatctctagtataatgaagatttagtttgaatctaaactttgctactagctatatatgtccttagcaagttactcttcctgagtctccatttcctaatctgtagaatgagaaaagtaaatactaaaatctatcacataggacggttgttattattcaattaaagtaagttacaggccaggtgtggtggctcacacctgtaatcccaacactttgggagactgaggcaggcagattgcttgagcccaggagtttgagaccagcctgggcaacatggtgaaaccccgtgtctacaaaaaatacaaaaaaattagccaggcatggtgacacacgcctgtagtcccagctactcaggaggctgaggtgggagaatcgcttaagcctgggaggcggaggttgcagtgagccgagatcgcaccactgcactccagcctgggtgacaaagtgagactgagacctgtctcaaaaaaaataaaataaaaataattatgagcccattatatataacacatagaaggcactcaaaaattagtaactatgattatacctgtaaatagaaaaataataaggcatcttcttccttaaacatggaatgtttgctttttggcgtgtgtgtgtttcccccatttgactgtattaacttggattttgttttaacagctcaggtgcctaaaaggccagaggggcttctcaggccaacctccttttgatggaatccacattgtcaaccatttaataggagatgatgaatcattccattcctccgatgaagattttatagataattccttacaggaaactggtgttggttttcctttgcacggaaaatctggttcgatgtctttggaccccgcagtggcagatggtagtgagagcgaaacagaagacagtgtgctggagaccagagagagcaaccaagtggttcaaaaggagcggcccccgagaagaagagagtcgtattcaaccactgtctgaccatcactgtgacctagactatggatttatttaagggatcagttatcatatgattagggctttttggaaataatttgtttcatatgtacatatatatatatatatatatatatatatatatatatatatatatatatatatatattttacagtcttatctgcctttttatctttgccaaatctttaccactgatttaccattgccataaagtagactggtatatggttaatgtgtaaaacaaggttctaacagtattactgaatattaatgtttcttgtttagaaaatgcaactatatctatatgtgggaaccattctgaagttcaaaactatggaaaattgaattttcttcagacaaaactgctcttgtgcaatattttatgctcagtgagcaaattgtgtatttatgtttatcaatttgttctcaaggtggctgtctacagacatttgaccaagacatacatctgatttaccttgtgtttttttttttattgttgtttttttttttaagacagagattcagtctgtcacccaggctggagtgctgtggtgtgatcttagctcactgcaacctccgcctcccaggttcaagcaattttcctgcctcagcctcccgagtacctgggactatatgtgcgcaccaccacgcctggctaattttttgtatttttagtagagatggggtttcaccatgttggctgggctggtctcgaactcctaacctcaagtgatccacccgcctcagcctcccaaagtgctgggattacaggtgtgagccactgcacccagcctaccttgtctgtttgtgtctgggaggttttttttttctatttttattttttcatgaaaattattggtgggccactgaaagtccccacacacaaagcctttattctatataattttataaacacaaattcatgattatctgttttgagagttttaagttttgttttaatgtttaacttttatgtgcatatgatgcttccatgtgttggttactagagtagtaggttaactacagacatactgttttgtttgtacatatttataaatctgtaccacctaacattgaacatcattttatatgaagaacatacatgttgcaaaatgactgctttcagcatctaacaggacttctgtaaataataggttaaaagttaaaaataaaacactaatgttttaagagctttagtattttgcttagcattcaatactagcagattcataactgatgcctgttcaaaaacactgttggtggaatcttttatttcatgtgtatgtaactactaaatttttcatgactgaagaggttatagcacatattagttagtgctaatattctactgaatataatttaagcaatgggctaaggtccaagaaacatagcaattatatctacaaataatctattaacatgatcttcagaatctctagtttttgttctatagataaagccataagaatcctttcctaccagtttttcctatatcatttagatattatttcctagaaaacaggatgcctgtcactgataagttagagaaaacacccaaattatacttgcactatggaaagacgacatgaatatgttgactgggtactttctactctcatttttgttagcctatgaaaaaaaaaacattttgttaacctatggaaaaagccttggaagagaaaagtagaattcagtatgtatggaggcacagttttgcacagtatgttgcatgcggcaaaaaaaaaaatatgaaatagagtagaagagataaaagtagttttctgtcaaaaactaggagttaagccttcaggtacgttgtggactaggctttccagcaaggtttttgtagctatttgcttgcctgagaaatgaaattgaaaacatacccctgcgtgtctgtccttaacaccaggctaaattctggtggttaaataacttacctgtggttacaagctagtaagtagcagagccaagattttttttaatatagagacaggtgtctc

SEQ ID NO: 13363 - DNA, 47799 bp, Human
aggtcccaaaaccaattgcccaaggatgggatgaagaatatgcataagagaacacaacttaggggaggtaggggtggggagatttttatcgagttagttctacatgaattaacatgcagagctgcccacctaatgcaagtgagcaaatggtcctcctgtattctatattacttatgtccactggactctcatcccagcaacagtcaaggcagctctgggctctccaaagctctttacagtgaaggcctggatatttcttcctcctttgtgacatgcttttgctttgattccccattttggcctcctcctttgtcatcatgactttgttcctgactctggtcttttattctacgtttttgttttggcttctcctagcatttgaatcttgattttttactctgggaccctgatttgacttacctctctggctctctatgtcttatgctgcatcaggagaaaatctcttatcttttttccagcccaacagagctcagcccatgaaacggaccttcaatgggtatgttgacagcaccccatcaccgtgccaacacatataccatgaggaaaaggtttggaccatatctggagtattgcatccaagtctggccaacccccttcctcactgtgagggtatctatgtaaactgaagtacattattagaaaaaggataggttgggaatagacatgaacccttggtgatacatagaattactgaaagagccagagatgcctagggaaagggggattatgggcacagcagatcaatctcaggatttgcagaggatcccactgtgaaagacttttttgtctttcaggcttctcttgtgtggcccctgggagcagtctagcacctgtgggcagaagctgtagggaaaaggagcagattttatctctataagaaactttcttgtggtgaaaactatctagaaatggaatgagaaagtggtgagctccccattattggaggtgttcaagtataggctgagcggtgacttgtcacgaaaactgtatgacagacccaaacatcaacggggtgcttagattctttgatctcgggtcagttccacacaagacaggctctgtgttagtgaggacccagtggtgtttttgaacaggcggcaggataacaatggtatataaaataaatgcagagaaagacctccacatcaagccaacccctcctccctacctgtaagttttccacctgagtgagctctggctccagctgcacttgtcaaactcccattgttagagcacagataaatgcttccggccacccaagcaggagaggcccacctcaacttaagggctactctattttagttttccgtagctggagattgagtatcacgcttttctaatcttgtgcttctgaaagggccctgttctctcttgaaccccaccccctcctcctttcacagatcaaataccaagtacattggacagatagaagttcgaatgagaaaatgcattttaataaaatcccattgatttttgtggatgtaagtcaaggaacaggcacctaaagagtcttccatcccctgccgtctcccgcctctctcctgacctacaccgggcggtcatacatcgattggcttcctagataatagatcgtgccacccggtagggacctctggggacgcgccgggagctggaagagtcgcacgcagcagcccaaccctgagttaatcaaactagcaacaggatctcaagcagcagcgacggcggtggcaagagtagcggtgacggcggcggcggcggcggcggcagcattatgcgtgattactgacaggcaccagctgctgccgccacagccgtctcaaacgcactatgtggactctccgatctagaggcagattcctgactaatcccagagggctggcccagcctgtgctccccgggctgctaggaagcgatgaccactcttgttagcccaagttgaagaaagccgggctgtgcctgggagccgagagaggcggtaatatttagaagctgcacaggagaggaacatgaactgacgagtaaacatgtatggaaattattctcacttcatgaagtttcccgcaggctatggaggtaagtatctcccttgggcttcactgcgtggacctgtatgagagactgagaagaaattgggaaatacgaatgactggattagtattgaattaaaaggagaacatatatgtttatatgcatatatagtgtgtatatagcgtttcagcgtgtgtgtgcacgcgtgcatgagagaggagaggaggaaagaatggtctgtaggtgaggatacgtttgcatatcagaatgaggatacggggatattctaaggagagagtaaaccaacatgcttgagaatgtgtctgagacaaagatagaataagagcattgttataacccagtgtgtttgtgcgggtgtgaaaagtggaagagttaacggggaattactatgatgttcctattagccaacttgtaatgagaaaaaatgtgattaaaaaggttttgcctatcttgagggttcctgggatactttgtaacaagggcatgattgttttactcaaaagcagatttccctttaattggatttttaaaaagaaaacatagtgctttaatttgctactgtgttttccttcccctgttttctttcctttgatttgctaatagcctcttctctcctcccctgctgctgcccccaattctactgcaagagttgctgcaatcacttccactctgggggtagagatctggggatggggggttggggctcttagagaattggcaaactgaagattcaagtcaccgtgccaggcagggcagcccagtcacacttcacagaagcttccggagactaggtcctcaggctgccttaacgcccaagcacatccgtcccaaggatcccttgatttagtgacagaaacagtacagccgcccagctctgagtaaatggaagcaacagctgaccaactggcctgtcgcttgtcagttggaggcatgcagcttatgttgctgggagccaaagaaagattctggcaggcaagacagcagaaattcttataaggttttgaaaattgaaaagtccctgctctccagacttcctccgtggaccaattcatctgaaggcttgggactaaagcttgcctaacttggctgggcagaaccccctgggaggcatggtgacacactgcaaggtagaagtgatctctgtcaccaggaggtgttagacctgggagtttgcacattcattcagggtagtttttatgaggcaggcatggtgttgggcactgggaatacaaatatgaatgagacacagtctctgccctttgggactggggcaggcttgttacacaggcacattataatactgcatgatgtgtgtaatagcaaacgtaggttgtacttggacttggggtgagggccatggaaatgttcccgaggtgatgttcaagttctttgggccagtctgatgacagagtgagagcggtggccaatgctgtgacctgggcatttgatctctagtctatggttgggctccagatgtgaaaagcctcctcaattcccacctcagtcccattcagagctgagaattgctttttcctttacatcttagttcatttgtaagaggtgcatgctcattttcagccagattcgtgggccccccaaggtctgtgagactgtggcttcattaatgccaaagagacccttggagacagttggggtgaataaaagggttgaagctagaaggatttagggagagaactaaagtaagagccagagaaagaagatctagttaaaattccatgggggctggaatcttggaatgttagcatcctaaggacctgaaacagcatcttaggctctcatcttatagatgtgtaaactgaggctcaaaagaaggcagggactagtccaaatttatatggggctgagctgcagaacacttccagaaaagcccttactcaaatttataatattgttgctttaatatagtgaaaagagcaccaggaggaagaggaggcaggaagaggtagtgtgctgagtttggttcccaatttttcacctagtagctgtgtgaccttaggcaagctagtgaacctctctgagccttagcacctttctctctaaaatgggatttataatctcatccttagagtattgtgaaaattaaatgagttagcatgtgaaaaacagctgctatagtgttgtccatatatttgctacctaatacaatattttcttcccctctattttactcagagactaacatgcaaaatagttaaaaatcagacattattgtaaaataataaataaggaatctgggaaaataaaattaaatccacaaagaccctcatattttgctggcatagattttcataattgtgggggctctgatatttagcgtaattagatttcagatagaagtaaacacaatggttcagctatggaaggaaatagttcagtatagtatagggaacttgaggggaaagggtcatgtaggttgtctacatgtctcctgtaaagctacttttctttgtcattcttgagggaggagaagaattattttgtttagttctgttgaggttttccattttgttggcatgtgccagttaagaggaggcctaaatgctgagccaaaggactctgcccccgtctgcagggaggtctgtttgagaactttctgtgatgagggagagggacagaggactcacaagcaggcacaggggaaagcaggattagagtggacgtcacctttggcctctaacctcccctgccacagtgcagcaagttgcacggcacttattaaaatacttggtgtataaccccctgccctgttacatattagcacatggaattacagagggccccatgatttgtataagaatctccagggaagcaaagtcaccttttggaaataacacctgagatttgtgtctgggaccatgcttaccagatgtcagagcatcatctgatcagtgagcaacagattgctcaaactggccaaagtgtggtggctacgtggtggctccacaaaggtgcccaatctcccagctttgggccctaccatgtaatgatgagagaaaccttctcttctccttctctgccaagtccagggtttgccagctgctcagtaataggtttgtttttctgggatgagacagttgctgcctcttagaagatggcaaaacaaagcctgtaatcccccccatccaattgtgcagtaatcctcagggtgagaaggagatcagggagagagaggacttctctcatttcatttaacaaacacactgtaacactaatgctcgctactattgtaagcactttaccagcctcggctcatgtaatcctcataacaaccctaggagtaggtactgttaccattgttctcgtactccttttagagacaaagaaacagaggaattgagaggtgaaataacttgcttaaggtattatagctagaaaatggcacagccagggatttgaacccaggcagactagctcccagagttcacactgctgagctgcctctcacagcttctgtgagtgacacagttgctctgcaaagccaggggcagcagcacacccccagggagctcccggtgctccaatacaacctcagatatgcagcctcagcactgactggttgttgcagacccagtggactggccattgaggaataagccatgggataggttaagagcaacggtgatctctgcagaattaattggtggcttcccttgggtacatacttatttgcaagagtcctgtccaactgaccctgaccattcatgtagaatagttgctttcacttgaaaatagccatagagaaggggttgagttggacctgcttgtatgtgtgcgtgtgcacatgtgtgtatatgctagaacatatttttcccctccacagatatgtgggtggctaattggaacctatcatgggcataagtggttaaggtttatgtggaaaggagtaactgtttatgagatttaggaaggaacatatttcgtataaactattttctaaaacatttacaatctcaccaagagatagagagctgaatagcaactgggggaagaaattgtgcaaagagaatctaaatgccccacctcttccttcccctcattatgaagcttctaggtctgcagagaacttagccaccagcattggatctcgggtgtgccaggggctcccagaggaagctggtgttttctcctctttttaaaagtagaagacacagaggcccagggaatgaagttaattttctagaagtcatgagattgactcagccctggctcagtgatcctcagaaaaaagtgaaaatacaggttgagtatccctaatccaagcatctaaaatctgaaatgcttcaaaatccagaactttttgaatgccaaaatgatgctcaaaggaaatgctcgttggagcattttggatttcagatttctggattatagatgctcaattggtaagtataatgcaaatattccaaaataaaaaaaaatcctaaatccaaaacacttctggtgctaagcattttggataagagatacttaacctgtatcaactcgtttcataactaaaacaccactttaaggtcggtagttttattacccccattatacagatgtaaaaactgggggacagagaaattaataatttgccaaagggaacttggctaataaatgataaaagtggcatttgaatatgaggaaaagcagcagatctggattttaatcccagctctaccatgtactatactgtactactctgtaaattcttacagcagttacccagcacagaccttcctgccccttcccaattcaatacttggcctctcccaggattttgaccctggcctttctcactagaacactccacatcttgactctatctcttcacaattcaacccctagtttgggttcccttcctcagggctcccagcccagcctaatcttcttctccctcctctttccacataacagccactcagacaccagggattagctaatatgcatttcttatatttgaattattatcagcatattcaaggggactttcctataaacatttaggctgcacaatcaccctgagatggaatgggaaggtattttataactgttttactggtgcaaagctttacattttaaccgatgtagaaaacaagatattagacattaaattttccagtgaatggggagcagagagaagctttcttctgatgggaaggaaaccttctctgctacggaagccctttctggcttcctcagtggggaaaaatcaaggaatgtgttggagagtggagagcatgtagaagaggccctccttctgcccccagaggctcaggcctctcagcctctcagtgggaatgtgagaatgaaagcatgcattagctgatgggttgacgctgctgcatgcttcacgcaaccccagttcggaccagctggctagcctttcgaagccgcacagggcagttccacctgggttcatgtagcccccagagaagggctgatgagctgctcagggtgggagctggggttgcttccagtgcttgaaggaagggggagggagagagtggcatccctgcctctctccctgttttcctcttccctcctcgcctcgtgtcccactcctcccatcttcctccacccccgcccccctcccctaaaatctgtaatgatggaggtagtgaaaagcagggaaagattgataatcagcctcattattaccagcattatatataattatagcaaaacctcactcatttggatcaattgagagaaaaatcagtctaaattcgtgacaagttggcagattacttttaaattacaattttattacttctaagtaacacatgtgaacagtttgtgtttcaagtaccacaagctaatggttactcagtggggattttagaaaacctgctttaaaagattcttttgtaattaacaccccgttaatatgccaatgtgctccttctatgctttttaaattgcttgaaaacatatgtatcttaaataggcttaacatttctaccatcttatttgcttaacaaaccttttttattattattttgtgaatgaacaaataccaactagtttataccatgaccagtttagtcaccactctgaattaattatgttgtaaattaataagaccatgttggttgtttttgtttagaaatcagacttttagaacttgaagaaccacctcattttatagaagagaggttgagagacttgcccaaggccatataggcaaaaacagcaggtcttctggcccctgggtccaagtttattccgtctgctagataatgccttacattcctaaaactctttatgaatatgtgctatttatttccataccaatcattgggttatctgtcaaaaaatatttggtgagtgtctattctgtgccaagccgtgtgcttaatccccatataatggggataataaaactacggaccttaaagtggtgttgtagttatgaaatgagttgatgcaagttaagtatcccttatccaaaatgcttaacaccagaagtgttttggatttgggattttttttttattttggaatatttgccttatacttaccaattgagcatctataatccaaaaatctgaaatccaaaatgctccaattagcatttcctttgagcatgatattggcattcaaaaagttctggattttgaagcatttcagattttagaggcttggattagggatactcaacctgtattttcactttttttctgaggatcgctgagccagggctgagtcaatctcagcacaacagatagaggggcccctcctggaggccaccgtctatttcattcaaacttcaaactgacagtgtagtccgtaaggcggaaattattcccattagacagattaggaaactgaggtttagagtgataaagtggcccttttaaggcctgctgcaaattattatagatctagaatttgagtctagtctagcagaatttctgtgaacatttctgcatataatgaatgacattttgcttgcacaccacctttcccagccagcaccaaattatagaccttgctagtacagatggatattatgccatctctaacaaatgagaggctccaggggatcctgctaacgaggaccggctggctgtccctttaagccaattccgtatactggtacatcatgtaccagttagtccatggaggcagatgtcaatgagtgtttgaagcagatgccaatgagggtgcccccagttctcctctcgttcctaaagtccttgaacatcaattatgtgcacacccagctcttgaatccatgacctctgtccattactgtctctggatttcttgttcagataggctctctctatctgaacagggcaatctctatagattgtcttctaaagacggcagtctcttaaaatacagcgaactatattcctagtcccatgttaccattgggtaatattcagaacattatctgttctcaggttctaaatccctgaattctttgaatccattcacttaaactcagccctaagaaaaatgtgcagaaataattaatctccaaatattttgaagacatcagagcttgtaactagtttgtacattctgccagggcagggaatgggcttcatgctcttggtgtcttacacagcccatatacaagcagatgcttagccaggcgtgctggctgactgactgactggcattcttcttggtctagggtgttcttcccctgctctccaacttctgctctccacatcgctagggctgtgaaaacagatactgtgagccctgaaccctccaggaggctgcttccccatgacactagtgaccagtaaaatgaaaaggaggagcaaaggagattttgagtcacagaaatgaaacccaggcaaccagcctagaagaaacactccaagatattcattaagtgctttgtttcccgttcctctgacatcttgtaaatgctttttgaattaaagatgataacaggcttttccacttttcaagtttggttgttaattctgaaatcccaccaggagtttgggattgatctttaaccttgaaactcttgctgtcccccacttctgtccccatctggttacagtagctgataaaagaggccaaggaactccaggttgttccatttgcatttgaggaaatggagggggtcaggacttctcaaggtcactgcctggggtgagggtctcctgaaaatgataggagttggaagtcccaggtcatggctccctttctgtctgacctcatgagtgcctgccctgggatgatttgttaaaacgtagttttctgaaaatggtgctccctccgaggcagaatccatgtcttatttactttgtcagcatctcatagtgtgcagtctgacactttaagaacaggcgaatctcctctaagaaaaaggtacataccaaattctagctaaatttagtgccatagtctccagattttctataaagggagctaacttttattatgtgtttacaattttccaggcttgattttatttaaccctcacactgtggaaggttaacccttaccccatgtggttggtggcattgagctattttaccaaagggtgggaggaggactcactgtggttcagccccctctactccccttcctgccatcctaggtggctccaaggggactcagggaaactcagtttgaagaccacaaacagccacaggtcatgggcaagccatacctcctttccccagtgtccttgcttgtaaccgaggggttgaactcgatgatctgcaggcccttctgtgtagctttgacagtcaatccagctctgtgaggggaaagctggaggaagagcagtgtggagctaaggtgttggggatcactgctaactgaagagcaatcagaaatggtaatgataataaaacttctccagaatgatcccctagaggtctgcaagcttattggaatgcagccacatctgtgtgcactagcttacccattgattgtggctgctttcacactacaaaggatattgtgagtagttgtcacagagatggtacagccagcaagactgaaatgcttactgtctgaccctggaaagaaaaagtgtgccaacctctactccagaatgcaaaattgggtttcacatattaaaataaattgaggtccacctggaaaagtattttaatccttgttttattagcacctttgggggcccagtcccctgcctcccactcctagtcattttgttcatttggtgcaattatgtgtgttcaaaaggaaaagaatgcattatgatccataagtaagttgtgaagagcatagggtaagaattgagtatcttagttgttcttacatataatccacccatttggggcttatctgggcttaccttccactatctcccctccatcctggcaagtggcaagcgcagtgcaggagttcagcacagcggccccggcacaagactgcttggatttggatcctggccctgctctttaccagctagcgggtcttgggcagtttgctcaatctccctgtggctccactttcctgtcagtaaaatggggatgaggatactaatagtaccttatttccaagcgcccttgagactattaaacaagatgatgcatgccatgcccttggaagggtgcgtggcacatagaagttgcctaataaatgttagccactccaagctgagtatcccttattggaaatgcttgtgaatcaagatatttcagattttgaatcttcttttgattttgtgatgtttacattatgtgcttacttgttttgcattcctaatccaaaaatcccaaatactccaatgaacatttcttttgagagtcatgtcagtgctcagaaagttttggattttggagcattttggatttgggatttctagattagagatgctcaacatgtataaagtgtttagaaccatgtctggcttgtggcaattgctcagtaaatattagttattattattgttacacaacagaggaggtgacagtcagttgttggttgaagtgcctgtacctggcaatctcctgccgaccttgctcagcagcatgtctgtgttaagagcgaagcagggaaaggatatatgagtaagtttgctgcagacaaagaaaaacaagccaggtgtctgagaatcctatcattgttgggccttcacaccatatccctccactggaggaacagagacaggctttggtgtgtgacagttccactgtgggagagatcagagtgggatagggccccatggtgctcctgtgacttcatatggagactcctgactctgaaaaatgccaagtctttagctctgtccctttccccatgggtgggcattagccgttatcaatgattcattacaagtttccattccaacctgaagagggttgctaatgggagagcaaactctctacccttcctggcacagcagcaaaggggtggaaacaccaggccatttgctcccttgtctggccagtcagaaaaactgcatgcttgacattttgcttttattggctgaggatgaggttgctaagcaacttccttaccttggtaagaattctgtagttctaagtaccctggcttttgtgtcccctttctcagtaagtctctctctctgacacacacacacacacacacacacacacacacacacatgcaattcattgtttagagattgtggttctggtaaacatcaggaacattgctttcttatgcaaataatttctgttgataaactttatacctacttgtatacattaattaacaaaaaattaatggacctcatagtctcaggagctctcagcagtcctctgagttaggcctatttgtctcaatttatgaatgaggaaactgcagtttacagaggtcatgttccgtgctcaaatttacatagctggaaagtggcagaacctcaacctagaactctgacttctgagctgttgtctcctcctcagtcctgcatccctgaagccatagtgccatcaatgcacacagggacttttggagtcattgtagagttatgcactgtacagattcccttctcagttttggctcctggtgacactcttagcacctttaattggaatgccaaatggtttgaaggcctaacatggtccagttgatggtgggaggtacccctcagcatctggtccagactcagaccattccagaccaccaacacctgcacttctttcttttcaatgccaacaagccatgtcctacccaatgctcacgaaacattagtgctggaagggatctttcaggtcactgagtgccagctccttactgggggaaatgagacccaggagtatgcaatgctattcttgggtatgttaccaggagagaagaaaaccttttgaggaactccactagcgctttttcattagataagttattttgcaaataaaatcattgcctgagcaaagataatgaactctgcagaatagacttggtgcattttccaggcatctggcataggtgcctggaagatcaagagggcacaggggaaggcagggagcaaggttgatgagatggcggggccaggggtcatgccacagagtgaattgggctgagagactggatcaggccatttgtgctgctggtatcttgtgctacaaaatacctcagactaggtaatttataaataataggaatttattgctcacagttctggagacttggaagttcaggatcaaggcacgagcgggttcgtgtctggtgaggtccactctctgcttccaaagatggtgcctcacatgatggaagggatggaaaaatggacaaattgtgcatcctctgatgcagaagggatgaaaggtatggaaaaatggacaaattgtgcatcctctgatgcagaagggatgaaagggccaagtagttcactgaagtcctctcttataagtgcattaatcccatttatgagggtggtgccctcatggcctactcacttccaaaaggccccacctgttactactctcttatggtttaaattccaacacaaattttggagggacacacgcattcaaatcattgcaaggaccaaaagggagcattagggaaaaccttgacttaagatttggactagacttatcctaggctgagggctagacagaatctctcctggataaatttgcaagaaacaccactcatccttcaaacaggagcctgcctactttcagctggtgctgaagggaaacctgtcagttttctgcctagttcatagcttaatcagaaggctctcagtggggaaggaaaagaaataagatataatcaggtatctggaaaacttgtggtgccttttggtattggctgcagtttccatggggctgtggaaaaacaaacaaaaaaaaggagtgagagaggctgacaaaaacatcacagacaggtatgcattagtgtctatttgggagaatagattaattttccattgagaaacacttttgtcataaaagttgttgttttctaacttgtctaaaagcaaagctatttatttctaagaactactgggacattgtgagaggcaaagaactaaaatgcatttgtctaagatgtatttgtcttttaaaattctattttattttttaaaatgtagttataaaatagcccacctcttctgggtcattgactcaacagaaataaatcatattttaaaggccattgagaaccaaactttaactcattatttcattgtatctcaacaatgtaccattctcaccactgctctcagtagtcaagttaacttacttcttattaataatgataacaacaacaaaaatgtactttaattttcaaatcactttcacatcattatctcattttatttttgaaacaactcatgagttcttcaaagtccatatttgtatatttttatgcaggttgatgttttttaaacatcattcctttgcatactattttcatgatattttatatatcctctgtacttagactttttcttaaatcaatttactgttttaagaaagcttaaatagctatctttaggaagataattttataacaagaaatgagagctcagtccctccctataaacaaaaggaaacagaaagcataaatataaaactattaattttttttttaagtttgctgacataccacttaaaatgccctttgtcactggtggcagagggaccacaccctggaattcttggggtgatgagtgtgaagcaaactcttgctcttgcctgtgccctcagtctaggcctgatgtcaggctttggttcttgaccctggggataaagaaatagaaaggcgcagtctctctgagatctgtttaaagcagaataaaaaggaaagttgcagggtggtctggtctgtttttggcaagcctaagcaagaaggaaaagtcaatttccttcagatagcttggtcatgggggaaggacagctgtcttctcagtggagtttatggctcctcacccattgaatcagggctggcgcctaactcacctgtcacactttatcttagtaacagactcaaggtatacattggcctcgttaaatgtcacagcccccagggcctcagaagagtctaaaactgctctttccaatgagtggccacctgaagagtcttggttttcttggctttcagttcttgagcgctgccctcttttctctccttcagatgaactttcagcttgagatcacttcataattgagtcatcttgtactcttggtgcagatggctctccaatcatctttgctgtccttgacaacaaacacagaggagagcgtgggtttcagattggcaatttgaatcaaggctttgccactaactacctgggcagtgccaggtaatctgatagagatggagaaacaaaactggacatggttttttcctttttgtttagtgggaaagacagggaataaacaaatatagtgatacagtataacaaatgctaagatacaagtaggaacagacagttttaggaaataaaaaaagggcaggaaaccagaccaggaacaccaggaaaagctttgtggaggaggtggcacttgagttagaccttgaaggttgaataagagcttctagacaatggaggcaggggtaagtcatcctggaactggaaatggtatggggttagatggagcctaagttttctcatctgcaaaaggctgaaatgattttcataggcttattgtcaggataaagagttatggaaactgcctgatgctattgaggacacataataaatgtttgagttattaattttaaccactttgccatgcccctgtgggcccacagcatgtgttttctccttgattgtggtacttaggacatggggtattgggacttatctgtttatgaggcaattgtccctgatagaccaaagctccatacgtagaatgacaagagggtcacagcttccttggagtgacttccttccacaagtagccctcaactaagctagcagaagctccaagagaaactgcaggttgacattttttccagtggaatatttacgtttaagaatagtttcacagttatatttctgacacttcctgctctctaccagaacttgaaagaagccagtttctcctagcatcctactcctgacattacacttagcacccactgatgttgcccaaaggcttaggacagtgccttgcatgtagtaggcactcaagaaatatttgttggatgaataatgagccacataaagtcaggcatatgacttcctccacttcttatcccatctgcttggcaaggtgtctgacccacagtaggcatctgagaatggggtagcttctccagcagactgtgcttactgagcacttaatcctctccctttctatccatgtggacagcttgggtgccatggatgtgctgcgtgcagctactgtgcacatggcttcttcacatctgttcttgcatgctagctgcacagggatctagtgatgggatccacggtggggtgccctgtggtgttttctagtctctgctttgctgctacagatcctaaagcttatagctcctctcttctggagagaatgttccatgcggggctcccaagatgacaggagggcactctcctgtttcatctcgagtttgctactgactacaggggaatgtgggttcaatttattggaagaaagtgatactgatgacctcctcacccagaccctgttccacagacacttttggctgcagcattctattcttggaggcagaaatggtctcggcagtctggtctgcatttgccttcctgtgctacctgggcctctgtggccataaagccatgcctagccattccaagtcttctcccctgagtgctaattaaccctgtactatagagagggacaggacaagaacatcatgtacataaagcttcaatagatataggaaactaggggtatgacaacagccactgccttccccatcattattatggaatgtgactcctgatgtcagcgactgtgtgctcttctgctctgaatccccagcacctggcaccctaataaatgtttgttgcatataaatgaatgaatctcagccctgccctgattatcagagcaatatgagttctagtcagggaattatggagcagcctgggaacctactcactctccccatcgaggtttggtatagactcaccttccctggctggctggcccaggcctcagtcactcaggctggggtcttctggactgtgccccttgttgcactggctgtggatccagcatagtccagagtggattccaagctgggccccagagaacatccatgcttatttctgtcctagagcaggccctctcccctctgtgtccctcgcttgtctttataccaccagggtagtgtaggtgagagcacctagggcttacaggtgtgtaggtgtggctaaaagaggggcaggatacaggaaagaaaggtggggctaggcctctgtcccccagggcccctttccatgttccccaacctcccaccatctatattcttcttcttacaggctcccctggccacactggctctacatccatgagcccatcagcagccttgtccacagggaagccaatggacagccaccccagctacacagataccccagtgagtgccccacggactctgagtgcagtggggacccccctcaatgccctgggctctccatatcgagtcatcacctctgccatgggcccaccctcaggagcacttgcagcgcctccaggaatcaacttggttgccccacccagctctcaggtaagtgttcttcctctccaaggcctttccagccatcttacatggtttcacccaggctgctcctggagcagaaccagcactcagcaggtccataatgcgtgcttgccaaagggtttgaatggtctctgcagacgtccctcaggcagggccttcattgcatgtgtcctcaggctgagcagtcctgaagaactgacaactcctcatggtccaggagactgtgaccaaaagggggccttccttgtagttttagcagttcagccctggctgtgatttcaacatctctcagcagaatggaccccttttattcttctcaattcaatcatgagcatttattgagtcactgaagtgccacgtgctcttgttaaaggcaatgcagaaatgatcaggaaatggccattgctttccaggagcttacaaatgagaggagaaataggcaggtatgtcaatggataagttgagaacaaggcagactgcattacatgctatgctgtctctgagactatgggaggttgggaaggaaactttcccttaatttcgagtgccttctgctatgatggaggagaagaagtatgtgcatggtgcatgctagattgctactctgcagagcctataggatggccagatatctttacttccttctagcaatgccacactaagttcatcatccttcccatcttgtagtggttggctattgctgcaataatgctgcataacaaaaatccccaaacacttatcttctcactcatatgtctaccttaggctaggacagatggctctgcttcagatggtgggtgagtgggctcagctgcaggctcctcatgtttcagtaggagtggcagctacttgggggcatgcttttctcatggtgtatcatagaaatgcaaaagtccaaacccaatccagaaagcacagtgaagcctctgctcaaatcgtgcccactgatattccatcagcctaagaaaaccatgactgattcaggccgggcacggtggctcatgcctataatcctagcactttgggaggccgaagtgggtggatcatgagatcaggagatggagaccatcctggctaatacagtgaaaccccgtctctactaaaaatacaaaaaattagcccggtgtggtggcaggtgcctgtaatcccagctactcaggaggctgaggcaggagaattgcttgagcctgggaggcggaggttgcagtgagctgagatagtgccaccatgccactgcactccagcttgggcaacagagcgagactccgtctcaaacaaaacaaaacaaaacaaaacaaaacaaaacaaaacaaaacatatgacagattccaacattgatggggcaaggaagaaggctgtgtctatattagtgggaagtactgcagagaaacaatgcaaagaatatgaagaattaaaaggagtgaagtattaggaacaataatcccatctgccacagcttcttctctccctgtataacagccagagtccctgctgccccaactaccagcacacctagaggcagaactggcagggcctttatgtgtcaacttgactgggccataggatgccctcatattcggttaaacattgttctgggtgtttctgagagggtgttttttggatgagatgaacatttaaataggtagactgagtaaaggagtttgccctccctaatgtgagtgggcatcatccaattagttgaagatctgaatagaacaaaaaagctcaccctcctctgagtaagagaactttcctgtctgatgacctttgaactgtgacgtcattttttttcctgtctctgaacttgaactgaagcatttgctcttcctgggtctcaagcctgctggcctttggagtatgtcatgagcttttttgggtctccagctcactgactcaccctgtggatcttgggacttatcagcctccaaaatcatgtgagacaattgcttataataaaatttaaaatatatatatacacacacacctcctatagattctgtttctctggagatcactgactaacaaagtcccaaagcctcctttgaatacagttttagagaggaggaagggcttcttttatgtcagcattttctgctactccagagagaacttcagtgaccatgcctagagtctcctctgagacacctcatattctagggttctgaaaacaaattcatgtggagttatagcatagagccagtaaggacttcaaaaatgtattgctccatagattagataatttggagacggccttagagatcagctagtgtagggattccaggagctgggcccagtcaggtaacacaggtgagtgaaggaagggttgtgtaagtcaatggggcaggtgtggactgtggagagctgccctgctccctcaaagctgttcaaattcaaagacttttaaagcattcctcaggccaaataaactactttactgggtataatttggccagtaatcttcaccccagtttctaatcttatggttctcacctgtaggacctttttcagagtacacatttctctctcatcccatattttgacccttgtgcaggtagcaaaagccccacaggggatcctaactgccccactcttgctcaaatgaggatcactcattctgtccaaaccctttatgtcacaaatgaagtaccaagacttggggagcccaagtgacttgtgcagcctcacacagccagtcaaaaacagagccacaatgaaatcctgtcccctggcttgcagccctgtgttcacaaccctgcatttgcctaatgctgtgatatatgctgacttgcacagtgaccccaagatcttcctgttggcagccaaggattaaaagatggataatcagtgctcccgggtaatcttgtgggagaggtggccacattatgcagatccattgcacttcagtgctgtctgtgtgctgtcatagacgcaggagcagacctgaagggagcaaagagagtgaattataaactgcttaatatatattccttgaccccagtgctcagaggagtggggatggggcagcagtgggggtgtacatgtatttatgccacccccacccactataatcagcagggccattgataccctatgcttcataatgtatgaggtttgtttgtttcctttctttcctgtgaacagagtccaggaaggcgagtaaaatctggtagttacagacagaaagtacattgtagtttggggatgaaagtacagttttgcaaagggcattgacattcatcccaataactacttatgtggacctgctatgcatcaggtactaattgatactgtcctaggttttagggataagcacggaataaggtggccaaggtctttactctcatggcaatcacacaatagcaggcaggacaggcaaaaacctaaggaataaacaagatagtttcaaataaaaatcgtaatatctgaaaagaaataaaatagggtgaggtggtagacagatcctgtgggtaggaattgggcaaggcaccatccctctgaggctgcttttagcaaccacactcaagtctgattgagccaaacatggccagtcaattcatcttcagagctgtgtgagtagcagggccgctattcctggaccatatgtctgtacagagggattggggttgaaaggtcagatggaagctttggtcctggccaactgggctgtgtgcagaggccaaggccaagtttggctttggggagctatattaagcttgccaagtgctggggaagctcagcagcctgagaccctgagcagtgttctgggcttgggctccggaaccacactgcagcaatgctttgctcggttaacgagatgacactggaaaaaaggccttggtgttagctacagtgagctggactctggatcgtctgggcagattattcctatgcatcctgccttcctcacccaggactggtctgagagggattcatgatggaagcatgttcattctgtgacctggttctcgcgtaagtacaatttggggggtgaagggaggaggaagtgtctaggggtgggagcagcaggcagggccagtctcctctgtgctctgtcatttcattgtttgagcttctctttttgcagttgttggatttttgatcttgaggagtaaagagatcggaactggtacgatgaaggcaggaattgtgtaatcttttgcaaaccactttaacttgtttctgtttcagtttccttttctttatcgtggggttacaaatacttgccctgattaccctacagggatttttttaggcatgtcaaagaagatgtggatttaaaaatcacttctcaagacgtgcgatgctctatagcagtaacttggtattattaggattattcccaggtgatagtattatacacttaggtaattcaggtgtactgtttctgagaggttctagagaagttcatttcaacaagcatttattgaaccaggcccagtactgggcactggagataccaaaaatgtgtatgagatttaatccctgccctggggagcatctaagtggagtgatgcaatttctaaagacatcaatatatcattgggaagatatttatgtactttgtagataatgtgatataggaaacatttttctgagtgtgtttgtgtgtgtatgtttgatactgcatctttgtcagcatgatgtctgctggctggactccggaatgggcctcacagatctttgcaatactcctgtctttttctcccctcctgaactctgcagcctgacctgggttctatcattgctaatttctgcttagatatttattgataactgaattattatcctcttgagtctgtttgcatttttatagaaaataaataaaaattgcaaatgttagagctggaatagaccttaaagttcatctcgtctgatgattttaaaaaattaagtcatcaagtcttttcttcagatgaaagcatagttggaagcctgatatacacataagataaaagcagatctggttgagccagggacaaaagacttgaagcctcaacctccctccccaccccccccagcaacacacacactcacctagaaatggggaaatagagtctttgctaagtgaagtgacctgattaggaagtcgcaggtttagaccaaacccatgttggaggtccaggcttattactcctcatgatgaaggccttagctagattaaggctgtgacactataagagttctgctccctggaacgggagtgcctgcctgcagcctaacctttggtggaaggatttgggctgaacacagttcagaaatgcaggactcaatgttcaaggatggctccagaagcatgcagaatgaattggtccctggctgagtctgcaaaagggaagacgatccagcagacaagtatgtttctttcctgttctcagggagcagctggcttgcgtgcagcagcagataggagttgcctggtgaatcccggctctaaagtgcttatttcagtagactgtttctaatggaacaagacagccgggattgggggacttggggaccaggcagctaatgggtttatgctctgatggctgcctttgatctcatctgccattgctctgagcccaaaacaaaccccaagccagccagagagatggacagagaaaacatcaaccaacctgtctcactgcccctcctgccactatccactcatgaagaggaggagtgttggagaggggctgctggctgagactggggagaaagtgccccaaagcaagtctgctcctgcaggggctcctggccaaggaggtgaggaaggaagctgctagggcagttgaggattgaggatcacctctcacccaaggcagacaatgtggtgaatggggaatgatgatctgagatccaggatcttggggttctggctccaagcagtcagacctggtaaggtacctaacctggtatctgggcaggtgcaataccttggatgtctcctctaatctttcctcatgctgtacctcattcactgtattactgaaatggtttcaggtaattatttctctgctccaagcctctagtggctgcttattgcttcccaaactaaatcaattctcctagcaaggcaattcagcttctaggctttgtcatagcgcacttctcagcattatctcccatccatccactggacatgtttgctccacaaacacttgggcttccctctaggcctctgctctcaaagccttctgcccatcactagcccatccaaatcctacacatttttgaaggctgtcgtcccagctcaaatgccacttccttcatgaagccttccctgatctcaatagcatgtgatctttccttcctgaatgatccaaactgacttttaatcacattaatggccaattccttgaggcagtgcctgcatctccttccgttttggatctccatattgttcctgaataaacaaatgaataaacccactttaaggctcaatgtccttatctgtaaataggaagacctcttagggttgttgagaggattaacataattaattagcactgagcaagctttccatagatggtagcaatggcaatcattactatccgtggttgctgctggctggtggcagtggagctggtcctgctggagttgagggtcggaggagaaggaagggtgaggaccccttgaacctcaggtggtggtggtttcttccttattcccatgacttttcttgtccctctgaggacttggggacagagccgtggtcagctagagggctctctctgtggggtcatctgacctaaagttcttccatttcatgagtcggatccaagtgctaatctctgtttctttgaggcacttgaggaaagttattgcctagaagtcacgctatggcagtggttcttaaccctggatgcacattaatgtcatctggtgaaattaagaaatgccagagccagccaggcacagtggctctcccctgtaatcccagaactttgggaggccaagacgggcagattgcctgaggtcaggagttcgagaccagtctgaccaacatggttaaatcctgtctctaccaaaaatacaaaaaagttagctaagtgtcgtggcatgctcctctaatcccagctacttgggaggctgaggcaggggaattgcttgaaccagggaggtgaagtttgcagtgagctgagatggcaccactgcactccagcctgggcaacacagctgtctcaaaaaaaggaaaaaaaaaaaaaaaagaaatgccagagccaaggccctacctcagactcatggaatcataatctcaagacatggatgaggtccatgttttttttcaaagcccccagggatgagaaccagtgtactacatgaaaacaaagcaaaatactggttacaagttccacatgtcttctcatagccttgtataaaaaaaggggtggtgctggaagagggaattcttctatcacatatgtgttgtcatttattatgcaaattaatttttaaaaattaacagtgatgttgatttcaaaacaaagcaccaaaggctgtgtcttttcttttttgtatccctcatagtgtttaactgagagcctctgtttgcctcctgcgctcaataaatatttgcttagtgaattgaaaaagctcgtgaatttagaaggaacctagcttaggctctattgtagtttctgttttattgaacctttcttctgtcccaaaggccttgaatagagaggaaaatcatacctttgattcagtttgagtattattgtccctttggttaggcaatatgattcaaaattcagacaaaccatgggaagtcagtagttcctaaccactaaacctttacttctattggacaattacgaacatgcatatcctgcaccaccttcgtttgaacttgcttgtaagtgttcttatttttttgtgcatgttctgactccttgatgacattgtacatttttgaggaatgagagatataccttctgggtttctattgctgattggatgagtggctcaaatgtattcaatttgctttctttggtgaacacaagatacttagcctcagtttctgaggaatcttaccaagagcactgggagatacagggatggtgatggggagctgatattaacttacaataagggatgtattcgagttagcatcttcagtgtgcttgcagagatgaccattacacatgtcctttctcattttaccgtgaactccttctgggtgtgtatttttctttgcctttgtaccccagagcctggcacagtgtctggcattctgagtgcccagggaatatctgttgattgactaatgaatgaatttgcatttttttgcttggctctcttagagtgtaagtctttagcctgagggtcgtagttcctcttgcagcacggctgaataggcagtcaatagttgataaaaattttaaaatacacagttgacattgtcctgggtgtgtaatttggcatggatttctagcttaaataaaacatatgagtaaaatgaataaaagcagatagactctaatggagatgtgttgtgatttttggtttaagttttggcttctagaaataattttgttcctcctatggcacttttatccctcccttaagttcatctcacagataggcagtttcaaatactctgtacttggaaactgtttcttgaaatagaacttgttttttcttgagtaagccctcattgccttaggccttggggattgaatttactctggctctgtgctttacagtatttttttctcttgcagctaaatgtggtcaacagtgtcagcagttcagaggacatcaagcccttaccagggcttcccgggattggaaacatgaactacccatccaccagccccggatctctggttaaacacatctgtgccatctgtggagacagatcctcaggtacatgcagaagcagacactccctgaaaagtgccacagagaaggggctgctcactgtctgcctggatactttgtactcaatgaaaggaaaatggccctttaggatgggctaactggggacccacctatacgtttatgtcactgggttcacaggctgccgttttgatgaatttaaaggatggctttattttttgaggatgagatttacaggaaacatttcagaaacccttctctggagtcacactattacacatgtatctgagagacagaagctgttgtgattatcaagtatttctgctgggtgtggtggctcacacctataatcccagtgctttggtgtagtcccagctacttgggaggctgaggtgggaggatagcttgagcctgggaagtcaagcctgcagtgagccatgatcacgctactgtactccagcctaggccacagaatgagactccatctcaaaaaaaaaaaagtattaagaataacccctcccagataagcaattgtaaaaataatgtcctaatgtagaggatttgaacgaactagaaaactgcaaagaaaagtaaaaaaattacccataatgtccccaagaaaaataaaccctttaatattttagcgtatttcttgctataacattctagattttcaatatgcttttataggcagaaataaatgtgttttcaccaacttatctttgattctcttctccttttctcagttatttctttccttgcttctttcctctccattcttcctgccccatatttccctccccatcaattttgaacacatccgaatctccgatttgattatttgaagaacaataataagaggaggttattctcttttctatagctgtccatgatggctaactgaatatttccttatactcttaatgccaccaaagccactaaagaatgtcactccattgaaagttccaggcacctagaacttacctagctgaatggctgatgttttcttgctctcaaaaaatatttcccaaatcatgcagacttggccattgccataatagcacaccagccacagcccgacagtgttttctctgctatgcttattctagttgaaagtctatgaggttcatttaaatattgaaaagccatgggaatgactatgtcacacagttgaaaaattggtcccatatttctctaagacaaatatttcagaactgagagcactaggttttctgggcccaagataaaatcctgtatttatcattgctgtgagttcagcaatgtgaaaagccggcctgtagtatggtcaaccaatgaggcaaaggctggcttttcttcaggcaggctatctgtacccatcatttcatcttacagtggcttcctctgaactgtaaactcctgagatgctggaaacctaagtaaaacagaattagaaagtcatgtcatttctgtaactcaatgacatcacatattacattcaaagaatcagacacaaatatgttttgaatgatttgtttccttatatttttgaagttctgcaatttcaatcaatcaagcatagtgcctggtattaagaagacttctacctagaaaaaggattgtgattgattcatgatgcctgtctgaggatgggcttggtggctctcctgacctaaattagccacccctgcctggggtaattgaaaactgcatgtgtggacaggtaataagggcaatgaaatatgcaacaaattagtctggattaagcaaaatcaccttctttttttttttttttttttttttttttgagacgggatctcgctctgtcactcaggctagagtgcaggggcatgatcttggctcactgcaacctccgcctccagggttcaagtgattcccatacctcagcctctggagtagctgagaccacaggcatgtgccaccatgcgcggctaatttttgtatatatatattttaacagagacgaggttttaccatgttggccaggctggtctaaaagctcctgacctcaagtgatcttcccacctcagcctcccaaagtgctgggattacaggcgtgagccaccatgcccggctgcaaaatcagcttctatcagatctttatgtcatagcttgattgtcatatgatgatataaagatcaaacagcaattaatttcctcaacagtcaatagcacttaacaattcataactcagaattctgttcatagtttatggtaaaggataataaatttaaataggtttcctaagaacttgggtctcaattataattagttaagttggggttcttttcctgctaggtaatacgtgacaagcatatatatttttatttattatttacactaatgttttgaatggaggcagaacatttgcttaactaaacccaagagttgcctttataaaataaatataaagaaagccttagctttaggaattttctaataattctctctggaattagtaatgcagaggaaagacacgaggaaaagtgtatttgctgtgtcttagtttggttcctgtgatcaagcctgcattctctgctagtgattatttgctttctgtcccaatgcccaagtgatatgcctgtttctctgggggaagagccaagaggttcttttgaatgaaagatccaaataaacacaagaacaatctatggaatgttcttttcttctaaccaggaaagcactacggggtatacagttgtgaaggctgcaaagggttcttcaagaggacgataaggaaggacctcatctacacgtgtcgggataataaagactgcctcattgacaagcgtcagcgcaaccgctgccagtactgtcgctatcagaagtgccttgtcatgggcatgaagagggaaggtgagacacattcagttccaaaactcgtgtccggagagaggcatttcctaggcaaggggacattcaactgcaatacacgagaagtcatggtgcccaaagtcatcctaatctccacttcaaatttctttcccacagggctctaaagagaagtctgaataggaaattaggatgactttgggtactcgtgtattgcaattgaatgtacccttttcctaggaagtgtgtctctccagagcagagagggcaagaggcatcttcctcctccacatttacccatcctcttctggagcccagatggtgatccccaaactggaccgtctccttttttcttccaataaccaggcagcaagtctcagagccaaggtttcagggtccttatgatctgctctaccaatggatcgtcagactgaccttcagggtggaggtgacttttctcctctaatcctaggtctctctctggggcaaactgtaggtttcatttcactcactgagttttttttacctgggtctgctatcaaatctttgatattggtatattccatcatcttttggcattactggcattacacaggtttgacagacctaaccttcccattcagagagaccaccactgtgtgttgaaaccatcacatcttttaatttatagtgtggtttagctgggtattctagtatgagagaaaaaaacctcagaaggtgctttctgtcccgttagtagacagaaaagactttccattaagtatcacagataaattgaagtgggcagttaattaactagtgagctcaagcagggacatggggatagtggtgaatcttaatagattttagagtaagaaggtcctgcctctctttaggaaataagaacaaggagttcagtcaggcccagcacgctcctcattcttgaggaacttcttttctgtgagaagagggcatcttactgaaagggtcaatgaagaggggctctttgtgtccctgctaaaagtgaatgtcacccatgagcaaacaaattcttgtaatcttaacatgtcaagatgctagaggtggccttacagagtcacctaatcaactgtaaccatccgccagatgagaaaacaggctcacagagatgaacggagtttcctgaggtgccaaaggcagttaatgaactgaccccaggtctctgactttcagatcagccctagtctgtgtctccttccctgccaggttgtgaaggaactgaagatggccctcgctgtgacatttaacagcaacctcaaaagtgagagacccaaatctcagctcctgaaaatctgccccacaccccagcctgttcctcacacagtcttcccctttcaggaaatggccacttattttccagttgctcagaacaaaaaccattgactcccctcttttttcacacaccacatgtagcgggtgaggaagtcttgtctcttcctcaaactatgcccagaatctttccatgtctcactacttttaccactaaccccccaatctaagctaactgtatattttgtagtgatctacacagcatcctaagacatctccctgcttccatctttgtcctcctacagtctcttcttagcacagtagccagagggaggctttgaacaagtagattgggtcaaggtgttccttcagcagaatcctccaatgtctttccttctcacccagaaaaaaaggcaaaaatctttgtcatgacttaaggttgtacatagtctggatgccctgttgtctctcagcctcagccttcctggcctctttggtgatcctcaactataccagagatgcacccacctcagggcctttgcacttgctgtctgtctagaatgatttttttttcaggtatctgatggctcactttttctcatccttcgtatctttacccaattctcactttcttggtaaagccttgcctggttatatcatctaaaattgcaccagccacccccaacccttccttgtctcttttacacagtagttatcatgatctaacacttgtacttatcttgtttactgtctgtatccatgaaggcgggggcttcatctgcttttttcccccactgctttatcaccagtgactaatacattgtagccatttaataaattgttgaatgaatagtttaaactgaatgctgaaatcagaagttttagaagtgcaggagctcctaaaaatgactcattcatttattcattgagtattagctgagtgcctactctgtgcttacgtcatacttgctgtggcagtgggatcaatgatgttacagattggagcatgcgatatgaaatacctgctggtgaagaacatcttttttccaccaggatagaattggatactccttggagcttcccccaccatgattatcaaaatgaaactaatgactacaagtatttctcccattaacaagagtccagtgactgcagggtcatttttttccctcctaaaacacttgagataagtttccaattgacttggaacagtaacagttttcattaagcacatgatattgaattaaaggaaagtgaatggtctcagtcagagaaaccatcatttctatttctctagagttattctaatccatctctgaaaatgcaggctgaatatccccagctcagttagggacagagtggtcaataggccaaatgttgggaactgtggttcgttaaatgtttttaaaaaaggaaggaaaacagggacatgtgaactgtaagagacacttctatggtttgggtactttaatagaaagttggacccaatttttgctcctgcattttttaaaagaatgtggagaaacagaaagaatagtgaaaagctgagtagtaaaaattaggagagggaaaggagctcttagggaactttctgaagagattggcaccatttaccctgacaaagggaaggcaaagaagtgaatcaattcctccgctgactatataagggggcgcatttcaaaaggctactggatagcctgtccaccgccatcatttctggtcttgatttatagaatttggggctcagtttgaacactttcttgaggacaagaataataacatcctggagcagataacagagagaccatggaaatcacacagataaagagatggaattggggtaggtacagaatttacctgcctgggatcaggggccaggacctgttgcccttttaggataaataatgttaaagctagagtggacattttctattctctaacgtaacacgtccatttcctgaaagacaaattagaggtttggagagcctagcccacacaagcccacacagcaagcacatggcagaccctgtataggactgggaccctctgattagtgggccacctcaggaattctggaatgtctatttccatgatttcttgtcatatacatgtagtttcaagactggtgaatggattgcctttgaggcagttcatgggcagcattggtatccttgtgagccctgtgtggtctttattaatagacctagcccagtaccttggaggcagtactgagaggttagagatgggcccaggaggagccattgtgggtgcatgtgctggctccatcatggcctaccacatgccctcagatatgttactagtttctctgtggctcgtagtatgtcagagcattattgtgaggattaaatgaaatgtaatctatctaaaatgttgagcataattcctgacacagagaaagagcttcataaattttgcctattgtaataagtgcgaaataaacacgtgttggatgaatggttaaaatcctttcctaaggcagaagtttggttttatttttaatcatccagggttccctggatgtaccctgatgtgtgtcgtaacagtagctcagaatgtctgacaagtagaagctaccccccaataacaatatatgactcctcatttatgacaggaagacttaaggcacaaagaggaaaagtgaatagcaaagggtttgctcatacaaaaccagaattcgaatcaaattccctgacaccaaggatattttctctgaagcttgaaggttattttccttgagtgttacaaatctctagaagacattgattgaggaccacgaatgaaacttaacttagtttgctttccctcatcttttaaagtcaagacaaatagaagctcataacctacctttaaaaaaattaatacaagaagcattcaacatttcccagtaaatccaaatataataaaaaatacatattatagtttctacatgttgtcagtgaatgaagtctgacagagtgagcagaaagtaaggatgagacagaaggaggaagaaaacaggagagagaggaagaggccaaaaagggagatggagagatgagcccaagggggtaaaaagacaccaaaggcaagaggaaataactatttgtattgagtttttataattgcttcattcatccttacgatattatttcagttaactactgaagagtaccaaccttaactaagtaccagccttaactatctcagttaatctctgcttcacagataagggatctggggcttactaagctcagtcatatggccaatgccatttagcaaggaaggggtagagttatatgtgaaaaagttttctttgactccaaggcacaggttttttcccctcttttcactattttctcctctctgttctctctcccttctgtttcctctttttctcaccctgttttgttgtctctttcccttattccttttcttctttctaccctccttgcctctctctcaatgacacagtaccattcttgtcttgaagctttttggcgtatctccactaagttttggagtataagttgtgtttttgcagtcatactcttctctgacctaccttgagagactgatatggctcgcatgacaaactagatgttcggcattgcgattccagtccattctgcagcctctggggctcattatctcctcagagagtaggaggcactcttgcaagtggactatggggaggaagggagagaaacagaaataggagctgctagtggagtagctgtcatggagtttcaggctagtcacctgcttaaaggataattttcttgactttggggatgtaaaaaatgtgttctaatattgaattctgtttattgctgctgtgaataagatggaaactacagccttctagatgatggaaactaacccaacagagacttttctcctgatgaagagcatagaattggagggggcagcagtctgctttcaatcctaatgtatagacatggagggttctgagagttgcactgaaccttgatgaaaaccctaagctttggagaggctgagataatttcagcctacacctttgcctatgtaccctccccaacctccaaaatgagccactgattctgaaatgtcatctaggtgacatccctccaccccttcacttactaaatacccacagctggctccctaaagatcttccctgacaagtcggatcaggtgatgttgtgttcaagctggtgcactaggggcagacctaatgggacgtgaatgccaaggatgatgcataggatctgacagagggagtttttaaagtaatgtgcttgttacttaactatttcatgctcacagttttttagaggcagcaggtagagcaagaatgtggggatctgcagggatagcaaggagtggttggcccattaaaagagaggatacaattagagtttattaaagcttaaaatggatacttcctagtgtcgtcaccataatgcattggaaagaatatgcactaaagaacccctcattctccttaggcataagcaaacagctttgctttccttgtttcatctgtcaacattccaacatccccaattcaggatcataatgattcccctttcatagatgagtaaattgaggctcatgtgggtaataaactttcccactgttgtcctgggcattatggtaacctctgcatgtcctgctgcatgtcagctgtgcaagaagaaagacagaggagccgagagcgagctgagagtgaggcagaatgtgctaccagtggtcatgaagacatgcctgtggagaggattctagaagctgaacttgctgttgaaccaaagacagaatcctatggtgacatgaatatggagaactcggtatgtgctcttagacacacatgtgtgttccatttcttgggtagggctggaaatgggagaaaggggtgtatttgagtcctgggacctgtgcctcacagtactttgttcctttttcagacaaatgaccctgttaccaacatatgtcatgctgctgacaagcagcttttcaccctcgttgaatgggccaagcgtattccccacttctctgacctcaccttggaggaccaggtcattttgcttcgggcaggtaaagcacattggctgccttttttcctgggacaattttgaaattgctcttgggatcctaaaaaaagtagcctgatggagctgcaacatgtccaagctatgtaccatgctgatgatgaaataaccctgtgcggggttgttcattcccaaaggaagcatcgttaatgaagaagtgggactcttttcccatgcaaattttaccacggctttataatttgcataaattttaaaaagactattaaatcattttattgaggataatttgaagcagtggctcattattgtaatgaaattggcaaatagaggtattcccatttcataggtgagataaagaagccaaagatgtttgctcaagcttgtactagacgggttccactgtcttcctattttaagactctatgtgctgtattttcttttgcctcctatttctgggacacttgcaggccgttgacatatgccatatctcctctttgtcactgagccagcagggaaatttcatgaagattggctgagcattgggaaccagtccactcattcatccctgttagataatgagcactcactgagtgtcagctgaaagctacagactgtgttgggtgttactagacaatgccaaagaaacaaaactaggttgtcagatcctaaggggaaaaactgcaaggtatattagctttatccaccatggcagctaacatagtgactattatccgctaaatgttcaacccacatttgttgactgattaaaaaaaaaaagaatccttgtcttcaagctgtcattctgggttgcatctgagagagagtggggggatgtgcagagccataagtcaggagaccccagtcttatcctttgtttcttcgctaatgaactgtgtcatcttgaactaattcttaacctccctagattgtcaattctgcttgtgttatgtgggataatagtacatgccttgggtgattataagtaaagaaagaatgtgttctgttttccctcaagacctcctccttatccttgcagggtggaatgaattgctgattgcctctttctcccaccgctcagtttccgtgcaggatggcatccttctggccacgggtttacatgtccaccggagcagtgcccacagtgctggggtcggctccatctttgacaggtgtctctctcctgcttccagtatttgtgtgtattatgtgtgtgtgtgtgtgtgtgtgtgtatacacatgtgtacatacatgaattctcacgtgggcatgaacctctgggtagtgctgggatggaggatgggcagcccaaacagttagctacacatgaccatgcagagaccactaggcacatgaaactataaacctggggaatgagggagagattaaaagaaagattgagatcacaataagatggagccactcagaggccagcacagttgccaggcagttgggagaacctattctcccaatggatttcctaaggagagattagatcttgacatcagctagtaagttgtgggtggagagggtgaactgtttatcctgggggccaaggatgggaaagggatcaggatctgtcctcaagaggccaggcaagatggactgtttatgctgggctctggatgatctcagaaggaggcctgcagcaggagcaaacccatcttcgtcaggcagggataccctgacagaaattctgtgccttaaatgatactaaaggaaaattaagccatctgataaggagttgaataaaatgagtagttaatgacttgagagtgagaggatggagaactggtaaagaggagaattaagttgaaattaatctctctgtccaatgccagggccccgttgtccctttctacctccatcgtaaatggtcttctttggtcatgtgcacatccactgagctgtatctattacttccctgccctttcccacatgttccatgtagagcccaacatggtgtttggaatgactcatcccccttcgtggtaaccggacctttctaccagttcattgaatgctgccctctgctgtgtttttctagacatgcaatccccttaccttgctgtgcctgttgcgtttctaatttccaagacttccatgatgcctttccatttccctgcttggagttcattgcttcctctttggaacccacttggactttgctcatggcagttatattcctgggcatcgtgctgctgctagtttttaatgtctgtttctttagttaaactgtaatctccttgcaatgaggggttgcatctttttcatttctgtacccctagtaactggtacatcatctggaaacagagtgggcttataaaaattttggttgaattcattttattggctcttggcctgttacttacggttttctcattacctgcttgtttcctgttaacagagtcctaactgagctggtttccaaaatgaaagacatgcagatggacaagtcggaactgggatgcctgcgagccattgtactctttaacccaggtaaccgcccttcaaccccaggggatgtgtgtgttcagccctcttccacggtcaacctccagtgctcccatgttgttggtcctccatctcagctgagacacagatggcagagccaggaatccaggagagctcacagtgtcagctagagccattttggaaaatgttttgaatgagtgtggcaggcgcgtgtctggggcaagtggggaagatgaaagatgacggtggcccagggtggcagtgaagggggtggtaaaaagcgatcacattctggatatatttctagataaagccactgtgatttgctgatggattgaatatagaatgagaaagaaagaaaggagttatagatgactctctgggtttttttttttttaagttttgttttcctgaacaatgggaaaaatgaagttcttattcactgagatggggaaaactccatgaggagcaagttctgacagcgggtgggtaggaatcgggatcttgtctttggacattaaaataggaaatgggtagtagatatccaagagtggctgcccaggaagcaactgctcatatgagtctggacttcatgggagaagccatgtgcatctgagagctgtcagcctctgcctgtgtaaggctgtgacactggggtgagatcatctggggagatagagcagagaagatggctggggactgagccctggggcatgccaacatttagaggtcaggtaaaaaagggagagccagcagaggaacctgagaaggggcaggcagtgagatagggacagaatcagaaaggtggtgtcctggaggctcgagggaaaatagtctttcaagaaggaggcgatcagctccagcaaaccctgctgtggtcaagaaagatgaaccttcagaattatgtagtcattcatgcagaggctttatctccagaattaggcagttagttcatcaatgcaggacatgtgccaattcagctttcgtgtcccatcttatgactcagtccatgctcagcacataataggcactcggtaaatgtgtgcaggtaatatttcgagaatggtccggataaaattaagctctcctccttagagtcagtggtgggtacatttgcctattcatggagtttaaaatctttgccccaagagtttgttgggtaaattgggcacagaaagaagagcaagggggcatgaatgaccagctttgtttatttcacacttgtccccatccagggtgtctctagtaactctagagacagtggccagagagaatggggacagcctctgctggagggtgtgtaatcaaaggctaactcagtcatgtcttttagatgccaagggcctgtccaacccctctgaggtggagactctgcgagagaaggtttatgccacccttgaggcctacaccaagcagaagtatccggaacagccaggcaggtgaggcagtgctggcagaatcgtagtaacagcagcaactactcccactcttcatctactgagcccctaaagtgcagcaggcactgtttaggtgtttttaaatgttatttaatcttcataacaagctgaaagccacaaaaatgttaattccatggggctagcggccttatctgtcttgctcaccattcactcctctagcctcaacacgtaaaacagtgcccgacacatagtacacatctttaaatggaggatgaatagcaaacaaatgaataaatgtgggaattattatctccaatttctatcaagaaacagaacctcagaaatgtaagtaacttgctgaagaccataatgctagcacgcggtggaggtgagatgtgaaccctgttcgtgtgatttcacagagcctgtgtttgaggtgtgactgcattgctttctggtctgcccccatagaaacccccatgcagtaggaagtacaggctttggcagccagaagatatggatgctggtccccagggtgccacgtgtgtggcatctgggaaggtgctgggtctgagtctgggctcctcatttggaaaggtggatgttggtctagcagatctctgaggccatctagcagatctctgaggccatctagcagatctctgaggccatctagcagtataggtatttctgagttattaaaagatattctcaaaactttcttccaaagtacagctaagccaaagagttttccctctctgctaatgccagttaaaatgagaaagtatgatcctcaaatctcatagaaaattggaaatgaaacggaaaagcctgtcttgaagacattaattttgtttgggggattaattttacatgctcccaatgctcactaatggtttccattcctctgtgaagtctaatatctacttagctgtttatcctgaatcataagccaacctctagcaattgtccagaagagactgagctgtgttttttgttggaggctgtggatgaatttgagtaggtgggttttggccctttggtgcaatgaataggcagggcctagtatattagtgagattaagctgtaatagacccaccagatgccaccagtttaacacaaacatctattccttgctcacaaatctgggtgggcagtcagttcagagaggtggttgccttgcatgccatcactcagggaccaagactccttttttcttgtgtctccaccatgacccagagccatactgtgttttgcatccagatgatggaagggggaagaggtggaggggcagagaggctaggccatatgggccagacctcggtcttagagggccctcaccttttcattcactttcattagctgatgccaagtcacgtggcccagctggccacaaaggaggctggagaatgtatcctgttgtatgccgaagaacagaagaaaatattggattttggtgaacctggtagttcactatagatgagattgagagagccctggccaaggggtcaggacctggctgccagcaatagcttggcctctgtcaggtgtgagccttgggcaaatcatcttaattgaagccctgagttggatgctttctatcaaatcttccattttttgagcacatattatgtgcaggacattacaaataatgagtgtcgtacatatcattttcctgaaattgtctctgtcttgctgtttatcttaaaaaaccaacaaaaaactccaactcacttttttcctaactataaaagcaatgcatgctttggttaaaaaaattataaaaatattttttaaaaatatgcggtggctcatgtctgtaatcccagcactttgggaggctgaggctggcggatcacctgaggtcggttgttcaagaccagcctgaccaacatgtagaaatcctgtctctactaataatacaaaaattagccaggtgtggtggcatgagcttataatcccagctactcaggaggctgaggtaggagaatcgcttgaaccggggaggtggaggttgtggtgagctgagatcatgccattgcactccagcctggatgacaagagcgaaactccatcaaaaacaaaaacaaaaacaaaaacaaaaaacaggtaataagaacttattgtaaatattttggtatatttctttccagtgttgtcgtgtatctattatgtctcgtgtgtatcctcgtgtaactattatgtattacgcatgtcatgtatgcatttctagatatgaaattatacagtttggtgtattattttcttcccttagccattctagaaattttattcaattactgacaactacaaattatcattttcaatggttttgtaatattttgcagtgtgaacatatcctaatgtatttagtcatcgccctgtgattgacatttgggttgtttctaattcatatcactttgaaaactttggaacttgactcttctgccagaatatggctggcagggggctgggctgcctccacactctggggagagaggccaacacttgttgccaggactagggcagaacttagaactgcaaggaggtggcagagtcccctgcatagtctcctgggtttgtccatcacagcttggactgaggctgactgccctgatcaagtgttcatagttggctcagtaggtacatcaggggtgtcactggccaggcatgtgggtgtgctgagggctggtcacctctggtccgcagaacctggttgaaggggatcctggcacagccaggtagaggcagatttctcagtgggagagtgctgccactctgtggaaacatttcagaagtgcatgtcacaagggccacattctgctttcactctgatcagaaagcagagatcaaaagtcaggtcacagaactcacacacacactctcttgcacacacagcaggcaccttcaaaggcataaatgccccttgctgctaacctgtgggtgaggaatgctgtgacgttcatgggtgtgtttatttctattagccttgatctcagttcctaaatccaggtcacacaacaaagagggtagtatgatggcatacttcgaattttagatattgtaaaatcgtggcctttttagagttaaaaaaattttttaaagttaatcccagtctaactttgtacttacagagaagctgtttcctttgcctacttccataaagcttaacggcagaggcacggccgggagttcagcctccttattctctaactacctctttcctgaatggtgatgccactcaaatgctttcaggggctttaccactggaggcttttgaagtaatgtgtagcattggcatagatctttaatttttccatgtagggaagcaatttctacttttttagatggtgccgctttattttccttgtattgctacatttctttaaaatgtcttatggcataagtgtagaaatatacacattttcaaggaacattgaaattctaatttgtaactttttcatgaaataatgttgtgacactcagtaaagattcatctggaaccagaaatctctgacttagggccacagtgactaaagtgattttggtccttgagctttttttggaagttgtgagtagagtgactttatgtctagtagcattaataacgttaaaaatgagctggcattgcactgtgcacagagggtcacacagacagagtgaaaaatgtcacagagagaagtacccgaaaggacatgcagatgggagatgaattccttcacacactggtctttctcccttttgtgaatctcacaacaaatgtcctcagttatagaaaaatgtgtgtgagggtgtgtatgagtgagtgtgtgagggtatgtgtgtgtgcatgttgtaagaacatgttagagtgtgagtgtggagtgtgtctgcatgtgtgtatgtgtgagtgcatgcatgcacgtgtgtgtaagagtgtgcatgtgcatgtatgtgagaccacaggcatgagatatgtgagaatgagtgtgtgcacatgtgtgagtatgtgtattgtgtataatgtgcatgaatatagtgtgagagcatgagtgtgtggatgcgtgtgcaaacatgtgaagtatgtgtgaaggtgtgtatgcatgagagtgtgtgaaggtgtgtgtgcatgagtgtgtgtgaaggtgtgtgtgcaggcacatgtgagttcatgtgaaagtgtgcatgagtgggcatgtgtgtatgtgtgagggtgtgtgtgtaagtgcatgtatgcaagggaatgtgacagtgtaaaagagtgtgagtgtgcgtgtgtgagtggtgaggatgtgtgtgcgggcacatgggtgtgaagcatgtgtgagtgtgtaggataatgtgtgggtcagtgtgtatgcatgtgtgccatgtatcctctccccaaacagaccatagactcctcaagggcagagactatgattttctcttttcctaatttaagggtaagcatagactaataagttgatcataaaaattggtaacaattggccgggtgcggtggctcacgcctgtaatcccagcactttgggaggctgaggtgggtggatcacctgaggtcaggaattcaagaccagcctggccaacatggcaaagacctgtctctactaaaactacaaaaatttagccaggcattgtggtgggagcctgtattcgcagctacttgggaggctgaggcaggagaattgcttgaacccggaaggcagaggttgcagtgagctgagactgggccattgcactccagcctgggcaacaagagtgaaactcggtctcaaaaaaaaaaaattggtaacaattggttacaaattggcaacaaaaatttggtgactgtggaccccaaggcatgtgcctgtagtcccgcctacttgggaggctgaggtgagaggattgcttgagcctaggtactcaggtccaacctgagtaacatggtgagaacccattcttaaaaagattttttgtgggggctggaaactaaagcaaattgatggcatgatggctagagtaaggttctcaaacgtgtcatctaatggtgacagctaccatgggttgagcacattcagtgtctcacgcttggctctaagtgcctcagcagatctgtgcgggtacccgagggacacagagaatgtgaggagccagtatggctggcaaagtgagtggacacagtcatctagttcttcctcttctccactgtgaatgaggggagctgagggcagtcctgggacatggctacagaattcaagattcttgaagggtcatgcgctccagcttctgttaaggctgacaagccctccagcctgtttctgaagctctttaggcttagagattctgtgacccccttgtctacccttccagctcttttatcacagatgggtcgagaaggccaattggacggcctcctgccagcaggtgcaggtgtgcagtgcctgcccgtccctgtccctgatgcctcttggcttccctgcaggtttgccaagctgctgctgcgcctcccagctctgcgttccattggcttgaaatgcctggagcacctcttcttcttcaagctcatcggggacacccccattgacaccttcctcatggagatgttggagaccccgctgcagatcacctgagccccaccagccacagcctccccacccaggatgacccctgggcaggtgtgtgtggacccccaccctgcactttcctccacctcccaccctgacccccttcctgtccccaaaatgtgatgcttataataaagaaaacctttctacacatgagacttttataggtggacttttgtatagatgttaaaggtaatacgctttgctgtctacagggctgggagactttctggaagttcttgggaaaactaatcaagcctctgtacatacaattggtttaaattattttttcacttgccctggaaagcaaacaaatgagtaataaaataatatgtgtgaaattggcactgctggagcatggggtgtgttattgtgctacagggaagtcgtctcagacatagagaagggatatcagaggctggggtcgaggctggggctggggtcctgagaccataaatcccagagcacaatgcctgaatctaagctgggctttgctgcacagccagctttgccccagggcacattctggggagactgggaagagatgctgtctttcaaaattaacttggttttttgtttttgtttttctactaagaataatgagcagaaaaagacttattctaattggaggcaattgagtataaggccacaggagagatgttctctgtcctgggagttggtggaagatctccggttctgggagttggtgggaggcggtaacaaaggaatagatttttctgttatatcatgagctagcaatgatagtcaaaagactagagtacaccaaatttattttctaatcttatctaaccctgtgcagcctgttcttaaaagggaaagagaggaaacctctcccaccttctagtctaggatgtccagagtcacctagtttttgaatcccaaccattggctggacaatgagctccttgaaggtatagactgtgtctgacaccactgacagcccatatagctcactgtcttcaactcacgtacctgccatctgcaggaatagggcttaacagatacacaaatcgatgtatgctgtgaattacatggtaccccctagggttgtaaatgtaaatgtgcagcctgaacaactgcacacggcagtcctgctttaccttttccataccaccagaacctgacccagggcctggtggacaaagcacacagtaatctgtgttgttgaactaggttccacacaactagaaaaaatcccctaaaggacaatgtggatgacatttgtctcattccctgtcaataacttgtcccctcaaaacccccatgattaactctccagtccaaatacatccctcagtgaacatacaatggtagaaaaactaacatcgctttattactaagaaaaatctagggatctcttagccttggacattaagcaatggaatgaaaatcttaattctgctgttctttcccttaacttgtgtatctgcatttactgtgaactatgatgaaaatggttggaggtgggtgttaaaatttaattgtggcctccttgatctctttcctctgccagcataattcactggacacattcaactgccttacaggtaacaagggccttccaggaaaattcacttccccgccaccgctggtggtcacttgtgtcccattccttttttttttttttttttaagatggcctctcactgtcgcccaagctggagtgcaggggtgcaatcctggctcactgcaacctccacctcttgggtctgagccattctcctgccacagcctcccaagtagctgggactacaggtgtgtgccaccatgcccagctaattgttttgtttttagtagagacggggtttcgccatgttggccaggctggtctcaaactcctgacctcaagtcctctgcccgccttggcctccctaagtgctgagattacaggcataagccaccgcacccagccccattccaatctttgatcccttttccagccaaccctagctcttgcctgcagcaaaacacagagtggtcagggcccagcagggtgctgcacatccatcaggtgcgatgtctcccgaactgctgctagggagcctcactaagcctgaacagaagcttggcaggagctgggctgtcttcattgcatgggctggtcccatgagattcagagcctcaaaggcca

SEQ ID NO: 13364 - DNA, 23560 bp, Human
  misc_feature (1)...(23560): n = A,T,C or G
ggagaggtgaagacagcaagtgcaggcaggtgaggccgtgatgggactgagactggaggaacagattagagagggttcctgaggggagacgagattgtcaaacgtttttaaacaaagatgggagaaggatctggtagggtagaggatggaggttaaaagaaaaagtctttcctgagtccctcagaaggactcagcaacacctttgctgactggtaacatccgacccagtggtctccagttagaactactccaggctacaagtcctttggaagcttgtagagatttgacagcactgggatgacagaggtcaggattatgtgtcactgtgttgttggtcatatcgacaagtcactgaatagtagtgcgtattgcagtgtgaactggaaaatgaattacagtgcatccctaccttgggcctcgcctgccacgcagccttaggaaagaacaggaagctatgttctgatagaggagccattctaagatattgtggaaggaataaccatgagatgtaacaatgtgtatatcttatatatgtacaagcaagacagcaatgtataagatacagcatcttatactacatctagtgtactgccatctgtgcttttaaaagccagggtggtggagaagtctgtattgatgttttcttgtatatccatggagatactctggaggggcccctgagaacccagccccagtggctaagagggcagggggatcctgtgtaaacaggatcaggctgtggggggctttcaccttaatatcttttatattcttaggtttttgaaccatatgtatgtattataacctctttaaatttttcaaaaatataattaaaaaaaaacctctagcaattaaaatattatttccaccagttgaatgaaagtcaggttgttttgccagggaggttatttggctcctctgaaatgtccattcataagttttctggtggctttggcttattctctttcactttggaggaaatatttctgattcataattcttcatgctccgccctcagagaacttctgccattgctaatgctactagtaaagtctgatctagttttcttacatttcattccttttttccccatccactctacattcatcaccacgttggatcatatttggacaattcatacagacaggaggataattatttgcattcttaaccaggcacagtggttcatgcctgtacatctcagctgcttgagaggccaaggtaggaggatcacttgaggccaggagtttgagaccagcctgagcaacatagcaagaccccatctcaagaccctggcaaaacacagttgctgctgttgagctgtgacatacgagggaacgttggcaggatgctttatgtggtgggggagaggagagctatcttcagctgcttaacagggctgtttgaaaaaggagtggaactggaacaagtagatggactttctgatagtccctcccagggcagctagaaacaactcctgagtgtcccacaggggtggtggtctgaagtggtggctgccacacagctctatgacccgcagagaaggctggctgcatccacgtgtctatccagtttatcttgcatttggaaaaagaagtttcgactagatggccttgactctaataataagatgttttcttgattattttccttttttctttcggcttctcaaacctggaatagatattctccatgagacccattctgtcttgattctgtcctttaaaaaaatctctaactatgtagcttcctttcaataagtacctctccatctgtattttttaggcaaggtgaaacaaaagagtgactttcttgtcagagcttgaaagagagcaagtggctttaaaagtagactttggctttctaaaggttctaagttttaatattcttatattcgtttaatcctaagtgtgtaatgaacatctttatccaattcaaagatgacacctgggagtgaactggtggtgggacatcacagactactgtgatttcaaactctcggcaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtgagaggcgctcttgggctggcgtgggcttcgcgcttctccctgcctgatttccaggcctgcctggcggaactggctcttcctgtgctctttctaaacctccttttgggccatctcccgatgcccaccagaagggagggagcagaggggaagttgcgggctttgctccatgtcccacctccaatggccgtgaattcaggatgcttggcctgtgctgagtgtccatccccattctcccgggtgtgggtccacccaggcctctgtgcctctgtggttcacctcctgcctggaagctcttcatctggcgggcacggggctccatgaaggcacgtgggaaatgtgtgtgcacgcgctttgctttagctttcatcagatccttaaagggttctttgttcagacagaatttaagtgcccccggggatcccagtcccttcagaatatttatcatctttccagtccccagatactcctcagcggttgtagcagaacacacagcaacagggatttccacacatgctcattgctgatagtgcctagtaagtaagttttccagaactggttgttggaaaggttagaacatgaattttgtgaagtttctagaatcgggagtatttgaacctaacctatacctttccaaaattttaagtcctagtagtttgtgagtagctaggttgagttttgtccagacaagaaaacttaactacagaaagtctgtgtgttcgcccggggtcacataacaaaccagttcaaagttggtccttggtacatttttagactgcagagtcccttcattgattatttttaaatgcttcacagagatcatttaaaatgattttatgccctaaaattaccagtccgtgctaatgtgcttggacttaacgcacttacgcaccaaactattttctgtcccaagtgtaatagggtagtttttaaaacaaaacaaaacaaaaaacagtagaactgaatgagtttctttcaactggtttgaatgtgccacctgctgtccaaactggagaaatgcccagtgatataataagcaacttgccttatctaagagccgcaatttgccttatctaagagccgcaatggctgtataaatactaagataacgtagattcccatgtctttttaattatactcgagttatgtagttatattttactccatccccagcatctcaatctctggttacagaaaatgagacatttgcaaattaattaaaatcatggtagatatcagtaactgtatcaggctatgatgcatttttcacagatgcagattctccagtaataaaatgcttttaggcagggtgcggtggctaatgcatgtaatcccagcactttgggaggccaaggcaggaggatcacttgagcccaggagttcaagaccatcctagacaacatagcaaaactccatctctacaaaaaaagttgaaaaatgagccaggcatgatggcacaagcctatagtcccagctacttgggaggctgaggcgggaggattgtttgagcccaggagttcaagaccaccctagacaacatagcaaaactccatctcttacaaaaaggttgaaaaatgagccaggcatgatagcacaagcctgtagtcccagctacttaggaggcggaggcgggaggattgtttgagcccaggagttcgagagcacagtgagccttgattaaaccactgcacgccaacctgagcaacagagtgagactctctccaaaaaaaaaaatgctttaagattttaaacccaaaatattctttgccactttaacttctggtgactttcaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcaggtatgtaaaaatgatgttttttaaacattggttgggtgttttgtttttggtaaaccaatcctgatagaatgggcctgaccaagccttgagaataagatacacatcttctcccatggagagacacgagcagcaaaattaattaaatcatctgtctcttctatgggcctgccataaattactacttgccttgggcaaaatcttttctatgggcctgccatgaattactacttgccttgggcagataactgatttcaaggttggtttaaaccctgcaagtgttcggagaatgttctgatgattagagtagatgatcatgggtagccagagttcctattatttgtgccgtgagtatgttctgtcctcaacccctagataaagatctcttccaaatagtaagttaccatttgctcgactctgaagtaaattgtctaggctttatgatgagatagctccgtaacaccacatggagagttttgttttttggttttttttgttgttttttttttttgtttctttaaatacaagtagtgcacattcttgttcagtttcatcctaagttccaactggacagagaaccagatagtaggaaataaaaagcggaagtcctccttgtccctcactcccctcaaggtatccaacattcattggtgtgtcttccccaacctttttctgaacattttgttataattttcagtttaattttttagacttacttttaaactcagaagtaaaaattgtatatacttatagtgtacaacatggtgtattgaaacacgaatacattgtggaatggttaaatcaagctaattagcatatgcattacctcacatacttactattttgtgtgtgtggtgagaacacttaaaatctactctcagcaattttcaagtataaaaatacattaactgtggtcaccatgatgtacaatagatgtcttgatctaagcattttcaaatttttatttcatatatacacacaaatagtatcaatttagttctgttgttgctttgcaacttgcttttttcatgtgacaatatgactttgagatatttctatttccttggttgttggattttcctctgctatatgataacatatatcagcaaaactttctctaaaaccacttaattcgtctaaaatcatatcccctcatttatcatgctaatcactccatgtataattagaagtgtctgatttttcggagatgaattttatttaaaatggatgaaacctagtcatcaacatgaaagttggctatgcttctctactcacctccctaaaatgacatatccccaggtggcccccataaaccctttgtgcttgcctttttaacttacagaggatgaaaaatgaaagaaaacgtagactggcaaaatggcagtaaagtaagttggatcttttccaaaatcccagatttctggagggctgaagttgaactacttttgatagttactaggctccagctgagcactgcccttggtgcactgggctttctagcacctaaacccttctagagcttgcacagcaggattggtgtggtgggtaggggggctcttttttctgttttgttgagtctggggtaggcagggacgtctttctttgactgacacccaagatggctctgatgggcaccaaacagcccatcacaggagtcctggaacccacacctctgggttgaaggggattgccttagcctctcatgacatatttaatcattttcagaattactatattttctcatatgatgtacacatgtatttaggaggttatcccttaatcttttgaatgttaccttttacaggctatcacattatgtgtggtttttttcagaagtggtttgaaattttatagtctgatcttattaagtattgtttctaatctcctaggggatttcatccctgtggtacactaggtgggaccatcttgttcttcagtttaagattaaactgcttgatcagtgtcataaatccttggctgactctcagcgcctctaagacagcttcattattatccattcagggtgaattccatgaacttaacttttatttttaaaatacaaaccaccatgcctcctatggtcactttgcatgttctccataatatcacgctgaatgtacacataatattgtgctttttggtagctctgcggtcataagaaaatcggatgtgtcagccagtgccttctgggtcctggctccgttttcccgtgtaggcttttccctggctccacttgtgagcccgctggtgcctcgccgggtgcagctcactcctccctccagcgttgaattcccttggacagaggctgtgggcttgtggcgctgggatcagtaaaagcagaggaaagctagatccagccaggtttaagtggagatctcctttgttgaacttgatgtcactttaaaagttcactttcatcagctccctgctccgtccactctccctactccacacaaaaagctggattgatattcttgtgaagagccaagtcctgctttaggaaaaccaacttgtttcttctttatgtgactatatttttgtccatgtgaattttccttaatgtagtctggcaagatcagaaaaataattagttacaccagagtcacttaacctttccttttcttatttgcatttaaattaatttttatgtggataaaagctcttcctgtgtatatttttcatttctctggtgtcttgtctcatgttccttaaaacttggaggcaaaggacttcatcgtagcaagtttccaaaggaaaagcgggaagcaaacaggaagatgaggtttcatattaggtcaccaggtatctagagcagctgactttgtgacgaggattcgtggtttgcagtttgcagggtaattgcaacaaaaatattctgcacctttgtggttagaacaaaattctttcaagttcatggacagcattaggcttttgaagtctgccggaaccagtagctgccactgggttttaaggaccaggagacttctctccccaaaagtgaggtttcttcttcctcccacagagggagaccgggggccctgcccaagcagtgccccaggggcaagaggatttgggagagaacaaagtgagccagtaaacatgccccatgaccctgacctgtaccccattagtccttcaaacgaaggtgccattcaaatgagagagacctcagccatggaaagcagcacactggctgcccaacttcaggtccctgctgcctccttctccccaaacgttcctttgacagtccctacatcttatgtgattttccagctgtttgatatttccagattagtaaatgtcctttaaaggaagagttttgtttaattataaagtctttttagactaattatgtggcaaatatcagcctccttccctgccatacccaacaacagccttgaattcaattccaaagaaacaaatttaacttcagtacgttgcatggcaaacatttgagtgttcatacattttgatttcaagtttaaaacacacttggctgaagcccacagaagcaggggctacttgggagaggaccgtcccaggcttgaaggcagcccctgcctcgcctctggttccttgtgccttgatttgcagctcccttggttaagcctttatggtcctgggaagtttctactaggcagagaaagcatttctgtaaaggttttcttttttaaaacaaaacgagtctctgtgtgcaccacatccatttctggcatctcagggctcactattcagaatggccagttcccattccctgaaaagggaaggggctctttgctccagagcatgctggttcattcataccccgtccagaaagagccaccagcttcaggtgaagtcaccattccaggcaaaagtaaaaataaaatttcagttccaaaaaacgccttcagcctatcaaaatctaagtttcgacttaccaatatctattaatattttagaagcagatttttttatacaaatatatgggcatggaggcaaggatatatgaaataattccttttactgtttttctgtagaattaccttcttattaccttgactttgatcatcgcttttatgttaatttattgccccatccgtggtttccagatgtcagcctgggcaacggctataacagtttgccttctgttccataaggcagatgaaattggagctactcagattttggaaacagctgttccttatcattgagagacagttcagcagttttaccttttcatgagtcatcagttactgggcctaggaaatgtatttccatcttgtgtcattgaccccatatcttcaaaagatgacacaactgaaatagcttcatgtagttcttctaggcttatttcaagagtctgcttaaaaggttgtctgacactctgatcattaaaccccagtgtgatctttctaagaatgcctcaggctctctcatttagaaagacttagtgcaactcattcatttgaatgagttaattcttgctcaatgcaaagatcccacaaaccttgggggctaggctgaggtccagccgctaaactctgcaattcctcactctcctgttcatacacacacagacacaaccctcctcacctccctgacctgcccctgccaaaaaatatgagtcatccgtcagtgtctcggggagttgagtggggagctatctcagatgctgagtcatgattttcagagaagatctgaacagattgctgtggttttaaattgctgaattgtagagagcatctagattgttattttcagtattaaagatgggggtcaggtttagaatccagcaagtgaaaagctgtccttactctgcacttctgatctagaactcagcctgcactgaagggactatcttgtgtttcttcttttctccactgtgtgaaatcataacaagaaacaacctctgagcataagatcagcttctagtatttaggggaagaaaatgcacattcctaaagtggtatgacaccaagctaccctacattgaaaagcagcctacttttccagcctgatctaaagcaaatcccaaaatagcatgggcttgatttattaaacctctgtcctgtgcagaggctgccccacgcctgaccccactgtcctccgaactcctgctgcagccgtaccctccagccctcagtggagcaggatgtgggtacaggcctgagccctgtgctgtttgctcttcttgtttgcgggtcgcatgtcttgagccagcctgtgacactcttgtctctgtatcccccagactgttcagtccacttccacataaactcaggaaatagcaattattgccagataatcagtgagctgtctgaaatcatgaaccaaggccagacccagatcccagggtttttgtgaaccctaatccaccaccgtacacttaacaccaggcagtcttagtatgccctgggccagatttcctctgtgacagcttcttgatttgtcttgtgaagcccagaatatgtactgggctcctgtgtcttcgagggaagacaggttggggagcaagatgtgttgtttatagagcccgagagccacctgcaaattccagtgcagctcatggctgcatgttaccctgtggccttcacgtagggcctgtagtgacagccactacatgcgtgggctccaggctgtcaccaaacctttacaacacgtagtaaataagtctagggtccacaactgctggggaaggccttaaacaaatctcaagtcttcaggatttccgtagcatttacatcttggtaaattgaattccataatagacttttcctttgctcaaatatgcaatgttttgagtaattccccatttatttttcattttagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgtgagtacctttttaaaaaaaaaaaaaaaaagtcattctagaaagcttcctgaagaaatctagtttggttattgtttttctaaagctgtacagtgtgtcattctgtggggactttccatcttgtaattcagatttgggttcatagacgttgttgacctttgttgcatcattccctagagaaggacttcattcactgaggagcctaccactttgcataattcacatggatatctactgttagtaaatacccaatcagtaacccaaccaacaatttgcaattgaaaagttcttcacctaataacttaaaagctgcacttttaagagaaggcaattttaagagggagcaaagttacataggattagagggttgtcgtccatataattgtgtgtttttatttctttaactgtttaatccgttcattatagtagtttgtgtttgtattgtagcttgtgatttatcaagcagttattcacatctcattctctagtccttgaaatagggcaggaggtggtgtcacaggtcaggttctccagaagcagacactgagatgagtttggcacgtggagaattagcaggtagtcagtacctgtggaagggatgggaaggaagcaggaccgcacagaggaagaggtcaaagtgatactatgcccatcatccttaggggtgggatgtgcgggaagcgttgcaccctggacgaggtggctccctacagctgagggcatccctaaaggcgccctgtggccgtctgctaacagcagcacccgcagccaggcagccaggcctccccaggagcgatcatggcagcacagttccatgtccaccacagttcaccccagggccattcagatcattgatgcaccttttgggggccagctccttcaggttccaaggggctttctttctgggagaaacttagaggaagaagattaggcagcaataacttgcaggccagaacctgaaatgtttaacctggatgttataatcagtgggtaaaagtgtgatgagaaaaaggatatttggatcctctcattatttgcagtgggaaaaatagtaactttacagtaaagaaacctggcagctaccaccttgccgagtggtcagagttcacagaaataagacaaaagccaacatgaagcactgaggggaacacagccttcgtcgctgcgtgggatttctcctgaaggtgcagcagctcagtctcatcatgaggaacgtcaggcccagactggggggcagtctgcagacacccgcagtgctccaccaaagcgccaaggtcggagaagacgtggaaagactgaggaaccgtctcagactggaggagaccaaggggacacgacagctcagaacatcagggacccaggatgggctcctgggccagagaaaggacaagagtgggaaggctggtgaaattcacatcatgtttgtagttgagtgactagcacattgtcagtggctttggtcatcttaagatgttatgtgacattttttaacctagggagagctgcctgaaggtttatgggaactctgtactacttttatcatcttcctgcatctaaacgtacttgaaaaccagaacgtttaaaataaaggaatacaagagaggaggaggaaggtgactaggccagactgtgtcccccagtgccgcactggtctcagagctgccctgctcctcaccttctcacaccccagggtagttcccctcacccatagctcccacctctgctggcttcagcagccgcccaaatgctaaaacactcacccccaagggatctgtggcctgctcactgtgcccagctcagagttgctgcacttgtccacttaactgctatagttgatcaggagaggaacaagcggcaccggcctgcatcccatttcccaggccacgtgtccttccagatagaggtctttgtactgtatgtgctacaaatcagaaaacgctgctgcccaccatcatggagccacctccaaactggcacctctcaggccgtgccgacgccctaccaggctggcggctgtggcaggtgctatatgtgacttagccacaggactctcgggtcctgtcccctgacatggtctttgctgtgaggctggtgttctggtcacaacgcaccaccctgaggcaccccatgctggtggactagaccttccatagccacagagagtgatgctgcctgaggatctgcaggtgggacaggcagactcagacccagaggatatgcccatgcctgttggagccgtcagcgtgctgcccagcgcccacaggcgggcctccctgggaatggtgtcttgtgggccgatcacattggcatctcctgctggcaggctggacactcagtagcaacagcgactgcatcagcctttggtaagtcagagactgtgctgttgaggcccctctggccagccctgggtggccagcgaccaccagccatctctcaaagctgttcagtgccccctccatggcggatgctctcaggtggacattaatgtgagacagcaacctgcacgcttcccattcctccacccaccacacgcctctgtccaggacacccacccctgctggcagctagtgttattctaaccttgatccacttttttttctacaccagggggtgaccaggtgcatctgcccccagtgggggcattttcctcaccacattctctttgaggcctgctggatgaggctctggtgaagttgctgtcccctttttggcttgcccatccacccagtgagccaacccacccacaggccacactcggtcacagggagtccccccatggctgtaggtatgagctgaggcagggcgcaggtactcaagggtctgggggtgacgcaggggtctaggctgccggcccatgccctctggagcttgccaagcccagctgtgcatctgccgcgggccctgcctgaccttgcgcctgtggggctgatggaactcagctcgtggtggtcactccccacatgtggtcatgtggggtcccgtggtcgggcgctttgcctctcccagtcccagccagcactccaggcatgcccttccctgctgtggatggccccaccggctgtgctgccctcctccctctggcactgaccacaggctccatatgcatcttgtcccacccctccctactcagccctggcctttcagcctcactcagcagggcccccacctccctcgtgcttccagtagccatcccagcagccaggtcagaccatctcctgggaacctagcagggccaaatcagtatcgcaggagagcccccacgtcagtgaatctcctgtccagcttgtggttgggccccaggtcaggcgccctgagaatccaggccctcgtgttttctcacagctcccacctgcacccttggctgggtcgtgcagcccgtttcagggaagaggcgagttacaggcctgacgccaggagaggggatggggcaggttttggggggcagtgttgccttgctgagagatatttgccttatcttctagcaaggggggcttacgtgttctgatagggatgggtgggccatgtccgtaggctcgggatcagaggaagctggacttcagagttgggggcattcacccagaagcgcctataccaagttctagggtacctccccacccctcacaagctgacagaccctcctccagtggctgattaacctgggtggagcttgtccactcttgctgacaagtccaggggctaaggccaagtctcagccctctctgcctcttgctcccggctgcccctctgcttgcacccatgtccctgcccctcacctgtgagagtgttagcacgtggacggctgcctgtgccaggtactgtggcttctccacctggcctgttggggggtggtccctcattgccagctggggagccgtgcagtttctaaacctctctcttcaccctcggtctgtccactcccctcgtcacaaggtggtttctctggaagctaagatagatttgggaagcagggtctggtagattaggtgccagcgtccatggaagggcagaaaggaagcaggattgggcagagctgactgacagggagctctggaaccacgtggcctcacggcggttcccggtgccccactgcagttggccgtggggttggcggccctgggaagagcggtccatgggggaggccctgagctctctgttgcctgctgacagcacttcccacagcaggcagtttgctggggtggggacgtgggtggcttatccaagtcatttgctttgtcctttacaccgtactgcacgcacctgacaccaccagactcccatggtagagtcattatcagtaaaatcagttcatcgtagtgattactgtaaacgagactgtgtcctgccagttaaccctgtcccggcaggaaagaatcctcatcgtctggaacatcccgtgaatctcattttgagttatttatccaaaggaggttgagatctgaggttctgacccctcccactgtatgatctatgtagatgtgtggtgtcggtgcagatgtggggcaaatactaaaccaccttgatgttcagacacattttggccaaagacattttggaagtggagccctggagctgaatgctgctcaggggtagaggtgtcagagttcaccattcccagaaagggccgtgaggcttgaagtcatcacaggacgaatgcctgccctctggtcagccgtgtttctccctactctacaagccttggcagatctttactttacgcttcccctggagatgtactggtgcctcttgagctgctgctttcaactgggcagttttcacccccgacctcacccctggggaacaatgtctggagacaacttggttgtcacacatgaggagatggccgttagcagaggctggggtactgctcggcaccctccatagcccacgggacagccctgctcagcaccctgcatgtagcccccacaggacagcccccacaccaaacaacagtccagcccagaatgtccctagtgtccagggggagaaaccctgctctaactcaagagcgaagagcctgcatttcactcggcgtgaattctacactttctgagcagagtatctgacgaagcctctctacagaaagtgaataaacgttgttcagatgacttcgacaactcttgttgaaagtgactatgcagatgatgtaaatgatgtcgttcctttcatgagcctttggtgtacttgagctttcagcagcctgaggcaagactggacaagtgtggttttccccactttgcatgtgcagagctctgccaggaggataagctaaaggaatcacattatcaagataaaaagaatatgcaaatagtgcaggctgtgtggcctctcctttcttacagcaggccctccgctgtaggcgagggctacgtaaatcagccaaggagtctcttccagtttagccttcctggtgcccagtagacattcatggagtgcatggaggatggcacggtctgacgcccacaggctcccacgtggaaatcttgcacctctcaggggcctgctggggtgtgaagctggagaatgcccagcgagtacctgagggccttaccccacgctcacaccttgagagccctctcttggggacttcagagactggcctgagggagcaggtggtaaaacctctgccacagcagtccccataaggctgaagattcctggatcccctctgctcatactgggccagtttcctcgccacccgtcctgctgtactctggccaaactaaaaagacatctctatttaactttcctcggcatttcccatctctctggatggttccaggataactttcttttaatagttggacaactttgaccacatcatggggtgatgtaggttgtctacagggagtccctgtgcactcagccatctcagagcaacgtgctagctggtcaggttcccaccgcctgcatctgtgtgaatcggttatttgggtagaagtttgaaacctctcattttgaaactactgaaaatagtgtgtttatataagaatatgctcacgcaaattgcgtgtatttaatcctataatacatatcttaccaagggagatttgttgttgttgttttcttgggtgactgtcgttcaaaccaactcactggccgtgtttaagtgaaaaagctttaacaacctagcgtgagccctgtcatttttgctcttgagtaaattgagaaatgcccttgcttgtcctgcacatccaaccacctggaatggagaacaccgaaggtagggaaaggatctccagggatgagcaggcctggagccggcggggctgcggaggaagaccggccgcaatgagtgagtgctgagcagagagaagggccgttctcggctggtatcaggcccaagagagtcaacaaaggggggacgaaagggagacagggaagagaacagtggtggggctgtaagttgacctccaggtggcagaaaataaagttggaagaattgactgggacagacagccagggccctgcaggaagggcgggagaggaagcctgcggacacctgccctttgtgattgaaccgcagacaccaggcctggcggggtcgcttgcctccgctgcccaagctaaggctccgctaagctggtcctgagaacatacttcatgctcaacttcagggatgtggctgtagtgtcctcactctatgctgagaatgaaagaagcacagtctatgaaaggaaaaccccgacagcacagagcacttcgtgcggcagcagcacaccgggagtcccactccctttcctgctgcgtttggatctgccgtgacaaggactatcagaaccactcacagtaaggtcgggtcgcgtttctaaatccactgtttatggaccgtcttttcactgagaagaagctcgtcagttcaggggtttctagaacttctccagactcttcaaaaactcatgactttctccaagttggtaatcccagcactttgggaggcccaggcgggcggatcacgaggtcaggagatcgagaccatcctggctaacacagtgaaaccccgtctctaccaaaaaatacaaaaaaaaattagccgggcgtggtggcgggcgcctgtagtcccagctactcacgaggctgaggcaggagaatggtgtgagcctgggaggcggagcttgcagtgagccgatattgcaccactgcactccagcctgggcgacagaaggagactccgtctcaaaaaaaaaaaaaaaaaacttgcaaaccctcatgaggagcctgtccccagccctgttttccagcctctgcctgcatgggaggggcagtgagtcagccacgtgtttgctttgccgcctctgcctgtgtgctctccaagctgcgggtttcacatgcagtaaacggcatcaagacattgacagaaggtgtatgggcagtcttacactgtctcagcgacttcagggccaaaactgtcttttgtgattttgcctcttttggaaatggaagccacctaccgaaattgtgttttaccagagccccaggagctcatagtcaaggctttgtgacatcagagttgttaggaaggttaaccgggcaagataaacgacagaccaaaaattgtcccctcaggccagtgtggagtttctttatcagacatgtgtgcaccccttcccgccttatctcggcatctgtgagcctgtcatttgaatgatgtaaaatccatacatgttgtactgagaccttaaaagtgatctagttcagtgtcatgtattaaaaaataaagtgatctagaatccaggacaaggttaaaattaatttcatatatacacatatatattcttttaaagaaaacctaatgttagctttctccactgagccgtgtgaggtgactgtagccagcccctcaagcagattacggtcatttttcgccacattcaagccctggatagttctgtcttttcgtatccaagcgatacaaggcagcctccaaggtacgctctagcagaaacggtcgctgccattagaatattttttctgtatattaaaaacaagtcaccattggcctcccagataaagaaaaggtttggtaggaattctgtgcctggttcaaatccttaaaattataaattgcctaactttgcatatgctgattttcccaggattgttttgtgtattaaaagagctcacacgtgggaagggccggcattagggggaggaaggcagatgggaggagaggaagctataccagtaactttttaaacgaatggcaaaaagaccttttctattttagatttctttattgagtccctgtaattctgtagtaggttgtaaaataagacactttttgctttcctttttaagaaaaaaatcatcagcccgatagattactttcccacctgcccaatggactgcaccttgcacagggtctgttcccagcggcccctagaggatgtgccccatttccctgcggggctggtatttgtgaatgtctcccttcggtgtggattttaagggatgggtcttccccgcccgcctcccaccgcaattcatattacatccactcttcttccttgcaggcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtatgtctaattgcttctgttacacgttactttttaaaaaatagaaacttttccctcagagagctcacaaatttgcaattattcctaagtcctttacgtttgtcctcaacagagcaccttcccgtgaagtcctgccagaacctattgccgccactgcccccacgcacgccttgccttccctttgcaaatacccaggaaccacagaaatggacttcagtctgaaatgtcagcaagttagcaaatgtcctatgaaagtcaacaacaactaacatggatataattctttactggttccaaagcctttcagtcacattattagcttctcccccgtttccccacagtgggcctaagttgtttttgggttgttgttgtttgtgagatggagtctcactctgtcgctcaggcttgagtgcagtggtggaatcttggctcactgcaacctcaacctcccgggttcaagtgatgcttgtgcttcagcctcccgagtagctgggactacaggcatgcgccaccatgcctgggttatttttgtattttcagtagacacggagtctcaccacgttggccaggctggtctcgaactcctgacctcaagttgatccacccacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccaacatggcaaaaccccgtctgtactaaaaatccaaaagttagccaggcttggtggtgcacgcctgtaatcccaactactcgagaggctgaggtgagagaatcgcttgaacccgggaggcggagattgcagtgagcggagatcccgccactgctgtccagcctgggcaacaaagcaagaccctgtgtcaaaaaaaaaaccacaaataatttttttttaaaatatgcttgtaacaaaattgcatttggcaaattataggatgtgaaatgtataatattaactgacacgactcccatcccaggcagacaagcaaccctcattatgaaaattacattttgtttagaaaaattccctcaacaggcatccccagagctttctgggcatcagcagagcagacgtccagttcgggggtccacgccagtatgcggcagtggcgcggggccgaggctgctcacaggctgggtgccgacagcccagctctcctttgaaataagccgttttgaagttaagaatgcacccagtgccaagtgtgaaatgtgctttatacatatgttaggcccgacatattgtgagaaaatgtctggtaacctttttaacaggtgattgctggaatttgatgattgcctccgtaaatgtggaggcacaggggacccgtgtctgcccgcatgcaccctgctaactggctgcttgttttccggtgcaggtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtattagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacatttgaaatgtttctctgattcttgtgagatttctcatgggatgttttctctttcgtgtgtgtgtgagatatacatgtgtgtataaagcatctgtacagttcaatggaatgaaaccctgtgtgactaacacctaggtaggacctaacaatttgaccagtatcctccctggtcaccttcacccgggtgaccatttcctcactttgtgtccatcatccacttctccttcaaagaacttattcctaaaataaattacttttagttctacatgtttttaacctttatatcatatcacaaataagcttctgtgactgactgacttcattcactgttaagttttctcttacgtagagttgtaacttactccttctttacccaaacctgtcgtggctgttttcactcctgttttacagatgaggaacctgaagaattaaacacttgcccaacgtcatgtaggtaatttgaacaggagtagcatgaagcttttacccaaggtcgatgtggcaaagcacatattctggcaaagacaccaagatgtcagtgttgtagaattcacaaatagggaactgagtaaaatctccaagttgtctgtctgcatcatccgagactttgaatcctctgggccttgtgagccacctcccctttttctgaagcaaaccttccaccttccaacttcttgcacaagaattgatcccaactagaagtagcactggcgacagcagtgaagtgcttctgttttgtgccctgcgtgggtgaggaggaagggaaatgcgactgctcaggtgggtgaaagtctcggtccaacttttgaagagaatttgacagtaactgtcaaatataaaaagcctggacccagcaactccatcaataaggattcatcttaaggaatgagtggtcataggaaatacaacaataaagataggtacgcagttaagttcatctcaggattgttcctgacagtgaagcattggaaactgcattcatgttcctcagtagggttttggttaaataattgtgcaacaccatcacagtggaatacacatttattgaaaaagaatgttgatgaaatcttaggtttaaagaaaattgtatgctttaaaaaactttaaaggatatgcatgaaaaacatcttgtatatatccagttctctcccctagagcttcccagctcctgggcttaagactgctcagcccctcaaagccaaagtcgggagcctgttacccctgagagccagagacaggcacaacagccaggcagccttgcttcctcgaccatgagggtaacagtgatgatggcacttaacactgcagcataaaccaggctcgcttcgaaacacttgatgtccgtttgctcattcagttttttgagattattttgcagagaatattaatgtaatacacattaatatgcttttcccagatccactcactgagcccatctggtggcctgtctgtactgacctctcctgtaaccaactttccccagctcgtggccttcctgtcctagcatcactctataaaatgagaggtctcaaatagtctt

SEQ ID NO: 13365 - DNA, 227391 bp, Human
  misc_feature (1)...(227391): n = A,T,C or G
ggttcaagcgattctcctgcctcagactcctgagtagctgggattacaggcaggtgccgccacacccaactaattttgtatttttagtagagatgggggtttctccatgttggttaggctggtctcaaactcctgacctcaggtgatccacccgtctcggcctcccaaagtgctgggattacaggtgagccaccgcacctggcacaaatgtatattttaatagagtcaagatggccatgctgaagtctttgtttttgggtaatccaacccaaactatctgctgtgggcatctatttttttttttttttttgagacggagtctcactctgtcacccaggctggagtgcaatggcgtgatctaggctcactgcaacctccacctcctgggttcaagcgattctccagcctcagcctcctgagtagctgggactacaggcatgtgccatcatacccggctaattttgtatttttagtagagacggggtttcaccatgttggtcagactggtctcaaactcccgtcctcaggtgatctgcccacctcagcttcctaaagtgctgggattacaggtgtgaaccactgtgcccagccgggcatctattgttttttctgcacactctaccatacctcttaaaaaattttttaaaaatttttattgtttgtgggtacatagtaggtatatatatttatggcatacatgagatattttgatacaggcatgtagtgtgtaattatcacatcatggtaaatgtggtatccatcgcctcaagcatttatcctttgtgttacaaacaatccaattatactctgttttttaaaaaaatgtacaatgaaattattattgactttagtcatactgttgtgctattagatactagatattattcgttctaactggaataatatattttttaaacagtaaagaatgagatataaaagtgaaagagaaagagaaaggtactgtattcctgggtaaatatacatgctccctttgctttccctgtttcattgacagccatgcacacttacgtttatattcctcattatttgataatcttccccattagagaaataggaaaggctctagaacacatgaacacacttatacagcctttatgatatccaaatttatccattttacgccaaaaaaaaaaagtactttcagtagtgcctcccatgtatctttcaaaaggtacatagctctgggtgcacaaaaaaattaacacaattccctatacaaaagggactgctcagagctaataacagctaaagaagagaggacgccaattgcaggtacaggcacatctcttcgaaccctcccctaaaacaaatgaaggacagaagaaaacagaaaactggttaattcaattattactctgcggaaacttagggatagtgcaaataaagctctgaaattagactttactgagccctgcctcttgggcatcccccaagaagtgtccgcgaccccccagaaacctcagggacaccctcctagacaccccgccccaccagcctcacagggatgaacctccctaccattctttgaacccccctaccattcctttttgtctggaatcagatcttgatttccttttggggaatcgcccctcccctggccatgtggttctcgcgagatgagcacagtgccccacctactctgaactaagaatcttgtttttttgagacggagtctcaccctgtcgcccgggctggagtgcagtggcgcgatcgcaacctccgcttcccgggttcaagggattctcctgcctcagcctcctgagtagctgggactacaggcgcacgccactacacccggccaatttttgtatttatttattttattttattttattttttagtagagacggggtttcaccatgttggccagaacagtctcgatctcctaacctcgtgatccacccgcctcgggctcccaaagtgttgagattacaggcgtgagccaccgcgcccgtccagaattatctttaaaatttatttctttaagatttgtagctactaagaaagaaaggagctttttttccttgggccttcaaactgaaagaaccgcatgagcctgaagctgcgcatggtcttaacatcaggctgtgcaggaagaagctatctgcagatggatgccagcacacacaaggaagcagagctctggcaacattgaggtcagtaccttcttttttgcttaagctaatattaattgaatttccatcatttgcaaccaaaagtgctttgatactgcttttcatctaggggtaagaatgatcaacttggtgcaagcaaaagtaactggttggccaggcgcggtggctcgcgcctgtaatcccagcactttgggaggccgaggcgggtggatcagcgaaaccccgtctctactaaaaatacaaaaaattagctttgcgtgctggtgggcgcctgtaatcccagccacttgggaggctgaggcacgagaatcgcttgaacctgggaggccgacgttgcagtgagccgaggtcgtgccactgcacttcagcctgggcaacagagtgagactcttacctcaaaaaaacaaaaacaaaaacaaaaagtaactggtcaacggttgtgagtaatagaaaacttatcacaatctcttttggataactggtaaatttttattggtttggcatgctaaatttagaaagctcaaataactagcatttttctgtaccctagagaaaagtgttaaataagccaactgatcctgaggattattcaaagatgtaattccaggttatgtcagagtgtcagtgtggattcaacttaatcacctacatttccaacattaataggattattctgtagaaactgatgccaagagaaatgatcctgagttctgtactaataatagctacaacatattgacatattttgtgccaagaagtgtgctaagcctatcattatttatatttaattcgcccagaaatcctaaaaggtaggtgtgattgttccttttttacaggtaaagaatctggccaggcatggtggctcatgcctgtaatcccagcattttgggagaccaaagcgggcggatcacaaggttaggagttcaagaccagcctggccaccatggtgaaactctatctctattaaaaatacaaaaattaggccgggcgcggtggctcatgcctatagtcccagcactttgggaggccgaggtgggcggatcacctgaggtcaggagttcgagaccagcctggccaacatgacaaaaccctgtctctactaaaaagtacaaatattagccaggcatggcagtgggggcctgtaatcccagctactcaggaggctgaggcaggagaattgcttgaactcaggaggcagaggatgcagtgagccgagattgcaccactgcactctagcctgggtgacaagagtgagactccacctcaaaaaaaaaaaaaaaaaatcagctgcatgtggtggcacgcgtctgtaatcccagctacctgggaggctgaggcaggagaattgcttgaacccgggaggcagaggttgcagtgagctgaaatcccaccattgcattccagtctgggcgacagagcaagaaaaaaaaaaaaagaattttaggtttagtaatgtgctcaagcatgggctttgaaattagaaagacaactgacaagtagtagaacccaaatctaagccctcatgttgatatttctaaaaaaaaaaaaaaaaaaaaaatccaagccctggatctttctaatttcaaacccatgcttttaaccactgtgctctctataagtttccaaagtaagtttttgagttagcagggttttactatagttttttgagacagtgttgctctgttgcccaggttggagtgcagtggcacgatctcggctcactgcagcctctgcctcctgggttcaagcgattcttgtgtctcagcctcccgagtagctgggattacagattataggaacgcgccaccaggcctggctaattttttttgtatttttagtagagatagggtttcactgtgttgcccaggctggtctcgaactcctgagctcaggcagtctgcccgcctaggcctcccaaagtgctaggattataggcgtgagccaccatgcctggccagttttactaagttttaatgttagatgtgttagattgattctttaaatttgccaaccatatgtagctagcagttcataagaattcattcaaatatcattttttcaacatattttgaatacatatgtagcttattcctgctatgagccaggaataagaatgtctaattgacatggagatcttatttcaaaactcttttttttagacaggctgactgcagcctcgaactcctaagctcaaacgatcctctcacctcagcctcccaagtacctgcagagactaccatgcccggctaatttttaaatttttttttagagagataggggtctcagtatgttgcctgggctggtcttgaacttctgggctcaagcaatcctcccactttgacttcccagtgctgagactataggtgtgagccaatacacctagcctgtcaaaattcttatagataatcagaatttgccatcaacaatcattatctgaatgataaattctttctcttatgagacagaggtccagactggcaattttttttttttttttttttttttttttttttttgaggcagaatctcactctgtctcccaggctgaagtgcagtggtgtgatcttggctcactgcaacctctgcctcccaggttcaagcaattctcatgcctcagcctcctgagtagctgggattacaggcacacactaccacgcctggctaatttttgtatttttagtagagacagggtttcgccatgttggtcaggccggtctcaaactcccaacctcaggtgatcaccacccccaccatctcggcctgccaaagtgctgggattacaggcttgagccaccatgcccggcctcaatttttttttttttttttttaagtgaggtgctagaagactgttaccagaacttgggagtcactcctttttcaaaaaatacacaaaacccagtggttttagaagatctggagggcatccctgcccatctcatgagatcctcagcatagcaggcagggaaaaggggttggagagcctggcactgcccctgtccacagctgtctcctttcctaaactaagtctctgatgcgaactctactcctgacctccatcatccgtgtgtgaaatgccttgttttcatgttgactcttcagtgctgggtgctgaattagcatcctgtgtttgttttagcttcttatacagggaccaagtctggaatgtaattaattgagcccttatttgaaataaatgtgttctgggtgttcagagacctaaaaagatgtgagaaaaaaaaaagaaagaaaagaaaaaaaaaataaactgcacttggctgggtgtggtggctcatgcctataatcccagcactttgggaggccgaggtaggaagatcacttgagcccaggagtttgagaccagcctgggcaaaatggcaagaccctgtctctacaaaaattaaaaaaaattagccaggtgtgtttgtgtttgtatgcgtctgtcatctcagctacggaggctaaggtgggaggattgcttgagtccgagagtttgaggctgcagtgagctatgatcatgccactgtactccagcctgagtgacagagtgagaccctgtcacacacacacacacacacacacacacaaaagaaaaggaaagaaactgcacgtcttcaaacagaactatgttctctaatggaggagtgaaaagaagtagggatttggaaagagagcacctaactttgaatttcagctaaccatttattaaacatatgtctttgggcagatgtttgtacctcagttttccaataatatttaacttataaggatgtaggggcaattaaatactgtgcatgctagtattatgtaagttttaaaacaaaaattattataaattaatggagcctactgattttgataggaaaatctataaattccttgagtatcagtgaacacataccgtttttttttttttcttttggtggggtgggggagggtcagggccttgctttgttgctctgttgcccaggctggagtggtgcagtggcgtgtttatagctcactgcagcctcaaactcctggactcaagtgatcctcccacctcagcctctggagtagctgggactagaggtatatgctaccatgtctggctaacttttttttttttttaagcaccaggtcttgctatgttgtccaggctggtctttaacccaggtctcaagctatcctcccacctctgtctcccaaagtgctgggattacaggcatgagcctggcccacaacgtttattctaatgtttatttccataaaatttcaagaacagttgaaaaagttagtttgatgtctttaaacatgttataatatataatagtatacaataacatttgtaatatgagaatgtacaatgctattatttaaacaaaaagctgaataaaaacagatgtaaatccttgtcagcttaatcacataaataatcagcctattgcatagagattgccttgtttcactataatctttggatgtagtttccattcattgcatattttcagatattacttctgactatccttttcttccatgctggagaagctacttctttttctttggatattatttgtatgtgttccaactaaccaagtatttggactgatgaagagttgttatatatttttcagaggataagacccaataaaaatacacctaacaaaaagtatatatgattattttaaaaacaaacaaaacccacagaaaataacaagtgttggtgaggatgaggacatggaggcactggaacccttgtaaagtgttagtgggaatgtaaaatggtgcagctgctatggaaaatggcatacagagctcttaaaaaatttaaaatagaattaccatatgagaagccacattcagtggtgtatgcctatagtcccaggtattccagaggctgaggcagaaggatcatccgagcccagaagtttgaggccagcctgagcaacatgacaagaccttatctcaaataaaacaaaaccaaacccaataactttttttcatgtctcttgaatttgctttttcaagataggcaccactggggaaatatccagagagtggggcaatcacagttttagtctttgatactttgagacactgtaaagtgatatgatgattcagctttgctgtcatcccaactattttccagagagtattaatgttggaccaccttgtggattatgcaagactgtcagtgttgcctttggcactaacagaaaagagtgagtcaagaatatatattgcaaggtagaaatggtcaagatgtggagtttcttgtatgtgatacttttctattttgttttataagaaaaaactagctatttcattaggaaattacagtttgcatatttagaattttcattagtagtgattttaagtgttactgttgttaaaacggtgagtttgttagtttagaaacggttcatctaacagctaacaacttagatttaaataattaagtttggctgggcgtggtgattcacacctgtaatcccagcactttgggaggctgaggcaggcagatcacctgaggtctggagtttgagacaagcctggccaacatggtgaaaccctgtctctgctaaaaatacaaaaattagccaggtgtggtggcacacgcctgtagtcccaggtactcgggaggctgaggtgggagaatctctaaacctgggaggtggaggttgcagtcagctgagattgcaccactgcactccaacctgggcaacagagtgagactccatctcaaaataaaataaaatgatgtaaaataagtaagtttaatatgaatggagagggatatctaggagtatatttcagaatcttttttttttaactactccaaatatctatgcacaaaattcaagtcaactgtgcaagaaaagtcaaagaagtttctttttgttttgttttgtttttagagacaggtctcactatgctgcccaggctggagtgcagtggttattcacaggtaccatcatagcacactatagtcttcaactcctggctaaagtggttctcctgcctcagcctcctgagtagctgtgactacaagtgcccactgtgcccagccaaagcagtttcttggtatttcaggagttcttgtataaatgttaattttcagccaaaaactcaagtttgctacaactatactcaattaatgttctttgttttatttgtagtcaaagcaaggacacaacatcagagggacggcagagaatccttgtgtgtagatctttggtggtgagtacctgggaaaagtcacctaagtcaagatgtcagcataaaaagcattttattttgagcctgaaaagtggaatgagccatctatctaagtgcttacatggcataatgtgattagtagaaaggtttttttgtgactctcttactctgttgcccaggctggagtgcagtggtgtgataacagatcactgcagcctcaacctcctcggctcaagtgatcctcccacctcagcctcctgagtaggtgggactaccagtgcacgccaccatacgtggctaatttttaaattttttgtagagacaggatctcactatgttgctgaattcctgggctcaagtgatccttccgcctaagctttccaaagtgcaggggttatagcataaaccatggcacccagctgacattttgatagatgtatacattgtggaataattaaatcaagctaattaatatatttgtcacctcacattcttattttgggggtaagaacatttgaaatttactctcaacaattttgaaattataatacattattaaccatagtcaccaagctgtacaatagatctgtctccattcttccctttacatttatgatttgctctgtctagaaactgaataagtatcacaaggaggaaaattgagtggttaacaaacatacatgaaaccacgttcaactttactttcccacctttaaggcaacttataaacaaaaattgtaatagtatagtaatgcaagggatatatagcagctaagagaaatgaactaaatctacatatacacaacacagatgggttttaaaatcattgtaattattacaggcatgagccacgatgcccggctgtaatattttatttcttataggaaagataacaaatttgtcaaaatgttaacaatgatcagccagacgtgttcgctcacacctgtaatcccagcactttgggaggccaaggcgggtggatcacgaggtcaggagatcgagaccatcctgctaacacggtgaaaccccgtctctactaaaaataaaaaaaaaattagctgggcgtggtggcgggcgcctgtggtcccagctactcaggaggctgaggcaggagaatggcgtgaacccgggaggcggagcttgcagtgagccgagatcgcgccactgcactccagcctcggtgacagagcgagactccatctcaaaaaaaacagaaaaaccaaaaaaaacatactgttgaatgaaaagcaagttacagattatgtactgcttatgtaacgtttttatttatttgttttgtttttctccttggtgggcattggaaaatggaacattcttaaatggacacattcatactaatagcatcttcatgttctgtctttttaaatgcacacacacagacacacacatatgcggaagaaagggacacactggaaggatacactctaaattcctgaaagtggttacctctgaagagactgggagggtaattgatttggactggggttgaggggagtgcaagggggcttcaattgtatctgtaattttttttctttttttcctgtactttctaggggtgactaatgtaatgttttatttcttttttttttttaaattgaaaacattttttaatggagactgaggtcttgctatattgcccaggctggtcttgaattcctgggctcaagcaatcttcctgcctcgggctcccaaagtcctgggattacagccatgagccatgatgcccggctgtaatattttatttcttataggaaagacaaaaaatttgtcaaaatgttaacaatgatcagttttggatgttgactcatgagtgtttgttatattctttgcatttttctgtcttttgaagatttcttataaataagatttgttctctcctgtgaagattaattttctactttgtgcctggatttggtatgttgtgcacatttcggcccacacaatagtaataaatgagtcttggaacaaaacgtaagcaatcctctgcaagcctgcatgatacattctcactaagccagcctaaaaataacagaagagtaaaagtattattagacagagggaccctcatttgacctttcggccatttggattgtccattcagttaatcttgtcacaatcatgtaattatgaggttggtttgagcttaatgaaccaatatatacaatgaaaatatgctgtcaccagaactgtgccacacaaaggccttgggacataatacttttcttgtgtttgtacatgagatttcccaaagataacaaaaccttttaccaaatatgcttttcagacctattaccctttctaacgaatattcctcttccccacgtcaagtcggcatctcccaaaatatgtcgatgctgtccctttgccacataaatacccaaatgctgcctgatacccccgcaggctacatttgacagtacaatacctgcaaaggcagtggagctgcagagtgctattgaaaagaccattataatctcctctgaaagagtctcaaactgaaatgccagttagtaaaacatataggaaagagaaaaacaaccaggcaagtatataagtgtactcagcagcactcaaaattccagctgagttgaacctggaggtatttttaaaaagttgaatgtctggagaactagtttaggaaacttactttgtcttttttaatttaaaaaaaagttaaaaaagatatatacacttcactccctaaaaaaaaaaaaaagaaaagaaaaagtgagtaggaagtaggggatgtgtacattaatgagggcttccttcctttctctcacttggggagttagtcaaagaccctttaagacttgtttacttttccttctctagaaggaaatagccagcgttttccagcaatgataatagcagtatggacatcatttttaaaaactctagcagtatactattataagaccaaaataagagcaatatagtaaagcattatacattatttctactcctgtatctgactctttctctttcagctagctttagtcagcaggcttatttgctccagcctagggggtttgatttatttactctatgtgaacaggtctgactatggaaaccccttcctcatgtcagaacctttggcttccaggtggagattcattcatgccgtttacaccacatacttgctccctgcctggacaaattggtcccagttccctcaggtcagatgtattctgatgactcccaagtcctgagctgcataacactcagaacctttgcatcagtctctcattgagccctagaggtgcatctctcttcatggttgttgcaaacattactaattgcctcaacctcttaactgtgggtacccatctctagaatgaaaccatcccttaatttgatgtttattgaatacctgtcagatgctgccattctgctaggagctaggaatatagtgctgattaagatagccatggcccctgccttcatggtgcttatagtgtactgtggagcttacacagggagcctgctttaaggaaggatcaggtttcttcactaatgagacctgtacatagatggtactggatgagtgtgtgtgtatatgtttgttagtgggtgggaagcaagacaggaagcaaggaaaccagaactatcaacattgtttaggttagagatgatggtattttgaccagggttgtagcagcaatggaaatagtgagaagtgatcatttgagggtaaacaggactgactggcagactggttgtggggttaaagagacagagataaatcaatgatgacccataatgtgtttgacctgagctactgggtgaacagcagggctatttacagagatgaggatagacagaatgtgtgtgcaagaatcaagagttgagtttttttcattgttacatttgattttccagttgaaaaatcaagtggcgatattgagaagtcacaaatacatgactttgaagttcaaggttagagataaaattttgagatcatcaatgtgtaatccatttaaagaaatgggtcttgtattagtccattctggactggccgtgtgtggtggctcacactttaatcccagcactttgggaggccaagatgggaggattcactcaaggccaggagtttgagactagcctggtcaatgtagtgagaccccatctctctaaaaaaataaagaaatacctgatactgggtaatttataagaaaagaggtttaattggctcatggttctataggctgtataggaagcataaagctggcatctacttctcggggaggcctcaggaagctgccaatcttggcagaaggtgaaggaggagcaggtgtttcacatggtggaagcaggagcaagagagtgaggggagagatgctgcacacttttagatgattagatctcgcaagaactcactatcttgaggacaataccaagggtatgatactaaaccattcatgagaaattcgccttcatgatccaatcacctcccactaggctccacttccaacattggggattacaattgaacatgagatttggatgaggacgcagattcaagctagatgagtctggatgataacaccttcagagagagtgtctcagctgggcgcggtggctcatgcctgtaatcccagcactttgggaggctgaggtgggcagatcacaaggtcaggagatcgagaccatcctggctaacatggtgaaaccccttctctactaaaaaaacaaaaaattagccaggtgtggtggtacatgcctgtagtcccagctactcgggaggctgaggcaggagaatctcttgaacccaggaggcggaagttgcagtgagccgagtttgtgccactgcactccagcctgggcgacagaacgagactccgtctcaaaggacagagagtgtctcaacagagaagaggaccaaggacattgccttgggacaagccaacatttagatcctgggagcagaaagaaaagccagcggaggtgacttagaaggaacagccagtgtgatgggagggaaaccattagtacatcttatccctgcagccaaatgcagtgtctcaaagaggatgaagtaatctcttgcgtaaactaagagcagttaggtaagatgaaaactgagtatcagtcactggtcttgccacaaggtgaccttgacaagtgatctgattggatctgattgaggaggagctgtggatgaagaagtgtgggcaacaaaggaagacatctcttttgaggagttagtgcaaagggagtagagaaataggggtaaggtggatagatggggtcaagtaagatttttaaagacaagaaatattctagtatgtttgtaagttgatgagaatgatccaggaaagaaagaaatctgaggctgcaattgcaagagggaattactacaggatgaaagtcattgagtcattgaaggaatgactccagggcacagatggaggaagcaaggccagttcatccagggtaacgagagaaagcagagcagagaagacgcatagataaaatcggcagatgtggtgggaagacaaagatactttcttctgagggctctgatattctcagtaaaataagaaacaaggtcatctgctgagttcaaagagggagaagaaggtattgaagacttgagaagaaataaaatcaacctcctgtagagtgatccacccactttggcctcccaaagtgctgggattacaggtgtgagccaccgcgcctggccaaaggaagtttttttttttttttaaggaagttttaattaaaaattttatattatttttctcaaatgttaacaatgtattataaaccaaaaataaaattttaaatcctccaactgactgaacgctttttgaagagaaacattcttagaaacctttgggaaaacatttcctactttgaaaaacatggactataagcaaataatgtcttttattatgagaaagtcttttggttcttaattatccttgtcaggaaaaaaaaaacaggataaaagattgctttttaagattgtcactaaaataaaaaatacaacataaaaacaaatttctatttaactcattcctgaatcttaaagaatgtgttacaagttgggctgggcacagtggctcacacctgtaatcccagcactttgaggccgagatgggcagatcacttgaggtcaggagttcaagaccagcctggccaacatggtgaaaccctgctctacagaaaatacaacaattaaccgggcatggtggtacgtgcctgtaatcccagccacttgagagctgaggcacaagaattgcttgaacccgggaggtgaaggttgtagtgggccgagatcacgccactgtactgtagcctggcgacagagcaaaactctgtctcaaaaaaaaaaatagttacaagttaagaaactcttctttctccttagacaacatgttaaaagaaactcaagaaatgttacagcaggtaattttatgacaaatatgtggatatgcccattttcaaaatatgttagaaaatacattttataaacccaaacttacaacacggccttccacaaaataagtgctcaataaagggtaataataacagacccaataataacagcaataatttttaaatttagatatttttagaagtagactttcagcatttcttctacttgttgaaatgaagtcaatgaggttgttttctttagtgtgttaactgagtatcaagaggcactaggaaggaaatgtttgatcagttggctttaggaataaagcatttccctgaagctaccttggttaatatttgcaagtattgtgaactttttggatgaaataccacacagatgcaactcaaaacgaatagtaatacacatatatagttatttcagctctaaactggtattactttcaagtaaactctgaaatctcgggaataaccatctcatggctcttggtaaaaatgatacatgttcattacgaaacaatcaagcacagataagatgatgatccgaggatgagatggtgccctcactaatttctgttcaatgttcaaggtataaccctgaagagagagggttcagggagaccctcatttgactaaaggactcacaatgcaacttcagttcagttttaaaaaataagaaagttatgtttctggcacactttcattttgggctgagattcaaaacatttacaggcattaatatatgttccgggtaccccttgtctttttttgtccccctgagcacaaaataacattacataattcatgattctttttttctcttctctagaccaaaacccagtaaacagaaaacagataaacaaaagaggtggggctagttctctgcagagtgttgtggaggtggggctgaggatggagttttccttctggaatcccagccctgctgttgggagagcaaggtcctgccacataccctaaggagctaagaccacagggatctcagggggttttactgtcactttgaaatggtgtgaggtttcctgcttcatcagaatccctgctgagggggaaattgaaggtgtactgtggaaacctccattgggggcttctgcacagtcacaggaaatggtgagtttgcaggaacttgcggttactgtgagaaaatttgctttggatttttatgtccaaaatctctgtggaattccccagatctgaagccagtgcctgctttggactctgctctgcatacaggttcatctgattgtattttttctcattaattgaaatttgccagctgcaattttatcagcgaaaaccaaattctaatctcgtagatagatatagaaaatgtggctttaaattatggccttaggttatgatgaaataaaacaccaacgagtatgaactgggtctttatgagcgaatctgaaaaataaagtagtaaatctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccagggtgacagaatgagaccctgtctcgaaataaaacaaaatttctcattcttttcaaacacagcatatgttacatgtaatttcatctgacacgtgtcataatgcattgtctttttttccataatgcactgtcttgtaatttttttcaagttttatttctaacaaaaaacttaaatgtaggccaggtgcagcagctcatgcctgtaatcacagcactttggaaggccaaggcaggtggatcacctaaggtcaggagtttgagaccagcctggccaacatggtgaaaccccatctctactaaaaaatacaaaaattagccaggcgtggtggtaggcacctgtattcccagctacttaggaggtggaggcaggaaaatcgcttgaactcaggaggcagaggttgcagtgaaccaagactgcaccactgcactctagcctgggtgacagtgcaagactccgtttcaaaaaaaaaaaaggaaatatgagactctctttttatgagtagaaggtgtctttcacctgtagcacaaagtggaggttcagagcatgaacggattctgtagccaggccacctgactctgccacttgctggttgtgtgaccttgggcaagttacataacctctctgtgcatcatttcctaatctgtaaaatgaggataatagctgggcacagtagctcatgcctgtaatcccagcaccttgggaggctgaggcaggtggatcacgaggtcaggagtttgagaccagcctggccaatatggtgaaaccttgtctctactaaaaatacaaaaattagcagggcgtggtggcgtgtgcctttagtcccagctactcgggaagctgaggcagaagaatcacttgaacccaggaggtggaggttgcagtgagccaagatggcgccactgcactccggcctgggcaacaagacggaaactgtgtctcaaaaaaaaaaaaaaaaaaaaaaaaaaagattatagagaaacaaccaaatgatttttctaatgataaagtcttttagactttatctgattaaagaaagtctgattagcagactgtgaactgctaatcaacagaatctggagacatgccactaaatctgagtcactgtcaacatgtgagtccacacctacaggaggggtggttccttgtatgaaaaacagcctcagtaaatcactgaaactctgctggcaaacatttttaatgcaagtaatgcacctcaatttcacccccctgcttacaatcctgtttgaaacaattccaaacaaatgaccaagaaaccactttggaccaaaagaaagctggtatcttacagtaacaaatactgtagcttgaatgcagttctccatgagaaattagtgaaagggagcatccattcccttagaaatcagttaatattgccattaataagaggttgggcaactgggcacggcagctcacgcctgtaatcccaacactgtgggaggccaaggtgggtggatcacttgaggtcaggagttatggcaaaaccctgtctctactgaaaatacaaatatcaaccaggcatggtggtgggtgctggtaatcccagctacttgagaggctgaggcatgagaatcacttgaacctgggaggtgggggtgggggttgcagtgagctgagatcgcgctgctgcactctagtctgggcaacaagagggaaactccgtctcaaaaaagaaagaaagaaagaaaagaggtaggggaacccttttttatagagctttgctcaggaaccaaaaattcaagtttattttaaacctttcgtctatgcttgaggtatctggatttctgcttttaatatcacattgtaaagatttaaagagaaaacatctctgtagacattgttaattttgtaaatactgatgtaatttcttgtgtttttccatatcatctactgaaactaaatagctcagaattaaaaaaaagagcccttttattttgccagtctataaagcttctgatgacaggtagaagaacctggtggttaaggacttaggttttgaggtcggtggatgtgagattgaatcgtggacaggttttgaggtcggtggatgtgagattgaatcgtggacaagatctcagtttgtataaaggcatgtatatcggcctcatttatacatattcttagagggctgtgagaagtaaatgtgtttatatgtatagaatttagtacccatggccaggcgcagtggctcatgcctgtaatctcagcagtttgggaggccaaggcgggtggatcacttgaggtcaggagttcgagagcagcctggccaacatggtatgaaaccccgtctctactaaaaatacaaaaattagccaggcatggtggtgcgtgcttgtcaatcccagctactcaggaggctgaggcaggagaattgcttgagcccaggaggcagaggttgcagtgagctgagattgcgccactgcactccagcctcggcagcagagcgagactctgtctcaaaacaaaaacaaacaaacaaaaaagaattcagtacccacgctggctcagatgttgatggttactgttgtgaatctggctctacggggaccagtcacttcatcactctttaaagacaagacactcctaaattatctaccaggccattttatttagaaggccttaacatgattgatacatttaatttaattttatttttttgagacagagtgttgctcttgtccaggctagagtgcaatggcaccatctcagctcactgcaacctctgcctcctgggttcaaacgattctcttgcctcagcctcccaagtagctgggattacaggtgcccgccaccatgcctggctaatttttgtattttagttgagatggggtttcaccatgttggtcaggctggtctagaactcctgacctcaagtgatccacccacctcggcttcccaaattgctgagattataggcatgagccacctcacctggccgatgcatttaaatgtgggattaaatattcacacctagttcaagtgttcacatctgtacttgaaactaaaacttgttaacaaggcataaatactgtattagtctgttttcatgctgctgataaagacatacccgagactgggcaatttacaaaagaaaggtttattggacttacagttccacatggctggggagacctcacaatcatggcagaaggtaaggaggagcaagtcacatatcacgtggatggcagcaggcagagagagctggtacgcggagactcctgtttttaaagccatcagatctcgtgagacttattcactatcatgagaacagcacaggaaaaactcatccccaagattcaattacctcccattgggttcctcctaggacacatggggattgtgggacttacaattcgagatgagatttgggtggggacacagccaaaccatatcaaatactgtttaatttgagtctaggagaaatcttaaggccttaaacttagactttataaaagcagaggctagctccatctggactgtttattccttcagaatattatgcctacttgtattcccaatgcctgactcagggctctcccatagtcagtgctcaatgaatattggtaaggaaaaaaatggttcagtgaggagatttttgcagtaattcaggtgactgatgacatttgacctttgtgaatgaatctccaattctgcaattgggtggattctctgcctataggtacaagaggaagaggacgagaaatatttcctgttctctcaataactttccaaataacatgtcataagaagcctcctcattctactctccaacatattaaaagcctaggattgagccaggtgcagcggctaacgcctctaatcccagcactttgggaggccaaggcaggcgaatctcttgagctcaggagtttgagaccagcctgggcaactaagtgagacccccgccctgccaaccccctctacaaaaaatacaaaaagttagctgggcgtggtggcatttgtcagtaatcccagctactcaggaggctgaggtgggagaatcgcttgagcctgagaagcggaggttgtagcgagctgagattgagattgtgccactgcactccagcctgggcgacagggcgagactccatctcaaaaaaaaaaaaaaaaaaaaaaaaaaaggcataggtccatagccctttagaactggaagaagccttctaggccaagcccttcatttgaactgagccttgacgggtattagccgttagccatttgtggaaggtcgcacagtagtcaggactggaagtctggtctttgaaacctgtcagtccacggtcatttcacctgcctgtttgtaaaacaatgtcctgttacttaagtatactttttaataagaaaaactgggtgtaagcaagagtatcagagtggtgttctggtgccagcagttcaacttctgcagcgtgtacttcacaggcacaggtacttaggacgtcgcacaggcacaggtacttaggacgttgccccgccgagactgtcgttcatatcgcgcccacctccgggtaacgccggtaatgctgacctagctccattatttgtattaatttatttagctagcagggggaacggctgggtaatgcagtctcagctgctggaggggaagaggcaagactccgccggcgcccaccatcagagcgtgacaacaagcgggaccggaggttgggaaaaagcacagggacagaatgaatgtgtgcatgggggagctctgctggggagagggcaagaggctgtgatcagattatctgaggtttcagaacttttatataaagaccaaggaaccaaatgaaaatccaactcttccagggagccctggaaagttcaaaggacctcgtttgagggagcgagtccccgcagctcgtgcccacgtctccctcgcgcttcccccaggacaggggccgccccaacccgggcacgctgagcccggccgcgcccctagccccttctctctcggcctcctcgtcccgaagggaagcacaggctcgagcagcattcggggctcatccatcagccgcggaggcaaagggggaggagagaggaggcgggaggcgggaggcgggaggaggagtttctgggcggccgagagcccccggtggggccggcggaggagcgcccttccccccgcgcgctgattgctgtggcgtcctgcccgtccccgcccgcgtgtgtgcgagggagggcgagtgcgccgggtcggcctgatgggggtaatcgagggtttcggggacgccgagcggcactttcctcttcccagcgagtgaaggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgaggtacgtgccggcccagccccgcggcgctgcagcccgcccgggctgtgggctctgcaggctgcgcgggtgcccgtcggcgcggcgcgggctgccagtgcctacttaccggccagggtcgctccagccgccaggacctccggccttgggagggaggcgctggtggggcggtgtttaccctccggggagcaggcaccggtggccagcggtgcgtgggcagcggccgcacggggcaggcagtgcccccggcgatgcgcagtgctggggaggaattctccacgcccgccctcactcttcctctccgcgggtccttctgacccctgcggggcgcggcggccacttccctccgggcgcgtgacagcttcggtgggaatggtttgttgtgggttcgcagtcaattgccgtggcccaggctgtggctcccggactcgtgcacggacgcggtttgcgttccccgctggccgcgccctcagggtgccttgcgggctgagccgcaagctgcagctcggcccccccccgccccggtttattttgaaggctctcttcttgtattcatttggttaggacaaacttggaaatcttggactgtcgctagaagaatctgcttgcagacttgatcttattagggcatttgccccgctttgcagaatcgcatagtgtcaggagccgacgtgtcaagcatgaattaccttggcaaagtagaacttagtggatttggtgtcctcacgaaaagctggaagaagaaaaccgttccatttccctagctgtgaagtgaggatagtagtacttgccccgtaaagttgctgtgagcatctaatgatttaatgtgtgtgaggtgctacaacagtgcttggcaccgagtaagcaccgcacggaggttagcgctgcttgccgctagccctgcggtggcaggataggagcggcgagggcagaggatagtaggagtgacaggctgtgctggggaaccaggcgtattctgagttttatgtccttccgaagaagtgagcggtttgggagaagtctccacaggtagtaaaaacacacgtcaagaccgtttcttcttcctgaatgcagagtgcaaacagttacttcagtgtgaactcagttgtttcttttggataataataacagctaacgttttctaagcccatactgtgtgcacttaatcctcacagcatctctatgggaaaagcactattaataaccctattttacagataagacactagaggttaagttacttgtccaagatcatacataactttctgttagttctgactccaaagctaccttccttcctcagcggagagcggcaagtgcaggccgatttgtgtgtacatagatttgtgtgcatagtccatgcatcttctcccatctttcagctttctatttgagctgaacgcatatctcttgaaacacacataaggtatctgtgatgaatttaggcgattttacatacttatgagggtgcccaattaaagttcctctgaaactggccccaaataattataaatagaactctgacttgtattaattaacatggaaatttttttttttttttggtgacagagtctcgctctgtccccaggctgcagtgcagtggtgcgatctcggctcactgcaacctccacctcccgggttcaagagtttctcctgactcagcctccagagtagctgggactacaggcgcgcgctaccacgcccagctaacttttgtatttttagtagagacggcgtttcaccatgttggccaggatggtctcgatttcttgacctcgtgatccacctgcctcggcctcccaaagtgctgggattacaggtgtgagccaccacgcctggccaacatggatctttattcttaatttcttttattaattctccagacattgttgatcaccattacttggcttccttaggaaacagcttggggttggcacaggaggcagggaaataattcttacccccttaagggctattaacatgaaattgatttcatgccattgtgtcagttaaaggatgttgctctatttcttgctgttctttgcttttggctttatttctgcattgtttagtgtttcaaggcttgagcgttttttttttttggcccttcagtttgacatttgtcaactttaatttttcctgttttgatggaatctgaccgttacacggcagctttgcctaacaactgttgattcagctcatgtttttaaatataaaaatcaccaacatagttttgaatcccagcacttcaaaggcaacccgtggggagttcattgttattttgaatattagtcaatagggggagcataacacactgttgatatctataaggcgcataaacccgtttttagagtattaaacatatagtttgaaaggggagggcaaaatatctagcaaaataactaagttgcttttggagtttataatggaggactagatttaatttgaactgattaagaatgaccttgaggacagggcctgtatgttgaatatatgtcaagaactccatggtggctggacagatagataaacacacatatagttttttttcaatttgtttccttaagtggtgtgtaggccaggcacagtggctcacacctgtaattccaacactttgggaggctgaggtaggaggatcacttggccaaggagttcgagaccagcctgggtaacatagtgagacccccatctctttaaaaagtgaagtttgtatgtaaactaattttgtgtggtttgaataatatttcaacttacctgggagaaatggaaatccagaggaatttgttgtgaatccttttgtaatgatcctcatttgtcttttgtagaaaactgaatataatgaatttgttctcagggaggttggtgtgttcacaatcctgtcatcatctttcattaacatcttctaagtgcaagacaataggggatcagtaatcctaaataacagcagttctattactgtgcattcctcagaggcttacgttaatattcaagtatagtagtagttcagatgtatcatatttgatactagtataggtgtgatgtgtctatgaatactcatacttgtaaacataaacaataagaatatgcttgaaaaaatcacacttgacatttatctatttatttatttattttttgagatggagtctctcgctctgtcgcccgggcgggagtgcagtggtgcaatctcagctcactgcaagctccacctcccaggttcacgccattctcctgcctcagcctccccagcagctgtaactacaggcactcgccaccatgcccggctaatttttttgtatttttagtagagacgggggtttcaccgtgttagccaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctttcttgtttcttgcgtattatgtagtatttttttattatttatttatttatttatttatttatttttgagacaaagtttcgctctgtcgcccaggctggagtgcagtggagtgatcttggctcactgcaacctccgcctcccaggttcaagagattctcctgcctcagcctcccgagtagcggggaccacaggtgcatgccaccacgcccgactaattttttatatttttcgtagagacggggcttcactgtgttagccccgatggtcttgatctcctgacctcatgatccacccgcctcggcctcccaaagtgctgggattataggcgtgagcgactgtgcccggccccatattatgtagtattgatttacctttatttcatttaccacgttagggtcccatggatcctattttaaaataactttcaaaattagttgagtcccttctttttaaatcttagcattgcgcttatactacagagtggcatttatttaggatctcatttagtcttctatgctttgctctagtttactcgagtaattcaacaaacacttataacctcctactccctactaggctatggtttctggtcttggagcttggcaaattaattgtccttattcagtgctctgatgactgggggccaaaatgccttcaggttgcttagggctttcttacagaaagcctttcgttggcttgaaggaaagtgttgttccattgtttttaagactcaaaagaattaatttttctctcttgcatgcaaacttggttgtgacttgtaaaagtcaggtgagtgcttgtttttctgagggcagaatctgagcctaagagcccagggaactcaactgtcctttgagttttaagaaggtgatcactgctgacttctttagtatataagtgaagaccaatttcctggcttcaaaaatctgtgaaaggtcctgactttacattttaagcttaacagacagaacagttagagtttagactgtgactgtgtaagtaataactttgctgtaatattttgcctggatgattctgctctgtggtcattttgaattacctcccttcttgatagttcattttgaaacgtctttttgtggtgctttcattgctgttggataaaaattgtaattgtcagatttattttttatttttatttatatacttattcatataaaatatgtaaatatatgtaaaatctcacatatatataatctataactatatattgtataatatataatatgtatatattttgagacagagtcttactatgttgcctcggctggtctcgaactcctgggctcaagtgatcctcctgcctcatcttctcaaattgttgggattacaggcatgagccactgctcctggctgtcagatttattagctactaaaggacagtcttctttttcagtcttaacagttacttaaaagtgattttattgccatttccatcagtctactggagcatttttcttatatttttatttttatttttattttttttgggacggagtctcgctctgtcacccagggtggagtgcagtggcgcgatctcggctcactgcaagctccgcctccctggttcacgccattctcttgcctcagtctcccgagtagctgagactacaggcgcccgccaccacgcccagctaatttttgtatttttagtagagacagggtttcaccgtgttagctaggatggtctcaatctcctgacctcgtgatccgccgtcttggcctcccaacgtgctgggattacaggtgtgagccatcgcgcccggccatatttttaaacttatttaaaacaattgtaaatttaaaaaatgttaacttttttgaaatttgcataacttgagttagataaatgtttttaggggcctttaatgtaaaagcagtcttgtattgccactaggaatataagcaatttggaatttaagagtgaatctaggttatatgaaaagctaaccttaaacacataatagtgagccttcagcagattgagtgagggcatttctgtaggaagaaaattaagtgtaccaagagccatagcagtaacttctctggttctgcatcttcagagtaacacttggaatgatagcattgtttctttgcagcatgtcataaaacacaagctgttgctaatttgttcagtgtctagtcaagctgaaataaatcaacacagcttggaagggccttacaagaaggatctgggttcatttcctgggctctgtccaggaaatatagaaatataataaataaatctaggaatataaaatttctagatttcttattttatatcttttgaaatagcacatttgtttgttaactgacattgagctttattttctctgcttgcaaagtccttgcttaagaatcagcacaaatttccaagcattcttcctccccacttgaataatgattttgatgtcttgctctctcaaccaaaatgtgtttttgaaacaacattgatataaattctgcatgaggctactgtcatttggaacttattcttcattttttattcttcagtttttcaggccaaagatgaagacttaataggctgacaactgcttatgagggatagagaccatatttaaaatggaaggtctagaacaagagccccagaaccatgccttcaggccatcctaatgtgccctgctgaagataattttttggtgtcggggggcagggcagggagcctaatgtctggtttttgtggtggtggttcttttatgttgaaatcttcttccatcctgggaagaggattcagttatatgtagagcctagcaaagttgatttttagaattagattttaatggttatttttttttttgagacagagtcttgctctgttgcttaggctggagtgcagtggtgtgatcttggctcactgcaacctctgcctcctgggttcaagcgattattgtgcctcagcctcccaagtaactgggattacaggcgggggccaccacatctggctaatttttgtatttttagtagagacagggttttgccatgttgtccaggctggtctcgaacttctggcctcaagtgatctttccccctcagcctcccaaagtgcagggattacaggcgtgagccaccatgcccgcaagcccactttaatgttaaactgttgccaagataatttagaattaagtctgaaatgttagctctatctttacttaaaaaatggttataaagaagcgtatactttctggacattggactcctagtgaagggggcctttggagttgggtgttgtttgcaggaggacgaaacacctgcttttctgtccttccaggcacataattcatttctctggtatatgccgaaggtcaggttttttgtgtaaaattgctgatggatcatttgtaaaaacacatttaagttgattagtccttgaaaaatgatctttagaaaatgatctttacagatactagtccttgagctttcctgtggatcagattgccttgggcgaaggtctgcagtttcacaagcatgactcactaccttttataggtgagaacatcaaatgggccaggtggagggtctagtagaactctggatttctttttaaatttgtatcatactattttgctaatggaaacttgatgaatacttaattccatctggcaagtgaaaagggtcccttttgggagtattcgttttgttagcatttttagtgatttattgttttgacagtgtgatattggtccttggatgcaaaaatactctggagactatttggaaatttcattttataattaactaactgtgtgataattgctggagcagaatgtgtgtttttttttttttcttttcattctggaaggttatttgaggtgaaaaacttagattctaatcacaaaggcttgtgttcatgtggtaccctgagtacttttgtaagatactcactgtgttgctgtgagttatctcttttatggttttttctttaaaacaaaactcttctgagtctccataaagaataagtatctcattttgttatattagattttgtgcagttggctggcaaattaaatttaactttgagggaaagcaccattgactcattacatacattttgcatcattgcagcgtaaggtcttccctatgtgtgtgggagaagtttctgatctaaatgggcatgtttcctattgctggtctatcttttagccaaagcatttctgaatagacattcctattcattttcttattttcgagactttagagagattgctacttgttatgtattcgtgataaatcatctgaatcctgaaaaaaatacttatgccaacagcccattttgtaaagacacttgtctttgagcttttaagctgtcatactcattattcgttacaatagctgtacagccattggatgtatcatgtttttgacacaggagctaggggaaggatgacctacttgttgcatttcacatttttccatatttatatcttttttcaatttgtggcatctttatttcattgttagagtggttgttctctaagacgttccaggttttaatttcattcactgtgtgggctaaataaggagctttcctgtagaaccaattctactaaattcctgaaaatgtcagttaaaaattagccaggcatggtggtgtgtgcctgtagtcccagcttctcaggaggctgaggcaggaggatggcttgagccaggaggtcgaggctgcagtgagtcatgatcataccactgcactccagcctgggtgacagagtgagaccttgtccctacccccaccacacacacaaaaaaagaaaatatgaagaaaaaagaaaatgcttccaaaaagtatcccatctagataccatgctggttagggcttttggtcatgtttgaatgggacatagctgaacacagagcaggatttcaatgggtaggctaggaaaaggagaggagtgtctaatttgttgggagaaaatccacttttgcataataataggggatttacgtgttttctttggagttaatatgtatttcaagtaggtagataggtaagaggtttgcaaaaaaattttgctaaggttgaggttctgtagttggcaactcttataaccctgaagatcctgttctctaaagccaggaaaaagcagtctgtttccaattatgtatcacaaaaaatagtgaaattaagccaagaaaaatgatcatttgggagttgggttgcttttttttttgcagagggtaaaggagaaaggactgtagacacacattttaaagaatctgctagtttttctgttggctttcagatttttctcaaatgctctgtattggaaattaagaataattttaggattaaaggccttttcctccttcggcttctttttgtttctcagagagcaaatagaagagcatttaggcagtttttgctgacatgaaagggtttgggtccagtgttccgggacccagcttgtgtttttggtaaagccttttcctgcctgaatggtcccaggttatgggctcacagcatcatacctggtagtggtgctatggtttttgttatatgaatttttttaccatgctttgaactgaaatgtagtccctgctgcctagcattattctgctggaggagaaaactagggatgttagtgtgggaaaggtatggaggtgcgaagcctagcatttggatgatgtgtgggtgaatatattgtcctcagcacttgtcagaagcaactagcctttcgggatgcctactgctagtttcaggattagtggtcctgtgagacctaggtgttaactaagaaatctcctttccactgccagaagatcagccccggcaggtcttagttcctgtttctcacaccttacacctccacagagtgttgaataagactttcctgatgctgcataatctttgataactcttagtcttgtcactgaggctaatgtgttttagctcttggtgcttttcttctcacctcccatttactcttctgcctgctgctggctcccacgcccaccacacccccaccacacccccatgaggtgctagaagaggtgtgaagtacggagtgcaaagttgcatttgctgctttactatcctttttcccccatttttttttcttggtttccctgaaacgagttctcctggttttcctcttatgttccggatgtctcttcagtcttccattttgtttctttttctttcttttttttttttttttttttgagacggagtctcactctgttgcccaggctggagtgcattggcacgacgttggctcactgcagtctccgcctcctgggttcaagcaattctcctccctcagctgcacactcccacccccccccccccgagtagctgggattacaggtgtgcgccaccatgcccagctaatttttctatttttagtagagacaaggttttgccatgttggccaggctggtcttgaactcctgacctcaggtgatctgcctgcctcagcctcccaaaatgctgggaatatagacgtgagccacagtgcccagcccagtcttccttttcaatgcttgatccctatgggttgacattttccaaggttgcattttcctttcctcctctcctctcccctcttcttttctttttcttgtcttttcagtctacattgagttgctcatatttctgtgcttcaatatcagcagctccctgttttttcacacccatatttccaacagcctatcggacagtgccatctggttgttctgtagatttttctgttacagtccaaaagccaccatattacttctctgtggtccacagcctccacagtgtcaccttctgtatttcccatgtccctccttctctatgggggttcctgcttactcttccaggctctcactgctgccagctcctccagtggggcttcatgtggctcctcctggcaggtgcttctcttgctgcctcgtgagaatgttgtttttccttcggcagattccccagagcaggattgagtcttaccatcttggtatcctaggtgtgtagcatgggcctggtttatagatatattgtcaaatggaattcttcatttcagcccacttcagttatggctttggggaaagatcaggcttacagttgatataaattatagctatagaaaagacacagaaaatcaactcagaatcatagagtttagggttacagtggggcttagaataatcttccttaagtttctctaaagatgagaacaaccagagagcagtgtttctcttcttgcccctctgcagcctagttcccacccaatagccagaatgattgtgataaaacctaagtcagattccttcattcccttgcttaaaacactctaggctgggcgcagtggctcacgcctgtaatcccagcactttgggaggctgaggcaggcggatcacaaagtcaggagtttgagaccagcctggccagcatggtgaaaccccgtctctactaaaaaaaaaattagcctggcatggtggtgggcgcctgtaatcccagctactcgggaggctaaggcaggagaatcgcttgaacccaggagacggaggttgcagtgagctgagattgcaccactgcactccagtctggtgacagagtgaccaaaaaaccaaaaaaccactctactgtttattcttgtctttctcagaataaaagccagaactcttacagtgatctgcaaagccctgcccaaccagcccaccactcttatgctggtgacccagttgacttccctcttgtgctctctaggctgctcaatctgctccagctgccgcacctgactgttggtccctgagcacgccagatacgctctgtctcagggcctttgcatgtgctgtttcctttgcttggaatgtttttccccaaatagctacagaattcgcttctgttaggtccttactcaaaacagacaaaccaaaccaaaaccccacacacatactttgtctctcccttttctgctttgttttcttagcattggtctctatataatatataattatgtatcttgtttatagtctgtctcctttagctagaatgaaagctccatcagggcagggatttttatgttttgttctctgttgaatacccacacctggaacagtcctggcatgaagcaggcacttgataaacattattaaatgaataagaagcattttatggatttcttttttttttttttgtggcagggtctcactctgtcacccaggctagagtgcagtggcacaatcttggctcactgcaacctctgcctcccgggttcaagccattctcctgcctcatcctcccaagtagctgggattacaggcacatgccatcaggcccagccaattttttttgtatttttggtagagacggagtttcaccatgttggccagcctggtcttgaatttctgatctcaagtgatccacccgccttggcctcccaaagtgctgggattacaggcgttagccacagcgctcagcccattttatggatttcttatagccccagttataggtgcactcagggcattaaaaagggaaaattgggccaggcgtgttggctcaggcctataatcccaacacttttggaggccgaggacaggagtctcgaggactcctgtcacttgaggacaggagtttgagagcagcctggccaacatggtaaagccccatctttactaaaaaaaaatacaaaaattagctgggcgtggtggcaggcacctgtaatcccagctacttgggaggcagaggcaggagaattgcttaaacctgggagggagaggttgcagtgatctgagatagtgccactgcactacagcctgggaaacagtgagactccatctcaaaaaaaaaaaaaaaaaaaagaagggaaaattggccaggtgtgatggcttacccctataatcccagtgctttaggaggctgaggcaggaggattatatgaggcaaagaattcaagattagcctggataacatagtgagaccccatctccataaaaaaatcttaaaaagtcagctgggtgtggtggggcacacctgtagtccctgcttaaagggactgtagttgaggtgggagaatagcttgagccaaggagttcgaggctgcagtgagctatgatcatgccactgcacaccagcctgagtgacagagtgaaaccctatccccccctcccaccaccccgtcaaaaaaagggaaaaccatcaatctcggggaaggagaatctgatttttaaaaagcctcatttaagactcgttggactagaacactgacctcgttttcatgtctgactcaaagcagcacctgtgggtccccccatccttacaagtggtttgggaagactcccattttacctctaacaggcatgggcttgctgcggtttctctctgcctgtggtttgccctttaacccagcaggctacaaagatgaaaagcaaacacaacgttaaagaaaagagctagggaagagggcagggggaaacagggcagaatttccttgcagccctgacatcttgccttgtttctgtgcccatccccttgtctggttacacagtcccttccagagctgccttgcttgggggctgtgctcagtcttgagacttttaggccagatgactcttgagttttgctttgatgttgtaatttctttgaagagaaatcttaattttaggcaaaaaggacattggagaacggattctttaaaattaaattaccatctttcgaagtgaagttttaacccttctcaagataaggggttgtccctgaaatttctgcttgcttctgctgatgatgctagtgggaagtcaggattggcaggaccccatcttgtgaaaccaataccgtaaatcctcagggcaataaattcagctctgaagaagtgtcagactcttatgggtagggattatgtggaatgaagtacataatttgtattagtgtaatagtaaagttagaggaatttgcctcctgctcttattgagataacatcggcatggttcctacagggataggaagcccagccaagaaaggcaaaggcttaggaggaagctattggccatgtacaaagcctgcagtgtcattcaccctgggattcaaaggtatcacattgaaaataaattgtctagaatggagctgagttatcagtgagtagttaaaaataatcaaagctaccatttcctgaattctaacaacatactaggaagtaagtgctttatttattaatttagttagtcatcataacaatcccatgaaggaggtagaatcattatctctactttatagatcaggcatggagctttaagtaagttgcccaaaattatattgcttagaaaaggcaggtgggggatttgaactcaggtaggctatgggggccccgcactttccactatgctgtactgtagtctgcttctaggacaaaccaagcatgctcttacctcaggacctttgcactcactattcccactgcctgggaggtttttcctttagatattgtcatagctttatctcttacctctgtgcttaaatgttaccttgtctgggaggccctctctgaccaccctgtctaaaatagcatccctcctgtcatcactctctctccttaacctgctttattttcctttcctaggtcttctcatgccttgacatattatttatttgttgtcttgtctgtccccacctttagaaggtaacctatgtgaaaacaggagtgtgtttaatttgctgctatgtgcccacctccctgaacagtgcccaggacagggtaggcgctaataaatgtttgttgagtgaatgaatgaagtaaactaaaactgctgatcaaggcctgccaccctggtttcagaacaaaataatttgtcccttgtgccagatctcatcagactacccaccaccagaaagtgagtgtccatgcagggcctggttgatgtctacagtggcttagtaataggcacagtccctatcttttttttgaaagtcagctgtttctggaggatctcttgtttgtagtagttaagagcatgggcgtggaattagacagacctaggtttaagtcctggtgccaggatttataagctggtgacttggggttgcttagcatcttttttttttttttggtgacagagcagagtcccactctgttgcccaggctggagtgcagtggtgccattgtagctcacttgcagccttgaacttctgggctcaagtgatccccctgcctcagccttccaagtagctaggactattggcatgcgccaccatgcctggctaatatttgtgtttgtatttatttatttatttattttcagaaactcctgatattcaaattatttttattttttctatgtttcccaggctggtcatgaactcctggcttcaagggagcctttggcctctgcctcccaaagtgctgggattataggtgtgaaccactgtacccagccttacttagcatcttgaagcctcacctttctcactacaaaatggagtaaagggcatctgtctccttgtattgttgagaagattaaatgggaaattgtgatatacatgataggtgttcagtagatgataacagacattttgtgggttcagaagaaagcagagatgtcagcttctgacaggaaggggaatcaggtatagacacttgatcaaccacagaataattacaaagcagcatgtggacaagtcttggctttgtaactaagtagctgtgtaaagctgggccagtcgttgagcctttctaatttttggtttgctaatctgtaaaattaaagggtcggagtagatactacctgttctagcattccaagttggctctgactagaagataacatggaacaaattatacacaaaatgataagtgacagaatgttcacagtaggatgggattaatcagaagtctcttttggaatgaggtgaggactattggtagagttcttggactttgaggaatagcataaagatggcagattgtgataaaatggttagatctgacaaaattcaggttttttgtgtgcttacattgttgggaagatactgcatttaaataatttttgtttacgtaagttatatattaaaatagctaatgtagtattaatattctatttattcttatgttgccaagttgaatatttttcttggataacacttttctgttttgtgaagttattcctgctagcctttacataattatgcatttcagatttccacaagtgtgtttgaagtctcattttctagaagggattcaggattattagtccatgtaatgacaattatagtatgatatagaataaaagattttcttgtttaatttcttcatattagaaatgagggaagtaggatgcagaaggtctgagctggtaaaacatgctgatggtcgcactcctgcctccttttcctttgaggatgcctgaggttcttatacataactcttgttattgagaaatgttctaatttatcatcctgctgtactattttttcttttttcttttgtttgagacggagtctcgctctgttgcctaggctggaatgcagtggcgtgatctcagctcactgtaacctctgcctgccgagttcaagcggttctcctgcctcagcctcccgagtagctgagattacaggcatgtgccactacacctggctaattctgtatttcttgtagagatgtgatttcaccatgttggccaggttggtctggaactcctgacctcaagtgatctgcccaccttggcctaccaaagtgctgtgattacaggtgtgagctaccactcccggcctgtactatttttattgtagtgtgcacagtagtatttatacctgtagtccactgtggtaccctcattagatgcccgctgtcagccaagtgtaggtagactgtgatccgccttgctggaattaagacagtgggaaagccatacttggaaggaaataattacataataattacaacctgaagggttgtactgcgttctaggtgtccaagtttaacttggtccaagggaatcagaggaggcttccttcaagaagtaaggcttttgctgagacctgaagatgttagaaagtgaccatcctagggaccatggagggatgttgagttccgatatagtgaacatcacttttggaaggtgaggacttggcccttttgtgggactgaattgacactagtgtggctggagtgtgcagaagatgagcttggactaactagacgatggttggtggccatgtgaagttttgctgtttatctggacggcagtgggcaaccattgaagagttttaattcttagtgtttcacatgcctgggctctaaaccaccacacctggtgcacttttaaattttttgtagagacagcgtttcactatgttgtccaggctatcaaaagcttttttcaatggccaggtgcttgctagggcctgagggaggatgactgttgtcctgagaatattctgatatgctgaattttgctcgaataattacagctttatgatttaaacctttttgatgacagctgattcctcattctaggtagcttggttggtttggtggcagtgccagaccaagttccacagcccccagctgaacccctgcagctaattgggaatcatcaaatagaatcgagaagggccctgcagccagatccctgtaacttataccagaaatgttgaggcaatggcttcaccaccatttggacagttttgctacattatgagtatctttagaacccataccttgtatggaatttggaatcatttttttgtgatggagggaatttttgaaattctagatgataaagtctaatctcaaaaataatacaaaatttgctataaacaactatttctgttgccttgctactagtagtttgcttattttctttttggaagtctaggtatattttaaccataaaaataccaatgactattatttatttaaaatagacagtgtggggccgagcacagtggttcacacctgtaatcccagcacattgtgaggctgaggtgggttgatcacctgaggtcaggagctcgagaccagctgggccaacatggcgaaaccctgtctctactaaaaatacaaaaattagccaggcgtggtggcacatgcctgtaatcctggctatttgggaggctgagacaagagaattgcttgaacccaaaggcagaggttgcagtgagctgacatcgtgccactgcactccagcctgggtggcagagtgagactccatctcaaaaaagaaagaataaaataaaatagactgtgtgggccaggtattgttttaggtaccatgcctatattctgtcttatattataatcaaaatattgctaccattttacagatgagggcgtggtaggggctaaatgacttttccaatgtaacacagctgggtaagccaggttttgaacccccaaatacagttctttattaattctagcttaaaagcagacacccttataaatgaaaaggtacagaaacctttggatgcaaaaatcttaaatgtgaaaaggtggttcttagagtattgcaagggtgggtgaaaaagccatcctagtttgtgagtttgaataaaacatggtcttttccaactttgtgaaatgtgtcaacacccaccctccctttttcctgtattttccttgggagtgaggtgtgttgtgcttgggatagatggaagggctcttaaggacggactgaagttcggccccaaggaaaccaaggctgctggggccagatttgttgatcatgctcccagccaggaatgagggtgggcctgctctggagggacagcccaccttgcctctgaaggcagccggcacagaacaggcagagtggagtcaggcttctctgctctcctcgtaccctctgtgcgtactgcttcccccgtgcctaccagtacaggtggttccagagtaatcttcctcctttcttttcctgccactggcagccacagaatgttgggactaattaatctgatacctcaggataataaatctctttggtagaaacagcttgctaatgataaatgatagttttaatactatacatgcacaatctcatttgattcttgcaacaactctgtgatgtagctaagttttgtctgttacactctttacaaaggaggaaactgaggctccattctgatctaaacctccatcctttcttgtctgacatgctgtgagaatctcaactgattgtccaggcagtctggcctcccttcagtctgttctctgtacagcgtgagggaaatctttagtaatcccatctgatcacgctattccctgtttaaacccctccttgaacttattcgtcttctctttccctttcagctctgcagctctcctccctcctgtaatgcttcctctgcctgcagtgtcattcatcacctgacttttaaaatcttcgcttatcctcaggttgcgtatacttttcctttagagctctgattatatcgtgtagttacatgtttgtgattattgtctgtttatctcaccagcttttaagcccacaagggcaaaaaacatgtctccttggccactgcttagcagagtaagcaataaagatttgttgaaaggagaaactcaggaaattaaatgtcttgtgagaagtagtaaatgatatttttactcggatataagctccctgagggcaggatttttggcgtctttttttcattgctatatccctggcatcttgaacagtgcctggcatatagcagtaatatttattgaatatcagttgtgcttggatgtgattccgaagatttcttatccaaatctaggactttttctctcattgtgccaaatctatctgaagatggggattagtttagttctgattctgaatcaactcatggatgtagccaggccatgttagccatctaaggggaagctactaattttttcttactggtttttagcctattgccagacatccattttgccacagtttttctcttagatagagcaagatttctctcctcaccttagggaatattgtacccaaccagatccttttgaatattggtttagaacgtgatggttttgaggattcatttggatgggattttttcagctaatcttggtctttacctgtgcactctgttgggtcatgagggcatgtggggcagtatgctcagtttaatggactcagaaataaacccaggggatctctgaaattagcagaattagcagcacatttgtttgctttttttttaaacccattaagttctaagaattttcttttttttttttttttgggagacgtagtctcgctctgtcacccaggctggagtgcagtggcgcgatctcagctcactgcaagctccgcctcctgggttcacgccattcttctgtctcagcctcccgagtagctgggactacaggtgcctgccaccgcgcccggctaattttttgtattttaagtagaaacggggtttcaccatgttagccaagatggtctcgatctcctgacctcgtgatccacccgcctcggcctcccaaagtgctgggattacaggcgtgagccaccgcgcccggccaagttctcagaattttcttatgttcattgatgaatactaagtgttcttcagttcatcaaagttcacctaccttttaaatggaacatgttgctttgaaatgtggggaaaatgactattattccaaattgctctttcatgatctcagagtaccctatttatatttctactttttttttaaataaatactttaagttctagggtacatgtgcacaatgtgcaggtttgttacataggtatacattaggtatacatgtgccatgttggtttgctgaaaccattaactcatcatttacattaggtatttctactttttttttttttttaagtgaaagcaagtttattaagaaagtaaaggaataaaggaatggctactccatagacagaacctatatttctttctttctttttttctttttttttttttttgagatggagtctcactctgttgtccaggctggagtgcagtggcataatctcggctcattgcaatttccctctcctgggttcaagtgattctcctgcctcagcctcccgagtagctgggattacaggcacgtaccaccacgcctggctaacttttgtatttttggttgagctggagtttcgccaggttggccaggctggtcttgaactcctgacctcaggtgttctgcccagctcggcctcccaaagtgctgggattacaggcatgagccactgtgcccagccagaacccatatttctaaagaaagcatttagttcataaagtccagagattctttgaggtcaaaaagtcaggattgggagtccctgatgtttgcagtcagtgtggtagaacctcacagaagaaagaggagtttgtattttgttagttttatcaaagctacaacttttcggaagccttcagtccatccagcattccagggaactgattcctaagtcgggtgttaaggcactgaggtgtacaagttgtggccaaaactggagttcagctgaatgagaatgacacacttcccttttgcttctcctctgccttgggagcctttcaccacactggggagattagacaaaaaccttctgcagtttattttctttttgaacagttacattatggagagacttttaagctaaaagaagaaaagctccctttttgttacaaacagcagtgtgtagtttcaacttgtccaggacttcctcagagatgttttaagatccggtgtaaacttgctgtggtttgcctttgggcatcaaactgtttagcttggctctattatatctgtaattgctgcattttaataattgcccaatattcttgtcagcaatttgcagcctatatttttaatggaaccatttgcctttcttttccacaggtttgttcagacctggcttaagcccctggattaacgcagcacagaccctcagacccactgcagctgtgggcagggtgacgcaagctcattaaatattcccacaagcctcgtgccgcttacagtttatgtgcttcataaaatcctctgggaagtcatcttcttctgagatctccttacagggatttgctttataaaagttgtctttaacatttgctgaaatagcatattgtttcagagaggtttttccttatcaaaattattatataggcaggaggcactatagttcttgtgaaccaattcactaatttagggaatctaatatttcgaagggaaaaaaatagagacagatcctctttgtggtggttgaatttttaagttaacggagaagatttccatatgatcagagttgatgtggaattatggtgacagaaatgttcgacttagagggataataagtcagtttaatggctcccaaattatctctataatttagtcagcttttgagacaagaccgttgtgtcattgatgacttatgcctcaacttgactggtaattttgttcttttagtgagtccactctttagcttatctccttttgactgttgtaatgtttatttttcagtaaacaaaagattgaactggatttacagtagctaagaattacataaatagctatatcttaatttctccactttattggtataaatagctcaaagagaatggacaagtagtgatacagtacagtaattgtagctaacatttatttggttggttgttacgtgctagggactgttctaagcattgtgtatgtatattaactaactgaatcctcacaacagcctaccatacatttcctaccacaggatatgttcattcaagaagagtaagctgcctaacattaccatttggtaaggggcagagtggattcacacccaggcagatttttaatctttatcataatccgtatgctattcatactaggattttaatcactatcgtatatcaagattgaaccatagtggcctcctgcctatataataatttagtttcaagacatatctaagaaattctttttgaaattggaactttactgttattatttctggataggtaatacttgcacatggtattaatacaaaacccagaagggaattcagtgaaaagcttctgctccctcccacccctgtcctgcagtcaccctatttcccccgttctcataggtaaagttacaattgcaaagagccattttaaatatctctctttgtcacttgatgcaataaattaagaccatttaattaaaaactcatttaaaataattttttttgtactgttatctacaagcgcccacattggctttgtctctgaaggtagctatgggcaactcctgttgcgtgatatttcctgagtgaggatgacaaggccacaacccccaggtgtgtgagatggctcccggaaatgccaccattctgccttttccagggcttagatcagggagggtctttgcacttttacccataacttttattcttgatgagaaggaaccatgcctggagcatagtaaatgctcagtacatgtttgttaattgaacttctgtgagttgtgccaggctcagggatagagggctggagaaatatactttggagtgtctaaatcagtgaccattagggccgtgtgaggaatattcaagttaggcaaaccaccacaaaactctcattgaagactctggataggaaaaggttagaaagaaccttctagatccttgagtccagtaaccagatagtctcagatgggctgagagacagggaagacttttttcctgttaaaatgttggcaaacagttgaaataagaaccttgcctttttatgtttctttatttttttcagattgattcctagcacaacttaatttgatccttgtgataaccctgttattataacattagattgagtctctaatcagtgctggttttgttttcttgctggcactagggttgcatgtatcaagtgtcattgattactttggtaccacaacttaactggtggtgttatatttcaggtgcaccttgattttcttctgtagttctgaaaattctctataaaaccaaagatttaaaatgtcaaaaacagggccgggcgtggtggctcacgcctgtaatcccagcactttgggaggctgaggtgggcagatcacgaggtcaggagttcaagaccagcctggccaacatggtgaaaccccatctctactaaaaatacaaaaattagccaggcgtagtggcgcatgtctgtaatcccagctacttgggaggctgaggcaggagaatcgcttgaacccaggaggcggaggttgcagtgagccaagactgcgccactgtgctccagcttggcgacagagagagactctatctcaaaaaaaaaaaaaaaaaagccaataacaaatatgtcatttgcaaaagtatttgctataaaaatctttattagatagtcactgccctcagtctagtttgcttgagtgctattttgcatcttttaagataaatttcttacattacgcttttcagaaattctctgtttaattttagtgtctgtttgtttatgaagtttcttcattaagttttcttattgaaatttgttttacaggcagtttgaaaattgcaaggagggactttaagactacttctgatttgcaaagattgtctgtgctctgagcaggctaaagtgactggacgagacgcactgttggagaaataaaaatgacttcccattatgtgattgccatctttgccctgatgagcttctgtttagccactgcaggtaagttgcataatataaattgcatatttgttatatatttttggatatattttgtcccagtctctttagttgagatgaagtttcactctgttacccaggctggagtgcagaggcataatcatggcttactgtaggctctacctcctgggcttaagcgatcctcccacctcagcctcctaactagttgggactacaggcgtgtgccaccatgcccagctaatgttttattttttgtagagatagggtttcctatgttgctcaggctggtttcaaactcctgacctcaagtgatcctctcttcttggcctcctagcatgctggtattacaggtatgtgccactgtgcccgacctgtatttacatttttgtccctgaataaggatttcaagaaagcatttttgtcctttattagcaaataaatagatcttctagattgaggtgacactcttgacataggctgcttgggaggtatttagttttgcctatttcacatatttcaatatgtaacctttttttttttttttttttttttttttttgtggagacagagtcttgctctgtcacccaggctggagtgcaatggcctgatctcggctcactgcaacctcctcctcttgggttcaagcaattctcgtgcctcagcctcccaagtagctgggactgcagatgcctgccactacacgtggataatatttgtatttttaatagagacagggtttcaccattttggccatgctggtcttgaactcctgacctcaggtgatccgcctaccttggtctcccaaagtgctgggattactaactttttaaaaagtagagaaatacactgagcttcctggaggccaaatgagattggagatgaaaagatgcaaatgacttggaacattgttgcttaactaagagtatcggatctcccacaccaccatcttagtgtgtttactgtgaggggttacttagtaaatttggaagcttaatttgctctattttattataatttccattgtgtctattctgtaatgagctacataaaactaatttgttggaccagttctggaaactggcaggtctcagcaagaaaagcattgactcgaaaagtgattagctgcttggttttggctgttgaattgcacatacagatgagagtgatagtaatgatcatctattgagtgggcactatatccaggcactgggctaaacaattaaagaatataaaaatgaataaggatattcttatttaatgagctcacttaatcacaacttggaggtagaattaatttggcattttataaatgatgaaatgagatatggagagattaggtaacttgcgtagtgtcatgtagctggaaagtggaagagccagattttacattcagattttacatctatgctcttcacctctgtgttatactgaagaaaccagatctcccttaagactccaatagactcagatctggggttgtgtgcagacgtagactaagcgagagtcagctggcagaaactggtttatggattggaaagtagaatgttcctctcattgcaagtatctttttttttttttttttttgagatggagtctccctctgttgcccaggctggagtgcactggtgtgatctcggctcactgcaacctctgtctcctgggttcaagcgattctcctgcctcagccttccgagtagctgggactacaggcgtgtgccaccatgcctggctaattttttgtatttttagtagagacaaggtttcaccatgttagccaggctggtctcgatctcctggcctcagcctcccaaagtgctgggattacaggcgtgagccacttcccctggctataaatatcttgaaagaaagttgctaggccttttttgttgttgttgttttttgaatgccagtttatgaatttcaactgcccattctctatttttgtctatcagcagtttcattttgtctcattattgaagtgctatttgccttttagcctgtgtattaaaatggaattgacttaaaatctcatcgaaaagtagtagaaatgcacccccccacccccacctcccaaaaaaaaagagagagagaaagagggagagaagcggcttgatggaaaacatgctgttttgatgacaagatgtctagtctcaccttgtgggtttgaggctgggctttctgccttcattgatgcctgggtcagactgaaaaacacaactgaagaaggcactttatgggaaaggagtgagttcaatggccctgtccagccttgatgaatttgatagtgaatcagttttgcttcagatcttcctttcctatttgaagcctttgggaaaatatacacacaagtatatatatatttgagttgaatacacactcaaggctttgctgaggtggaagggacagtagagttacagattttttttttttttttgatacagagtctcgctctgtgtgtcacccaggctggagtgcagtggtgccatctcggctcactgcaacctctgcctcctggttcaagcgattctcctgcctcagcctcctgagtagctgggattacaggcatgcaccaccatatccagctaatttttgtatttttggtagagatggggttttgtcatgttggccaggctggtctcgaactcctgacctcaagtgatccacccccttcagcctctgaaaacgctgggattacaggtgtgagccaccaccgctggatgaattacagattttataatagcatgaggcaactgataaatagcacagaggtatggatgcctttttggtgtagaagtttgttggttgtttcccttttgcacaacataatagatcaaatgaatgaagaagagggaaattttgtttttttttttttttttttttgagacagagtctcactcgccccggctacagtgcagtggcacaatcttggctcattgtaacctccatctcctgggttcaagcaattctcctgcctcaacctcccgagtagatgggagtacaggcacacgctgccacgcccagctaattttttgtattttagtagagatggggtttcatcgtgttgcccaggctggtcgtgaactcctgagctcaggcaatccgcctgcctcggcctcccaaagtgctgggattacaggtgtgagccactgtgcctggctgcaaaaaaaattttttatatgctaatatctgatatttttctctgtaggcccagcatactttacaaaatggttttttgggcgttctggatgagctgaatttagctcatctgggtagttataacaatgatgaatatttcaaataattactgtgtgtcaggccccaaatttctttacatgtattatctcatttcatcctcataaatactctaagaaatatagatactttaataatccatagtttataagtgaggaaatggaagcacagagaggtcaaataactttcttaaggtcacacagctaataaatggcaggtggaactataaacctacttagtccaggtctggagattgagcctttaggcctctctactatattgatttgaaggaaatcatttgtttggaaagaatggtaataggttttgagccatttatgtcctcctgaaacattaaatcatttattcactgatccctgctgagtacaaagcacagtagtagtcacttagggatatacatgcaaagaaatgtaagattcgttcccaccctattttttttatttttggagagatgggatcttgctgtgttgtccaggttgaccttgaactcttgacctcaagtgatcctcccacctcagcctctcaaagcactgggattaaaggcgtgagccactgtgcccagccatattcatcccttcttttgagttgcttgtactttatttaggcttataaaatataaccatataaccaaataatgaatgtgtagtgaaagccaagtaaaacccaaagacctcagaggggtcacgaggggaagccctgtgggtcagagtagccagggacagctatgtggaagctctagatcttgaactctgtcttgaagactgggcagaatctaggaagaaggaggcactgagttcaccaggtgggaaaacctggcctagcacggaatgtggcatttaggtgcttaatttttttttttttttaaataaatggatgacctggagagctggtgtggaaatgtagcaggaggtctatttggaaagaaggatggagtagattatgaaagttcttaaatatcataatgaggcttgtggattttattctgtggtttggatgctctcttcttccatcccttggagccaaaggcatgcactgtttaatcttggaattcaaacggtggcctcaaacagtgaggctgagtatgtggcctcattagcttcagacccagcagtgcttggctcacaggctgtcatttatcaagggcttgatctctgccagctaatttatttaagacaactctatgagatgggtattattattatcatcacctccattttacaaacaaggaaattgagactcagtttggttaataatttgtacaaagtcctggaactaataagtggcagagttgagacttgaacctggcagtttggctctagaatccagcccatcaaccactagatccttctctagggaggagaccctgtgtgtgggatgaataaacctcttcttgattgattaaataccaggtgagtagctaccagtgtgacatcctggaaccagattaagcccctttggcctcagaagagacagacacaggtcatcagagcagaaggaccctcaagtagtgggccttctttattcatattctgacttaaccaaagtggccttaaagctgtaaatcggtgggaaggtgtggaggtctggcagcagaggggtgaaggttgtcaaaggcctccttttggttatgtggccagaggaggggcagagcacaagggagcacgtaaattgagcccaagttagaataataggagcctgcttgttccagctccataggtttgtctgggccttcagtgaaaacctttctttccttctctgcttgtgatagagagtgaatgaaggcagtcggggccgggtgggtcgggggatatccatgtcccagtgttagtgttgttctgacaaaactcatgctttcggctgggcgtggtggctcacgcctgtaatcccagcactttgggaggccgaggcgggcagattacgaggtcaggagattgagaccatcctggctaacacggtgaaaccccgtctctactaaaagtacaaaaacaaaattagccacgcgcggtggcggacgcctgtagtcccagctactggggaggctgaggcagaagaatggtgtgaacccgggaggcggagcttgcagtgagctgagatcgcgccactgcactccagcctgggcgacagagccaaactccgtctcaaaaaacaaaaaactcatgctttccctcccctccctcgttccttcgttatcatatagcactgttgaggatggagggtggactgtgctcttggtgaacacgagctgtgtaaggaccataatgcctcttgattagaaattagcttaggtgatttacttgggttaaaaaaaaaagagagagaataaatacaagagatttattggggttaaaaacaaaaaagaaaaaaaaagaaattatctaaggttatttattggcctcttagatcctgtaagctacctaatgtaagaaaagtgggaagtttaaaaaataagtgcttgatactatgggcttaagtctaagttttgctttaaaaactcgtctatacttgtgttataacattactattattgaaaatatctgctttccaggctgaagtgattcatttattattctagttctgctttcctcctttgtaatttgtgataattgtgcttttctttttaatacaaaaaatggataaaaataaaaacttgaaaaggcaaaaacaaaaacaaaaacaaaacaacctcccaactgttctacacatctttaaaagatattagctgctgcctctgaggcttgccaacattaggcagggctatgtttccaggagttttagtaataagaaaaagaggcatgcatggagaattcagggaaatcagttttattggaagggctggagttatcactggccccttgtgccaggtgagaggggtgccgctgaggtgagctctggagcagggctgctggcattgatgccagtgggctcttggtggaatggctaacttcttcattccactgtctcaattcagtacccagatgtatccttttggaaactcgcctgcaaactgtgcacagatttctattgagaaacacatttcttttcctctctactggatgtacctggaattccaggtagagtccacaggaaaatcgagatgcttttagtctgagctattttcctgctcagaaagctctgaactctttgtgtctgtgggagagcaagctgagataccagctggttaatacttggtctggaatggtacaagctggcagccttgagtagaggctaataataccatattgtatttgtaatcttaaaaatgtttttataacaggtatttcatttgatcctcacagcagcctctgggggtaggcaggcactattttcttcatttctagaatgagaataatagggcttagagaaagtaagtgatttagaaagataattcaagtcttggttggaccagaacttagacatgcttttgcagacaaactgcaccaacaaatcctgtgacctttttggtatagtgcacccttagcacctcttgacaaataaaaattgtatatatttatggtgtacatcatgatgtttttatacatgtctacattgtggtgagtaaatcaagctttttaacatatgcataacctcacacacttatcattttttgtggtgagaacacttaaaatatactctcttaacaattttcatgtgtaaaatatattattttttttcacatttttatagggggctgtaggaagggggcctcctcactgtcgagtgaggtggtcacagtttctttggcagctccaagctgggcactgggggtcctggaggtggctctgtatgtcagcatgttcctaccaccttggaagggcactagatagtttcagggcgtcacctggttggtcatgatgttgtacttggtaggggctgagtattggcccccatggtgaaggacatgactggcaccagctccatggcccaggcatttttgaggaaggcatgagtcctagaggggtaggtgagtgggggtcacctctacaggggtcatggccatcttaggctcagtggtggcagtggctactataataccttgttattaactatagtcaccatggtgtacagtcaatctcttgaacttattcctcctgtctaattgaaattttgtatatttgaccaacatctcctcagtccttccacccccactccccagcctctggtaaccaccattttactgtttctatgagtttgactttttttttgggagggggtgggatggagtctcactgtgtcacccaggctggagtgcagtagcatgatctcagctcactgcaacctccgcctcccgggttcgagtgattctcctgccttggcctcctgactgggactacaggcatgcgccgccacacctggccaatttttgttatttttagtagagatggggtttcaccatattggccacgctggtctcgaactcctgaccttgtgatctgcccgccttggcctccaaaagttctgggattacaggcctgagccaccgctcccggccatgagtttggctttttaagattccgcatataagtttgatcatatatgatatttgtcgctctgtgcctggcttatttctctgagcataatgtcctccatgttcatctgtgttgttgcaaatgacaggatttccttcttttttaaggctgtatagtattccactgtgtatatataccacattttcattattcaatttattcatttatcctgtacttgaaagagaaatcttggatgtgagttaacggcctgtgaacctcagaggtggttctgccatagttatctcctgtctgccaaacgagtgatcaaaggctgtaatactcataagggcaggaaggctggagggtgctggcaggggactaccaccagggaatgtaaggatagaagatggataggctcaaaggttcaaagcaaactgaaaaaaagccccctcccctttttttcttcttcttcttttttttttttttttttttttgccaaccctcaggtcttagaacacagctagttgatttggtctgtgattattattgtttttagctgattattttatcttatttttattttatttgtttttttgagacagggtctcactctgttgcctgggctggagtgcagtggcgcgatcatggctcactgcagcctcgacctcccaggttcaagccattttccccccacagacccccaagtagctgggactacgggtgcacgccactatgcctggctaatttttgtgtttttttctgtagagatggggttccgccatgttgcccaggctggtttggaactcttgagctcaagtggtccacccatatcggcctcccaaagtgctaggattataggtgtgagccatcatgcctggcctttagctggttattttaaccagttttgtgtttaattctgctttttgatacacaaggaaaggatattgtcaaatgtgataccagttatcaccagagtgccaaactttattttaaagagcaaataactgctattaaaagacctagagtggcatggtggtggctgcctgtaatcccagctactcgagaggctgaggcaggagaaccacttgaacctgggaggcggaggttgcggtgagccgagatggcgccactgcactccagcctgggcaacaagagcgaaactaggtctcaaaaataaaagaaagacccagagtggatagggtagcctgcattttagagtgtattccctttgaggatattgtgcacagccaagtgtgatgaagcacctccccacctaccttctccattagatttttctacagaaacagcatgtgcgtgcatgcgtgtgcaaacacaacacacacatgcatgcgcacacacacacatacacacacacgggagttgaggcagtagttgagagaaaggtgagttcatttctcaaagattcccttgccctgtatggacctgtgtgtgtgtggaggtggggtggatagcctaatgcaaggccttttactttttttttttccctgagacagggtctcactctgttgcccaggctggagtgcagtggcacggtagctcactgcagccttggcctcctgggctcaaacgatcctcccacctcagcctcttgagtagctggaactacaggcacatgccaccacacctggctaagttttgtattttttgtagagacaaggtttcgccatgttttccaagctggtctcaaactcttgagctaagcaatccacctgccttggcctcccaaagtgctaggattacaggcgtgagccactgtacctggccctttttatcattttcaaggagagtttactaatagctagttgggcaactgaatgtgcatatagtggaggggaggatgtttaccaagaatgagtaagattattgctagatgtgatgttagccaagtcaagagaatcgaggtttctctttgctttgcatccttatcgtaggctgtataattgccacccagctttctggatttctgattgatttgggttattttaggacagcagtgatggtgtgttttacagtgatcaacacttccatcaagacacagctttatctgtatgtgcctacacagctctttaattgctaaaagcttacccttgcacacggttgtgtatataggaaattagactttctcagcttgtttgctttggtaattaatccaactctggaggtatctttatcaccccatagagcttcgagctctgagcacgctgattttggaagtgatgtaggagcagggagtgttctgggaagtgttccgggaagcgtgccagcaagaggccttcctttaggactgaccctgctcagcaccgaggcgcatgattggcccatcccgcaccacatccatggcagccactgactttcattttctttaaaacgatctctgccagaatggcctaaaaaacatttatcctgaacttcaatctagtcatatttttgttttctgagagggcactgtcaatcaggtggaattctagagggctgaaaaatgccatagctcttggaacgttccttccaaggagtaggcagcaggtgctctggggactgaagcccagctattcccctgccctcccttgccagctcttaaacatctttaaaaaaatctacagtgtaatgtggaaaattttactaccttcaaagggaaatgttgatttaaaaaattattttaaagttactctgtttgttggcaatgaggggaaccatatatggcaaaaggaaaaggtcttgataaaattgctctgtgttctttgttttgcttccttttgtcctcatatgcctgagtaactgcgtcctagtccagaagattgaccagggccatctgagtaacacctcccttccttcctactctcctactccacccatgaggatacacaggtagcataggcctcaaaggagggcagaggttcagcctctggagtcagcccctgctctgcattttttttttttttttttttttttttgagacagggtcttgctctgtcacccaggctggagtgcagtagtgcagtcttggctcactgcagcctcaacctcccaggctcaagagatcttcctgcctcagcctcctatgtaggtgggactacaggcacgtggcaccacacctggctaattttgtgatcttttatagagatgacatctcactgtgttgcctaggctggtctcaaacttctggcctcaagtgatctgcccaccttagcctcccaaagtgccaggattacaggcgtgagccaccacgcctggcctccctgctgtgttgttttcatcattgaccccgctggactgctacagcattttcctgtgatgaacttttccagtgggatgcacctgtgcatgacaattatgttgttaaattgctgaaagttaaagttataatactacatggtgaagcaaaatgctctatagctcctgcccgcccttatcttttccttttgagttaattagaggacagaaccacttattttgccttttctttatacttttaaataactactatgttttagatgaagacttgtagtctggtcaacgttaagtacctcctaagattcaggtactttgctagcttctgaggcacagaaaggggagagactttggggttagtgcaaataatgagttttttcatttttttctttttctttctttttttttttttttttttttttgagatggagtcttgctctgttgcccaggctggagtgcagtgacgcgatctcagctcactgcaagctctgcctcccaggttcatgcattctcctgcctcagcctcccgagtagctgggactacaggcacccgccaccatgcccggctaattttttgtatttttagcagagacggggtttcaccgtgttagccaggatggtctcaatctcctgacctcgtgatcggcccgcctcggcctcccaaagtgctgggattacaggcgtgagccacctcgctggccttttcatttttttctaatacagttaactttcctaaagtgttgattgattgatttaacaaggatttactgagtacctattgtatttcagacactattccaagtgttggagagatagtagtaaacaaaacagataaaaatccttgtccttatgaagcatgtctctagtggagagagaccagaaacaaacaaaatgcatatatcagcaggttcgtcgaataaaaagcaaagaggttggggattgttagcggggattgcaatttgaagtaaggtgattaggaagggcttcactaggaacattgagcaaaggtttggaggaggtgagctaagtggatatctggggaaagagcattccaggcagcaggaaaagcaagtgcagaggccctgtggtggaagtttgcttgcagtgctcaggcaatagcaggtgggccaggtgcctgctggaatgggaagtcagagagttaactgaggggtgggagacggtgcgggtgtgtatagcccaaggcattgcaggccatcataaggttctcactctgaatgacactgagccattggagagtttgagcagaagaatgatatgatctgaaggatgtcttaacaggaccactctggctgctgggctgagaataggctgttgggcaaaggtggatttggagatactggcaagagataatgatgaccaggactccttattagaaggaaggacccttgggagtcatatgcttaggaaattcagaatgatgcttttgtaatttttccccaacctattccttttgaggaggaaagtggataaagatgtatttctcacatcagtggaatactgtgccatagcctaatattaaagataattacatctatagaactgaaaaagctgagtcttaaaacacaaaacaacctccccaaaccatctaaagaaaatctctttgtgttgtgaatgaatgtccttgaaaaatcatcgtcttaatagcctaaaccctcttttccttgcttacttaccctcctgatttccaagtcttgttcttttcatttctcagggggcctggttttcaggatcatgagttttgagggtcttaccaccttttgcagaagtgcttcttacagtgttgtaaattacagtttcgaagaaatacagttgcatccagttttacatagtaaatgtttctgagttgtaggtcaacctatttttataagttaaactacatattaaatgtgagcaaggagcatgatacagcagatttttttctataaagaaaataatcacttttaaatatattttataataaggatattcatagtggttttgccagaggtgagtggttttgccagaggtggaatataccatcttgtttatggaataggaagttttgcttttggagtttgaggttataaacaaatattaggccagtgctttcttatatgcatgagaatcacccagggatcttgttaaaatgcagattctgttttagtaggccttgatgggtcaaagactgtagatttttaacaggctcataagatgctgataccgttagtctgaggaccacatttgacagcataggtcatctgttttctcaatgcacaaattgtaacacagaaactgcaaacacctagacaatttcttagtgccataaaagggagcttgattttagcatgcctttacaacagctaccttgaacacctttggtaaacttgtttgggtcagagggatccatgtgctggagaggaaattggtttgaggcagtgagttccacagatgcctttagctctctgactgtaagtgtggtgcacctgcagaaaccaggtgcatctttattagctggggctacaccttgacataatcctaacagttgttaaagaaggaattcttcccgcccccaccatttcttccttttatgtgcctcttttgccttgtctcatttcttgccttgtgacttagtagaccaaggtaggagattcgtgttgggtcactgagggcggggtcattggtcccggaacctgtggccaagggactcttcggtaatgagaggtgatatgggctgagtggataaaagggggactttaggtgggttagcgagggtggctctggagttagggactaaaagttaaaagttgggtatacctcatttctgctagcagggctctaattttctagctcaggtttccccattgacttcctactttattctttttttttttttttttttgagatggagttttgctcttgttgcccaggctggagtgcaatggcgtgatctcggctcactgcaacctccgcctactgggttcaagcgattctcctgcctcagcctcccgagtagctgggattacaggcatgcactaccacgcctggctaattttgtatttttagtaggaatggggtttctccatgttgctcaggctggtctcgaactcccaacctcaggtgatctgcctgcctcatcctcccaaagtgctgggattacaggcatgagccaccgcgcccggccctactttattcttataatcacactccagtctagagcttttaaaaaattaacattttttagaagggaaaaatttctgtaagttgtaattgatgtttattaagcaccctgacaccacatttattataagtggggataagactgagaatatttaagctctgtgcctgaaaagttgtgttttaaactaacttttatttgtttacactgccattgagtagtttataaggttttctgatttgctttctctggcctcatcactgtttttggagaggcagcgtacaacctatgtacagctctggagctcgccgcaagactcaggtggtggtcattctgcttttgaaattgaaccagaaaagtcctgaggaatgtaacaatattttttctttttgcccccctgctagcttttttctagccctcccaaaaatgtgtttatgttgctgtccatgcatgtggagcagtctggaattctgtgtgacattagatagtgaaaaaaatagatttcccacgtgactgaggttataggagtgagaaatcttggattatgcaaggactctttgattggaagaaggacattttgagatgagatttattttaagatatagtaaaaaaaaacctagtatacaactttttgtttttttctaaactaacccttttcgggggtgacaggatggggtgtggactagaagcaataccaaacttttaagtatcaaatcttcactcagaagaaaaaaaatgtcttcagggtgaaagaatagctcaaatgcgaaaagcctgatagttatataatttgagagtagggtctggcatattatagaggactccgagagcctgatccaagcagcctgccattttcatcaccccaggattatctgtaaggacaactttactgtctgtcacctgccaggtctcagcctggcccttgtgagtgccaggaagtttgtgtcctctgttttgccaagcttaattagctctagaaataccctatcaaaggctgtctggcagtgttccattaatggtatggggtgaattcaaaagcactaattaattgttagattatttgcaaagcccatgctgaaaaacctaatgcctgcaggagaaagttggcagagagacggtacagagattagcttggaccttacccggctcaattgcgttttggaattgggccaagaggggagttgcttttctttttggagaagtgcttgtggctatattgttttctaaactgccagtgtactgctctaggctctccgtgagggagctcatatggacacttgcagacctagagagcccagagaccatcttcaagaggttttgtttatttttgttttgtgagagaaacacaattgtttaactttcattaactaaataaattcttcgcaagggcctcttcttaaatagaggaaaaggaactctagtttgtagtgtaacaattcaggttttaagtgttaaatgttcaaaggagccaggatcagggctttaaatagttttttcttcttaaaataaaacaagtcaggttcctcatgtcctctgtttaggtggcccaggtcagcaaaaagtgaattttccaactgctactgcagttggaagatgctgtttaaaaaaatcttcatttgaaatcaagtgcatgccaatttaaggtcagggtatactacatgcaggaaaggaagaaacaggtaaacaggtttgcattattttgctacatttgacatatagaatgataacacctataattaactcagcttgacaaattgtagacaaataatagaagtccctgtcccttatagatgagagagatttgaggcttttggagccaagtgccagtttctgttgactctgaaggcaacggagacagctgaagatcaaagtatagaaggatatttcagacttatctaaaagccaattgagtgttatataagggagctgtgtgtagctctgtttgaaaacatccatccagtaatcttccagttcctgagcctggccctgcctcctgttgacaggcctcagcgtctttttcttgtccttttgggcttgagcaacatgtgagtaagtacttatgtacaaatcccagaccaaatcttactttattaacatgattcagaagaaaagaattctaatgaaaaatttcagaggactgtgccgaaacatttcgtgatgttgtcagatctccctgaactcaggaaaggcccccaaaaatctattatttctgtttattactcaacttggaaaaagcttacaagaatgcctcaggagagtatgcactggttgaggaatttattcctgggtgtacagcatcccctacgtttactctgtgtgaggcgggctatcctgaaaccctgggcaacctgcctgctcctcagccagcaggtctagagtagcagcttagtatttttaaccctttctgtcatatgactcccagccaactttttgagttgatagaaacacagatctgagagctatgaggaattatgaaagcctttgtactgacaaaagactatgatttttctttgctgctttattatggttaaaaggtctcattatgcttttattttggagaggtaattctgtataacaagacctacttgtatatcccagttaggttgtgagatatcatgaataacattacaactgatagttaaattgaagactttaaatgattttcctcaaaaagataaaactaaattcaaggttattctaaaataagtatggttatttgcatttaaaaatatttcaaagggagaaagagaagttaggattacaagtgatagaatgaaaagtgctcataatttgttgcctgtagtatctgttttgctattcatgaacatggtacacccattcatttgtttaggttttccttaatttctttcagcactgcttttgtagttttcactagtttcttttgaagactctagtgtgtccaaatgtgaacaagattcatcatgtctgtcttattagaattatgtttaagaacctctgttttagagctgtaatgctatcctcttcaatctactcttcattaataatgatgaaaactgatactccctctgactttcctggagagtgagctcaggggtgtgtaactaaggctattgctaaagtgagttatcggcctggctgcctttgctctaagttgtaggaactcaaagctcagtgtgtactgtgagatatgttctttaaggctgaaggctagtgttgctgagcaagagatgtagtaaaatgaatatccttgttcctttggactaaatgtcagagttagaggcagtcttggaacccaaagattggatgttgtgcctttccatcaggccgttgggctttcccagcagagtttcgctggaacagagtcactccagtgaactttcattttggacttgtaacaaaaggattttgtagagattttaccctctgaatgtgggtaatacctgagggctttatcaagatgaagagtaactttgttgggttgctgcacctttatttagggaaagtaattctccaccacagtgtcaagagtggtcttgacagagacatatgaaaggtcagagagtcaggatcgtgcactagttgtgaccttgggttttggattcaggcacacaggttcaggtccagatcataggctgtgtgaccacaggctcagtgtcctcatttgtaaaattgaagtatcagtagttcctgtctcagttgtgttcttgtgaggattataaatgagataatgcatataaaccagaggatcacgtttattatgaatgaaactactggaaatagtattctttgaaaatgttaccatagtacttacctagtttggactgctataacaaagtcacatataagtcacacatagattgtatgtcttataaacaacagaaatgtatttttctcacagtgctggaggctgtaagtctgtgatcaagatgccagcatggttaggttctggaaagggccttttccaaattgcagactgatgacttttcattgtatcctcacatggatacagtcctcaaaaagacaaactagagagttctctggagtctcttttaagacactcataccattcatgagagcgctgtcctcatgacctaattgctccacctgttagcgtgccccatctcccaataccatcacactggggttaggattttaacatacaaattttaggggggtacacattcagtccgtaacacatggtggacatatttaatcagtcttttaagttgcagttctattattcaggcatatttttggtacaaaaattagatctgatcctgaaatataatgttgctgttaaacagactttattgatgcccagtttctttattttccgtaagttttacttagagcagtacagtggaaataccacagtggtacaatgggagtgatggagttgggagagggtgtggataagaagtgctctccctgccccccaactttttgttttgttttgttttggagatttgagtcccagttttgtggtttgcagagcttttgttgccttatctatacaatactgctaattatacctattcctttgatttgatgaggataaaatacttgtaaagcagccagaagtttatggcacatagtagttaggtcttcaaaaagttaatctttatttagacaatatatatgtgtaggaaaagagggggagagagagctagaacaaccttatgatgggcagaatgcatttgctgtttagctttgtgctcccaatggagaaaaagcaggttggggaatgtccttgggagatggctgaggagctgttggctgagccaggtggatttgaactgagcacctggatggaaaagaccttgttttcttttgaggcagtgacttggtctttaactggaagttacagggtaaagatgaatgctcaagaacggtggcggtgctgaggatcaggaccagtgggggacaggagaacccaagtgaagtggattgaggctgtgtattggtagttttcctcatctatatggtacctctaggctcagtcccagtctaaccaccctacttaaaattgtaatccctctctaaccacagaaactcctattccttcttatcttgctctgtttttcctcgtagcacttctcacctcaaaagctgcttgtaatttacttatgtttattatttatcttcccccactaaaatgtaagctccgtgagagtcaagttagttttgcttttgctctggtgcagctttttcttttttcttttctttctttctttctttttttttttggcagagtcttgctctgtcacccaggctggagtgcaggggcacatttcttggctgactgcaaccttcggctcccagtctcaagtgatcctcttaccttagcctctcaagtagctggggccacaggtgcacaccaccatgcttggctaattttttgtattttttggtagagacggggttttgctctgttgcccaggctggtctcgaactcctgaactcaagcaatccacctgcctcccaaagtgttgtgattacaggtgtgagccactccacccggcctaaaactactttttttttttttttttttgagatggagtcttgctctgttgcccaggctggagtgcagtggcgtgatctcagctcacagcaaccttcgcctcccaggttcaagtgattctcctgcctcaacctcctgagtagctgggattacaggcccacaccaccactcctggctaattttttgtatttttagcagagatggggtttcaccatgttggtcaggctggtcttgaactcctgacctcgtgatctgcccgccttggcctcccaaagtgctgggattacaggtgtaagccactgcgcctggccaactatttttacaataattccaagattgggttaacactgctctaattgtataagagcaatattggataaaactgctggtgactcagcaggaatgaaggcagtacttcactggcacacacttgcagtaaaacatctgccactttcctttaagagtgttgttaccctcagatacatgttttttccttattctatatggtaaaatgggaggtacgtatgttgcatttctgcattccaaagtacaatgattttcttgaggaaaagcactgtgcagttgtttgagttgtgagctgatctggtctgtttttcatggaacaccatttgatgtgaaagagtgactgacagacaactgatggttatccagacttcagtatttggcagacatttttgaaaatgaacaaagtgagccgggcgcgggggctcacacctgtaatcccagcactttgggaggccaaggtgggccgatcacctgaggtccggagttcaagaccagcctggccaacatggtgaaacccagtctctactaaaaatacaaaaattagctgggtgtggtggcatgcacctgtagtctcagctactcaggaggctgaggcaggagaattgcttgaaccctggaggtggaggttgcagtgaactgagatggtgccattgcactccagcctgggcaacaagagtgaaactccatttcaaaaaaaaaaagaaaatgaacaaagtgaacctgttagttcaaggaaaacaacagtatttgttgccaataataaaatttcgtttttcacacaagttaaaattttggaaaacttacatccattaccatgattatgacagtttctcaatggttaaatacttttctgatgaaatcagttgagatattaacaaatgtgatttttaaaatattatataatgaaatatgtcttatttggcagtaaaccattattttccagatgaccaatgcatgatattacaaaatcatgcatgatattacaaaatcatgcatgatattacaaaatcatgcatgatattacaaaatcatgcatgatattacaaaatcatgcatgatattacaaaatcatgcatgatattacaaaatcatgcatgatattacaaaatcatgcatgatattacaaaatcatgcattggtaaaatattccacatcttgagagtacaagatagaacaattgattttttttttttttttgacagagtcttgctctgttgcccaggctggaatgcagtggcatggtctcggctcactgcaaactctgcctcccaggctcaagtgattctcctgcctcaggctcccaggaagctgggacttcaggtgcacgccaccatacccagttaatttttgtatttttttttttttttaaagtagagatgggatttcatcatgttggccaggctggtctggaactcttgacctcaggtgatccacctgcctgagcctcccaaagtgctgggattacaggcgtgagccaccgtgcctggccagagcaagtgatttttaaaaactttttattttgagataatttttgactgacagaagggttgcataagtagtacagcgtttctttaggcttatcactcagctttaccttatgaggacatcttacataaccaaagtacaatgatcaaaactaagaaattaatcttgttacaatattattaactaaagtataatatttattaggatttcaccagtttttctactaatgttctttttctggtccagaatccaacccaggatctcacattgcatttagtcgccttgtctccttagcctcctccaggctgacagttccctggtctttcaatgaccttgacgctttgggaactactggagaatgtccctcaattaatttttttcctgacattctctcaggattacattgaggttatgtgtcatttggaagaataccatagaggtgatgtcctcttttcagggcatcaaatcgaggatatgttatgttgataggaattattactagtgacgttaatcttggtcacttggctagagtgatgtctgccagaattctctggtgtaaaggtactatttttcactttgaaattacgcagtattttggggaaagcaaaggattttaatgttacggagtatgaaaaatttattatgtaattcagatgctaccttgcaactaaacttaagaaatgattatttgttgagtttaggtgtaatagtaaagaagaaataaccacaagtatataaaaagacttaagatttggctgggtgtggtggctcacacttgtaaattccagtactttcacggggtgaggtgggaagattgtttgagcccaggagtttgagaccaggctggtcaacacagcgagaccgtgtctctacgaaaaactaaaacattagccaggaatggtggtgtgtgcctgtggtcccagctgctcaggaggctgaggtgagaggatctcttgagcccggaaggtcaggactgcagtgagccatgttcatgccactgcactctagcctgggtgacagagtgagaccctgtctcaaaaacaaacaaacaaacataaaaaaacttaagatttgaaacttccaactgcatatactgtatctgtgtgaggccagatttcttcatatccttcaaccagaacaatgtattgcaaaaaattgaatgcaaaagtagatgggaaaacccagtggtcttgtattaagccagacatttaaagagatttgctgtgcatgtgtctttgaaatttaacaagaaaagagatttgcggccgggcgcggtggctcacgcctgtaatcccagcactttgggaggcagaggcgggtggatcatgaggtcaggagatcaagaccatcctggctaacgcggtgaaaccctgtctctactaaaaaatacaaaaaaaaaaaaaaaattagtcgggcgtgatgacgggtgcctgtagtcccagctacttgggaggctgaggcaggagaatggtgtgaacccgggaggcagagcttgcagtgcgccgagttcgccccactgcactccagcctgggcgacagggcgagactccgtctcaaaaaaaaaaaaaaaaaagagatttccaaaaatgtaaaacagtgctgctcatctcaccttacattttgttttagaaagtagttgtttttcatgaaagatactgtttatgttacagtttattatagttggtttttagtgaattaataaatatttaaaaatttcctcagttttaatttctattgcagaaaatgttaatagacttatattaacaaaatctctttggagtcctcagtaattttaaagcaataaagggatcctaacaacaaaaagtttcagaattgctttttttctgaataatacagaagagatatcttagtaggggaatcttttcttctggaccaaataaagatttaatgaaggactccaccaaggactcttggtccttgcagggaagtcactcaattatcagtgtactcagctggcagatgagggggattgccttgtactatctccaagtttctttaaaccccaaactacatgatttcaaatcactatcattgtcagcatgggcattatgcagcaatctcccgagtatgctatttgctaggttaaagatgaaggttatatgtaaggatataatgcagtagtatttgtgaagcagggactccagggacttttctttttgggcctgtaaaattatttctttcactgctcctttaaaagaatagaagttttcatgattattagattttactgtaatgagcaagggaaagatttttaattattgctgaaaatttttgtcaatttatgtatatcacaaatttaaaaatgcatgatttctgagaatttttctgctctaatgtatatgtgtaaacttatgtgaatatttgtaagtatttacataaatcatttaaatttgttaatgggttctaaatataccactgatgtctctgttgaagtagactcgggttgcatatccattatatccttacttaccagccgggcatggtggctcacacatgtaatcccagcactttgagaggctgaagtggatcatgaggtcaggagtttgagaccagcctggccaacatggtgaaaccccgtctctactgaaaatacaaaaattagccaggcgtgatggtgcatgcctgtaatcccagctacttgggaggctgaggcaggagaattgcttgaacccacgaggtggaggctgcagtgagccgagatcatgccactgcactccagcctgggcgacagacagagcaagactctatcttggaaaattaaataaataaataaataaataaataaataatatccttacttatagtcttcatgaagttaatttgttattttggttctttggttttaaaaaaaattattaggtctgtatttacaaatacagacttaaaaatgtaccagctagaatctattaagaatccccaactttggaactaacatttttcttttttagtttaaatgaaaggcaatttgatggcttagttttttaaaatggggaaacaaaagggaggggaagccagtagtatcttgttgtgttaagtatcagtttaaatcaaatgttaaacaggatcctgcattcttgtaaagtgaatttagtaatggaaactgccacagtggagggccagctctgtcataatcaccaacttgagcatctctgatatttagcagaaatataaatatctaatgcagcgtgtatgtgttatactgtcatggcaaaatgttgtaactgattttgagccagattcttccagtgttttgaagctactgcttggaaataagatttggaagctgaactaacttctacaatttggtaaactatagtaaagttaactcagcatatattataaatacaatagaaatatataattatatataaaaaagtttcatcaaatttcaaaggtttaagtactattttaggatattcatagaacccaatctaagaggaaaatgctcctcactgccagcaggagaacttaatggagcgcagcgttttagagcatagacgttaagagccagctgcctgggtgcatatcccacggctgccactgagtagctgtgtaacctcggtttgcttcagtgtactcctctgtaaaatggagataatatccatctccctgggttgttttgaagatctaacgagatactgtgtttcaagtgctctgttgttccattattgtttagttagcaattgttaagttttaggttatttcttcatgacatctgaattttttttaaaatttatttatttgtttattttccttgagatggagttttgctcttgttgcccaggctggagtgcaatggtgcaatctcggctcaccgcaacctctgcctcccaggttcaaacgattctccagcctcagcctcctgagtagctgggattacaggcatgcaccaccacgcctggctaattttgtatttttagtagagatagggtttctccaagttagtcaggctggtctcgaactcccgacctcaggtgatccgcccaccttggcctcccagagtgctgggattacgggcatgaaccacggccgacatctgaatttttatctcattaacaacatatatcctcaagtaatgttttagggtaagttacatctgggaagatttggtattcatagggcatggtagagttctagtggtatgttggctttttttttttttttttttttttttttgaggtggagtctcgctctgtcacccagactggagtacagtggcacaatctcggctcactgcaagctccgccttccgggttcacgtcattgtcctgcctcagcctccccagtagctgggactacaggcatccgccaccacgcccggctaattttttgtatttttagtagagacggggtttcaccgtgttagccaggatggtctcgatctcctgacctcatgatctgcccacctcagcctcccaaagtgctgggattagaggtgtgagcaccacgcctggcctgtgttggcattttaagaatccttggagattatctggtcaaactcagcctgatatgtaaactacctttctaatatcctgttgactaagcccccaacctttacttgaatttaaaacatccctgactcttgggaaattcttccttgtgttgtgctacagttcatctggctgtaacctcctctcccagcccttacttcttccttgtagagctacatagaatttttgtctaacaaataacccatctgaatggtgacagtgaagcaaatgaattctggacaatttaagtgttgtataaaagtggccggatggtgtgtgtcaaagttgagggagctcagaggactttgctccctgttggtaaaagaagcaaggctcagatttgtggttagagctatcctgatctagttgggaacacttttgcctcattgagcctatgatggggctgtgagccagacaggggataggcagtggctgggtctctgggccccccacttgcataaagcacccccatccattgctatacttgtcctttcctggaggaggagcttctttgtgccttaaaaattatctcaccgccaggcacagtgactcacacctgtaatcccagcactttgggaggctgaggcaggtggatcaccggaggtcaggagtttgagaccagcctggccaacatggcaaaaccctgactctactaaaaatgcaaaaaattagctgggtgtggtggcaggcgcctgtaatctcaactactagggaggctgaggcaggagaatggcttgaacccaggaggcggaggctgcagtgagccaagattgcgccattgcactgcagcctgggcaacagagcaagactctgtcttaaaaaccaaaccaaaccaaaacaaactccatctcacgtatttgttcattgtctatttctcctcctgcatagaatggaagctccatgaaagcagaggagaaactgcttatcttgttcgctgctgtttctcgagtagccacaagaacttggcactttaggtagtaggtgttcggtattcaaatgatggaattaaagatcaactctgaactctcaaaggcagatagattttcactttagtgcaggaaaataaacactcatatgtcatgcccattcttcaggcctgaaccaaaggggaacctgtcagaggataggaaatgagatctcagcagcgtctgttactatttgcaattttcaaatacataaagagaaaagtatcttttgtctttttgatatgtgaagattttctagaaaggagaggtttcaactcttattgaaggcgggagacaccatgctatcagaattggattttaaaatcagcccagctggatagtagcttcaaactgcagccagcatgatgtgttacatgagtttagctttgagtgttaaaagaacaagtttgccagaaacatgaattgttaaaaaaccatgaaaacattacaatgtaggaaaaaaatgtagtgaaaattccagtatataatgtccaaatagttcctttttctggaggctttaaacattttcttaggtaatttgcaaagaatattggacaatgtagaaaatatgtgtagagttaaaatgatattgagaattctgagcagatgattaaggaaatctggacctccttttttctttgtttctttctttctttaatatgttagtacttgagttttccatagaattaggacatatatttaggtcagatctcactgggatattccttgggatatcttgattcagggttttcttccttttttttttttgagatgaagtctcactctgtcacccaggctggactgcagtagcaccatcttggctcactgaaacctccgcctcctgggctcaagcaattctcctgcctcaaggcctcccaagtagctggaattacaggtgtgtgccaccgcacccagccaattttttttttaatttttatttttagtagatgtggggtttcaccatattggccaggctggtcttgaacccctgatctcaaatgatccacctgtctcagcctcccaaagtgctgggattataggcgtaagccaccgtgcctggcctttttttttttttttttttttttgagacagagctttgctctgtcgcccagggtggagtgcagtggtgtgatcttggctcactgcaacctccgcctcctgggttcaagtgattcttctgcctcagtctccctagtagctggtattacaggcgtgggttaccaggcctgttttttttttttttttttttttttgagtcggagtctcctactgtcgcctgggctggagtgcaatggagtgatctcggctcactgcaacctccgcctcctgggttcaagcgattcttctgcctcagccttccaagtagctgggattacaggctcccgccaccaagactggttaattttttgtatttttagtagagacggggtttcgctatgttggccaggtcagtctcaaactcctgaccctgtgatccacctgccttggcctcccaaagtgctgggattataggccactgcacctggcttttttttttttttgagacagattcttgctctgtggcccagggtggagtgtagtggtgtgatctgggctcactgcaacctccacctcccgggttcaagtgattctcctgcatcagtctcctgagtagctggaattacaggcatgtaccatttttatatttttatataatttttgtatttttaatagagacagggtttcgccatgttggccaggctggtcttgaactcctggcctcatgtgatccgcctgcctcggcctcccaaagtgctgggattacaggtgtgagccaccatgcgtgaccccgattcagagttttctctgagaagaaactcccttcgattttggaacccaggaggctggactgccttctagtctaggttctaccttccccctgctgtctggtttggcttaatcacttgattcaataattttatgactttgagtgagttacttaatatcactctaccttagttctttcatctgtaaagtgcggccaataatagtgtatctcaaggttgttgtgaggaataaacatgttaatacatgtcaaatgcttagaagagacccttgcacaatagtaaacactccatagataataatgttattattagccaaatgtggttattttgagggtcatataatggggaaaaaaatgcaaatttaaaattcctgtacaaattcaaaggaatatcgattgtctctgtatatcaaagatgaccttagtatttgcaaagctctctctcatttagggccactagctgtttttccatttacacttccctatacaggatatagagttaatttctaggaaattagccattaattattggttaatgatggactaggaatgctctcaggagagctgactagttagaacatgacataactttgaattatctaagctttacctttacgtggaattttaactttgttgaatttttaagtaaagggatataaaagccagtctgctctattattagattcactgtgttcataaggcaacatggaaaaaaatagataatacagaaagaaaaatgacaattttaaggagaaaagtttttgtttttaaataattttctatgttaattaaattccatggatgttttgttattactttgtctctacagagaatgcagcagattttgaacatgcttttttccctctgcttaaaatgtgttggctattatatttcacaggacttacgtcgttttcaaaaatagaggtaattaattgttacgtgttttgatgttcagcaggcaaaggaaacacattactttgtgtaaacagaggttaatatggagtctttgaagtctaaattattgaactatttgcctaaggacaaacttcttaactgtttaggtttcttctggcctgtaataaactacagtggtggaaataacacaaaaaatcctgtgtataaaacatttgggtcctggttgcgtgtttgacccaaatctgcaggtttacctttgagttacactgcgaattagggacctttcatttccattttcctttccttgtagtggtttagttggttcatggttgataaagacagaagcatatgtttctgggaatggtaaaccttaattttgcttaagttttaaatgatcacttatttctggaactggcactggggtcgaagaatgtttattattccatgttaacatgggaatgagtctaaagactaagtgacgtttatgctcacttctattttacagcttccttgggctctagccaaggtgacttggttttgcaagagcgaagaggacctgccttatagtgcagtttttttttttaaattgtttttgtctgaaatgatctaccttgaggacagaagctgtactttgcagagtaaaagacaaactattactggttttaacaaatgaacaacccaggcaggtgggcatggtgcaggttgtgccccagcttgtgaggtctagcagatcttgtggcctttggacaggcttgccttggggaggtggaaacacaatggtgatgatttctaacttgaagagacctttgggactccagtccagaagtttttacctgtgtgtactgggtgggaggcgtgttgtgcttcctgctatgggggtggtgagagccgtttcccacctaagtgggacagggagaaagcgtctgatcggcacacagggtgcagaagcagcactggcccaactccacactcacttttccaggatcattccttttgcaccaagctctgaccctgtgccctctcactgctctggggactgttgaagccacaaggaggaagttgctactccttatgcccttcattcttcctgtgccccagaccgagatctgtcaggggtggggtattggaccccacctgaaatcacttgtgtatctggcagctttcttgggagtttctcctcagggggcagactcccatataaagtactggctggtatgactgcagctcccgttgacccactcactgttcacagaagcctaggaacagactgtagaacccagagaaagctctgggtgacctctgttatttagcagctgcttgcagcaccagtcactgtggcaactgggctttgtttatgaaaatgaatgaggacctcaagcctggggcatccataccgtggacagagctccccctggaaatcgactgcctgccagattgccagggctaaaccaaaacaaagacataccaaacacaagtagccaggaagtattctgcccttggggacgagcaccaagtcccgattgcctgtatccctcttcaccaagcataaccctgccaggctgagctgatcttggttatgccagagaaagacagaggcaaagaacatggtactagtattggcagtttttggaacacagccttgtattgctcaggtctggcctctagttctggttttagatggaaagagtgttgagtaccaaagatctagctttttgaaaattttatttcaggccctgcctttatgtaaactgtaacgatcatttgggtctgtactcaagaggcaggagaatcacttgagcccaggagttctgggctgttgtagtgcactatgccaatcaggtgtctgcactaagttcagcgtcagtgtggtgacttccctggggactcccaggggactgccagattgcctaaggagagatgaactggccaggtcagaaatggagcaggtcgaaactcccatcctgatcagtagtgggattgtgcctatgaatagacactgtattccagcctgggcaatatagcaagatcctgtctctaaacaaaataaaacaaaacaaaaaaaaaccccttgtctggaacaactgagtttggagtttgttgtccccttagagtccttgctttcatagtgattgttttcttgtgtccaaagcatccttggtagttttaactctccatgggaattggtgagccatggacatcatcttggagcacactttgaatctcagagcttcctttgaggggactgctatgttctgggtgcttctggtattcacaggttctatgattctatggctggacccttctagcatatgtgccctttggtgtcactttgtcagaaccacagccagtgcatgggtcttctgatgccatcctgtggctctcttccccacaccatgccttgtttttttttttttgtttgtttgtttttttgaagaccttcgagtctcgctctgttgctcaggctagagtgcagtggggcaatctcagctcactgcaacctctgcctcctgggttcaagtgattcttgtgcctcagccttatgagtagctgggattacaggtgcgtgccaccacacctggctaatatttgtatttttagaagagacggggtttcaccatgctctccaggctggtcttgaactcctgacctcaagtgatctgcccacctcaccctcccacagtgctgggattacaggtgtgagccatcgtgcccagccacactgtgccttgttactgcatgtctgcttgggtcatggcccaggtgtcatggtggagggggcggggttgggaggtagagagtgctggcattggtgatttgccagcaggacacatgcccaggaagatggtcagaaaaagagggactccttcacgtacgtataagtcagctttagccttaaagcttcaaacacccactcactgcattgaggagtccttgaggtccctcacctgctcttcctggtctgactagatgccagggaattgggagagagggacctgcagtgggagggtcctggaactgcagtgacagtaatacgggcttaaactagaattccttcctggaagaatttcggtcttcctctaccccagcagcctttcactccttaactttagtagtgtgccttggggcttgagcagctgctgcttctgtggaggtgaccatccagagggaccctttcacagctaagttcacttgcacctccgtttctgcttaaggcaactacagtttcgggggtggctgcccctgtttgctcatgataattccttatgaactctcctgttgataaactgaactggatcagctttagtttccctttaactaaggatttaagtcaaagcgtaaccacaagtgtcctgttcgttttcattcatttcagtgctgaacatttatacactgggctatggatttgatgtttccttcctgtcttggctgagatacctgtgtgaaatatgagtttgccatttggcaaactctttttcctttgactagttaatgaagccaaaatattgacgggggtgtggagttaggggaagaggaggtgtgcatggttacatttgaaagttcttcatggtgcaggagaatccagtgcttcaccctgagtaattgtaattagggtagtaagtaaaccctttcaggtttattctatagcgatcatgacgagttatcttggggaagggataaagaagactgtgagaggttgtacagttctgatcctgtcaggctttgagaagcagacctcagcgtgatctgaagagccggtaccctggagtagatgattaaccaagataatgttccggacagtctgcagctgaactgaactggtgtctctgcatccattcatagttacccagtgtggttaataacaagtccgttgggagttatgcctgtgctggccataactaccttgtattctggatgggggtcagagaaactgaatggatcgattcattcactgagcagtgagtgactgcagccttactgaagccagctcctttccagctctttgatgacatgcactattattgttgttaacaggttggctaaaaaagtaaacctgggagagttgaggctttgttcctctgtccagcactcagatatttcctgtagtcattcagtaaacatttaccaagtgcttactgtgtgccagggactgtgttatcataaccagtaactttttcttcgttaatgaattatctcatgcggcgtgcatacaaagaagccttaagaagtggaggataatgggggcctgtctctccctgctcatcctttggggctgtcacatcacggaaaggaagtaacagtcaacttaaatcagtttactttggtaatagcagtttttgaaaaggtttggagcaggaaattgaaactcttgagaaacaggaggtttggggattactgctggatttttcttattcctgctatcccaaggacttgatcccagttaccactgataatggaccccttttatgtttaactgtcttgtcagtaagtcagtgacacatgctgagaatagaaaccagtaccattccatgtcgtaaccgccagcctgtacacgccccgctggttctgttgttgtgatcgttgctacagcgcttaacatcaaacgccagcctcatgcctggcactttacatcacacctacggcgtccccaccccgggagcttaccttccctagaagtccaggacattttctatgttggcaccacaggaataggtagagggcaagggacagaaagttttcgtcagtaaaatgtggtcttttcttgaatcaataaaggcaactatgttcatctgttttaataggaaaggcctgtaggtaattttttttctccgttaaaatctgcttttaaaaatgtttggggttgagtgtaacaacagattgataactctctgttcatcgcttttccgttcttgcaaaatatgtgacttgcagtggttgactaagtgctaggctctgacgggaagaaatgagacccgtggaactcctggccccctgctctgtaggtgcctccagaccagggaggggagacaggcatcaggtggcatggccaggccttttttttttttttttaatagtggatgggagaaaatgggaatatgactaattttatttaatacttaggttgttttgtctgtttgctttactggcatagggtcatcttcagctgaagaaggatgtgctggtgcttaggaatggctgtcaggagccatcggtttgctccttcaaacaggaagggcaatgctggcttcagctaagagcgagagagcttctttccccagacacccagtatgtctctctttgcaatcattggctgaattgactcagcttttcctcccatccttgaatcagtccctggtagagtaatggagttacagtgattggcttaggacagtcagctggagaatcagtcacaccactcaccacagcggcctcctactaaatataaatgtgagcgggacttaaaatagaagaaatgcacatctaacaggaccataacttagggataaggtactggacaaggtaatgaagaggcgatcatggcccttgtttgtgtttcctccgttccctcggcagccttctaggggaccctctaatgtgctacctcactgtgtacctgtctctctatcctgactccacctgtcactctctctcgactctgggagtatagctgcttaaggccaaggcactctgtcttactatttgtggccactgtagctggcacatagcagggacttaatatgggtttcagcaaattgaacgaaaaaggatacttcgtattcctttgtgtttaacttttatcaaacattgcttgaatcaagtggattttttttttttttgagacggggtctcactctcacccaggctagagtgcaatggcactatctgggctcactgcaacctctgcctcctgggttcaagggattgttctgcctcagcctcccgaagagctgggactgcaggcacccaccaccacgcctggctaatttttgtatttctagtagagatggggtttcaccatgttggccaggctggtttcaaactcctgacctcaggtgatccacccgccttggcctcccaaagtgctaggattacaggcgtgagccactgaacctaaccacaagtggactattgatagtatattcattgcacattttataacaagtttattgagatataatacacataccatgcaattcacctctttaaagtgtacaatcatttttaatatgttatcagagtcgtgcagctgccaccacagtcaattttagaacattttaatcatcctccaaaaaacctctttatccattggcaatctctccctattcttccctttccccaggccctagtaactactaatctattttctgtttctatggatttgcctattctggacattctgtagaaatggagtcatgccatatgtggccttttgtgaccaatttctttcacttagcatgttttcaaggttcatccatgttgcagcatgtatttggtatttcattcctttttatggccaagtaatattttgttttatgtatataccacattaaaaaattcatcatcagttaatgaacgtttgcattgtttcctgtctggggatatgaggaataatgttgttatgggcattcatatacatgcaagtttttgtgtgggcttatgttttttcccttttttctgggaagtatggctttggccaaggccagagtcaagcacatccttatgtttttatttctcttgtatttatatgtgtctgagagtagaatcgctgggtcatatggttactctgtgtttaaccctttgaagaactgccaaactctttttcaaagtggttgcattattattgttattattttttgagacggagtcttgctctgtcacccaggcaggagtgcagtagtgcgatcttggctcactgcagcctccgcctcccatgttcaagcgattctcctacctcagcctcccaagtagctgggattacaggtgcctgccaccatgctcggctaatatttgtatttttagtagagatggggtttcatcatcttggccaggctggtctcgaactcgtgacctcgtgatccacctgcctcggcctctcaaagtgctgggattacaggtgtgagctactgcgcctggcctgttgtattattttatactcccagcaacaatatatgagggttctagtttctccacatgcttgcaaaccttattattatctgtcattttgaattagtcatcctagtgggtgtgtaatggtatctcaatggatgttcatcaatgaaaataaacatttgaatgggcacccatggcatgtcagatgctctttcttaggtgtgggggcaaagagatttgcaaccttcggctgtctgtctctctggcctcatctgttttcacatctttcctcttgatttatgttccctaaataccaaactgtttgtagtcctcatactatcatgtcatttcttacttccagatctttgcctataatctaaatattaatgcagtgtgaatattaatgccattactagttaactcttaaacagccaataaattatagagctggcagtctggctccagagtctgtgttctgtactacatactctttttttcttttaaaatcaactttatatcgaagtataatttatatagattaaaatgtacactttatttatttatatatttatttttgagacagggtgttgctctgttacacaggctggagtgcagtggtacagtctcggctcactgcaccctcaacctcccaggctcaggtgatcctcctacctcagccttctgagtcactggtactacaggtgtgcaccactaaacttggctatttcttgtattttttgtagagacggggtcttgctatgttgcctaggctggtcccaaactcctgggtttaagcaaccctcccaccttggcctcccaaagttttgggattacaggcgtgagccactgcacccagcaaattgcacacatttaaaggtacattttgatgagtattaatgaatacatatgcctgtgcaatcaccactgcaatcaagatacagagaatttttctattatccatctccacccctttcattctcttcagcctccctgtagtccatatccccagtcccaggcaattactaatctgctttctgttgctatagattagttttgcctgttctagaagttcatgtgctctttggtgtctgacttctatttgctcagcaaaatgtttttgagaatcaacagccaagttgttgcatgtattagtaatttgttcctttttgatgctgaatgttttccgcggtatggatataccccaatttgtttattcattcacctgctgatggatgtttaggttgtttccttttagtattatgcagttaagtagctatgaacctctataaacatgtctttttctggacatatgtcctcagttttcttgagtaaatacctaggactgtaattgctgagttgtatgtaactttataagaacttgccacgcagttcttcaaagtatgtgtacctatgttggttttaatacagattcatcatttcctatccatgttgcttgggtagattatattaattcttaagaatcacctcagatatcacctgccctaggaagcctttttttgacccttctcatcttccccttctttgaggtgaattagggaggctccccctccaggctcccttaacaccttgatgattgagtgttcactggcctatctttcccattagactgtgagctccttgaagaaggaaaatgcgttattatttctgtatccccaggaccttatatagtatttaccatctagataggtgctcaataaggcttgtgaatgggcgactaaataggacattattcatctttatttttattttatttttgagacagggtctatctagttctgtcacccaggctggagtgcagtggtgtgatcttggctcgctgcaacctctggctcctgggctcaagcagtcctcccacctcagcctcccaagtagctaggactacaagcacgtgccaccacgctggccaatttttgtatttttgtgtagagatggggttttgccatgttcccaggctggtctcgaactcctagactcaagtgattcccttgctttggtctctcaaagtgctaggattacaggcgtgtaccaccatacccggcccttattcagctttgtaagggagtttatggccctgtaagggagataaaataggcatgcaaataactaatgtgaagcagaaattaatagagttgaagaacaaagtctgtgagaagtgaaagagagtgatagcttttagtgaggaggatttgggaaggctaataaaggagatggggtttcaactgagcccccaaaatagattagatgtgctgagatattattacccattgattctaaagggatttgacttgatcttctgttctaaaagattggtgaggctggaaaatgaagtttacgtttgggaaggtcacactaagattcatcttttttttttttttttttttttttttaatgctttgctcttctcagcctacagcgggcactaggagatactggaaatgttttctgtttggcagtagaagaatataaatgtggcggtttgtctatcatctctccagattctaaaggcttctaggtgggattgaaaagacttctcttatcctctttgcctcttaccccatatggtaataggtcacataagtcacactattgccaaagctctgcttagccatttgtctggtctctttggtctcagccacctggcttcactatttagcacatatttgtccattgtcttctatagcacatgttcatagactattagagctgggaactttcaaaataatcaaatgataggccctccctttacagaggagaattgatactgaaatctagagactaacctggttaataatagtaaagataaaagctgccatttattgaccatttaatatgtatcgtatatttgcatgcattatgtaatcctcacaaagtgtagatgtcttcattttacaaatgagaaaactaaggcaaagtttcagatggtatagacagaaccaggattcaaagccaggtcttttctctacagcatcctacccaggcaaggccccaggtccgtagagttgctgaccacagaggaggaggaagttgggccacagctctcaggtctatgagagggcgttgtcactgaagtggaggaaaccaggattctctgcttcctagagagacactgagattgttcctttaaaccacatatgatttttaaaataagatatgtagagcagaaaccaatcaactagcattggctttggtcagaattatttttatgataaagtagagcatatttttaaatttttaattatctaagtaatattcaaaaacacatttgcacagtaaaagcattaagaatgtattaggttgatgcaaaagtaattgtgttttttgccattacttttttttttttttttttttttgagacagtcttatctctgtcacccagtctggagtgcagtggcatgatctcggctcactccaacttctgtctcccaggttcaagtgattctcatgcctcagcctcccaagtagctgggattataggcgtgtgccaccatacccggctaatgtttgtatttttagtagaggcagggtttcaccatgttggccaggttgctctcgaacccctgaccttgggtgatctgcctgcctcagtctcccaagtgctgggattacagtcatgagccactgtgcccggccattactattacttttaatggaaaaaactgcaattacttttgtgtcaacctcatagaaggatggagagcaaagtcagagttcctctcgtgtctccaacccgtctctagcatcacccctaccttaggtaagaaccatttatagttagagttatccatttaatcctttttctatgcatgtatgtgcatgcatatggacaaatacacatagttttagaaggttaataaattgtatcattctttacatacaaaaagaacatgtcataagatatttctgtctgtacaaataacagtgttttaaatgcagcatatgtatttcatgatatagatacaccctttttgatgaacatttaggttattattattttagacggagtctcgctgtgtcacccaggctggagtgcagtggtgcaatctctgctcactgcaagctccgcctcctgggttcacgccattctcctgcctcagcctcccgagtagctgggactacaggcgcccgccaccccgcccagctaatttttttgtatttttttagtacagacggggtttcaacgtgttagccaggatggtctcgatctcctgacctcatgatccgcccgcctcggcctcccaaagtgctgggattacaggtgtgagccaccgtgcccggctggttattttaaagtatttgtttattataaatactgtggcagttaacatctatgcctgtaatactttatagtaccataacagtgatgttgttatggtgtagtacagtaggtgtatttacactgatatcagttacagcctggtgtaattacagttatgatgtaatgcctttagagagaggttggacagttcagttgctgtcccaaacctggctgagaagattacaaaagatttaaaatatttctactggtctttattattgaatgactacaccctctgaaaagtatgaattgagcattatgattgctcataggtaaaaggttagcaggcatttaatatgtgctaggtattttcttgtgtattctctcatttgagtcttataataatctcataaagaatgtgctgctattcactgtttatctggaactaagactgagaaagactgtggcttgcataaagtgacacagcttctaagaagccagttcaagatttgaaccctcatctgatgatcagtttgttttttctttccccattttctgaagctggttcattctcttaagaactgtaaggagaaaaatgatagaaggcagaatatctttgaactaatgaaatcatcgcatgagcagagaagcagagtgggcatcctgtggatttaggggagggagggggtggtaaagcctctgaacctgtcactggacttggaggtgtgattcatgacttcaggatagtggctatgctgagagaccttggtgtctgacagcaacgtcctgctattgtaagctatggatttactgtcatgctaagaaataaatcatgaccaggaaaggctgtatgtttaggtgctgctgatgcctgtaggccctctccaaacaggagaatggctctcagtggatgaattgtctcagcttcctctgagttgtaatttctatgtgggtcaaagggttatttttagcctgtgggatccctagctctttgaggagtggcctcgcttacaaggtcagtggagtgggatgatggtcgggattttttttttttcccagacggagtcttgctctgtcacccaggctggaatacagtggcgcgatctcagctcactgcaacccctgcctctcgagttcaagtgattctcctgcctcagcctcctaggtagctgggattacaggcgcatgccaccatgcctgggtaatttttgtattcttagtagagacacggtttcaccatgttggccaggctggtcttgaactcttaacctcatgatccacctgcctcggcctcccaaagtgttgggattacaggcatgagccaccacacctggcgatgatcaggatttaaggattgtttctgagctcttcctggaccctgtgttttaggtcccccaaagaaggtgtgaacagccttttggaatctgttttactctggcaaaataatctgtgtccatagattgcaggaggatgctgttggtgttataataatgctctcacatttaaaaataagttatcaagtgtatttgaggaagaaaactaagaaaatctggaaaaaaccccaccatcaacaaaagacacgcaaaactctaaaacttgtaataggataaatgatgttcttgtaatgaatgtgtcagcattttaacacatgtgtgctcagtgtgtggtgatgcaggatgtgtataacagaaagcacaaacgtggtctgtgtttacattaaatctcccacctccaagacacacacacaaaaggtcccacttgagtatgtgtaattacatctctgaatactcccttgatcctatttttttccttttccctaaacacatattttggttacttctccaaagatacatgatatatattagcctcactcagaaccacagggaacatactcaattgaatcacacctctatgagtagtgtataaagtgtaacattttaaaacaccagggaccagggctggcaaggtccacggggaatcctgaaggctggtttccagccacaactgtgctggaatgaaaatagaaaacaatgaggcatgtgcagagtcagcttttctttgtgtcacagctcagcagttttcctgctgtcctaaactttcctaaaaaaaaaaaaaaaaaaaaagctggggctaaggggaaatggtgcagttgcagttgaaatttttttttaatagtaaagactgaaaatataaactaacagctggtgctgtaggaacatgtgaaatgaagagtgaattaatggtgagaaatctcactgctctttgcttggctgtgaggacacgcgtaggaaggacttgtggaaacttgtttggtaaaatagaaaaaaaaggaaaagaaaaagctaagtaaccatcaagcctttttcaggagtgggggaaaaataaaaatttatatactctaaacttaaagctttatttatgatcattattttaaatatctgtaaatgcatctgtaaaaaactccagccaagacagagggagatgtgaattatcaagtatattgacttttttttttttttctgttatcagtagcatccttcagaaagtactgattaaaaaggaaggccattcccagttcttggtttatttgcctcatagcgcaccaagtcaaggttgagctggggccttattccagaaagcacaggcttcctttctgattggaaataatatgtattttgtttgaccttcagaatactcatggctttactggaatacatgggccaacatttgtcctggcaaggccagggcagtttaagataggtatccacagggattgctttatagagcaattaaaagcagtgggagggaggtgactgcagaaattcagacgtttgcatcctttctggcctaaaaatcaagtgagtaatttcaaaaagcagaatttgaaaacaaacaaacaagcacttctagaagtttctgtctgaacacttgagaattttgccaaggtcatagtgttctttattttttctttttccttacatgttactttctgaaatatgatcatagtgttcttttgcaactgatcttggtgtgaagagggggttacatcttatatattacacagtgctaatatgtgtaatattaacatttttttgaaagattgtcaaatatggaccgtggaaaacagtttccatgccgtttgaacgttatgttctttatgatgctttgtttataaaaatattgttagatagctagggatgtttactactgccagctggagttaggcctcatggtagctttttaaagtcaggctggaggtgaattcaaagcctaacacagagtttcaagttattgttcttatttgaagtaaatgcataattggagactgtattctgatttcttgaattcttagctatgccagtaattcttgtttcttagggccacagtttggttctgtcaaatgtgtagttgtagagatgataaatgagtactcagagattagatgaattcatatatggtgacattaagatgttttctttaataagaatacctattatatgggagtaagtgaaaataatcatgtcttaatgttgttgaaatcctgtattcatttgggggaaaaaaagtaagtactttgtattctgcttatgtaaagggatatgaaagaatgtatataactaaatttcttaatgcttcattttgcttttgatgtgcaaaatataactttactgctaggtaaaattatacttgaatattaacagttattgcatgagtttaaagtttcagttgagcccaatatatgggaaccacgcagtttctagtgattttcaaaatatagtcccataaagatgaaagagactcaatagctgaaataggtggtacacttgatttaagtgaacatttgctaacccaggaagaatcaggagccattccaacactgtagctgtgtaccatagatacaaaataatatgttatccaacttagtatgtatttgcttactgcagttgagaacgcaggagtggtcagtgaagtgtagggattagggaaaataattgagaaaaatgaggagaaagaaagaaaaatagatgttttggtaatctttgtcaaatgttttctcaaagaccaggctcagatttaaaatattatgcagatgtagtctttggcctctggtagtttctgataggaattcagccttgagttgaactttgagatgggttgttttcttttcgtttttttcttttttaattactaagtgaccaatctgttgtagtttgttgatctattttttcctcttgccatccttctgttgctttctccatgagctgctgtttattctggaatgttgaacatccacatttagaattaggatttgtgtggctctatcttaaccaggaatggaaaaaatccaacccagtctttcaattcatgggtttaagtggattcagagaggttctcatccacagtgacaggttcagaattcccacttctaaagcccccgtttcattaggtaatgaatatacaagctgagcccttccaggttcacactgtggaggcttctccactcctctgtcttggttggctttcttccttggggtgtttgggaagagtctgattacagccaacttctttccttgtcagttgattttataacacaaaccattaaagttcaaactttttgttcagcagattgatttcatttgtctcttctatagggatctcacttagagtttatagaattctttgctatcctttactttaattcattttggcaaggtatgtagtattaactccaggtgaggcaaccaagagaggggccctaagtcaaggaacttgttaatggcagagatgagcctggaacccaggccttctaggtccaaatgtagtgttctttcctctgtgctcccaaggttcccattgtatcctgtgggcttcttttttgtaacgtaaagtgggtagtgaggagaaaggaggttcttttctgttgatctttcatatacttattgatgttatctttatatttttatagaacttcctgatttaattaaacacttctcaaatgccatgatctcatttgttttcatgatgaccttgaggattagctaggacaggactatccctattttattttattttattttattttattttattttattttattttattttaagtttagtttagtttagtttagtttagtttagtttagtttagtttagtttaagatggagtcttgctctgtcacccaggctggagtgcagtggtgcgatcccagctcactgcaacctccgcctcccgggtccaagtgattctcctgcctcagcctcccaagtagccgggattacaggcccccacaaccatgctcggctaatttttgtatttttagtagagttggggttccaccatgttggccaggctagtcttgaactcctggcctcaagtgatccacctgccttggcctcccaaagtgttgggattacaggcgtgagccactgtgcctggcctcaaaaatgcctgcttttataaattgctcacagtatagtagagatttttacagtttggagggtgttggaggttaattttgttgaaggaagtaatttctctaatgtggaggaggtggtaatttagaagactatgttgtagaactgcagccgggtatatgtttacttttgtgagcgcctgttttatttgcccgtttatttatacctatgcattttgatagaaaaataaatatagttctgttttggctccctgaaatagtttttatattttctggaatttcctcacttattgtctttaatattcctaagttttattatgactcattttggtcatacaatagtagaagaagtaggtgtcggcctgtttgaaggggtttattaagtaatttggggaagtatatttttgaagcctataaatattaatttgtccctggtgttgagatttgtcttgtggttgtcagttgtgcatgttcttatatgttttggataggggagagtaaaaaggggttgagcatagtttatttttttctttggctcaaatatgtagttttaccataaaccacggaaagtttcctgttcttgtttgattaaaaaaaagtacacttccattcattgtttccatgtaacttcctatactttttactaaaaaaggttgaaatctaggataaattatgagctatctctcgggcaaagaaacgatttcatttcaggaaggagcttaggaagcgaaccttcttgagtatgagaaacagtaatagcccttggcatgtatgtgtgtgtgtgtatatatacatacatatacatatacatatgcctttccttacataataatgatttgcaaagagtgaatttggaccccgacttctaatcaacatggaaaggcagggaagattccatgtcatggctggattttagaaagctgcaaatggtattgtaccatagagcaggggtccccacccccaggccacggacctgttaggaactggggcacacagcaggaggtgagcagcgggtgagtgagcattactgcctaagctccacctcgtgtgagatcagcagtggcattagatttttataggagtgtgaaccctgttgtgaactgcgcatatgaaggatctaggttgcctgctccttatgagaatctcacgaatgcctgatgacctgaggtggaacagttccatcccaaaaccatcctctcctcctcggtctgtggaaaaactgtcttccatgaaaccagtccctggtgccaaaaaggttggggactgctgccatagaggggcctttgggtggccccgttaggtgttttctttgtgaggtggtgctttccagcctgccctggactctgtggttcatggtagatcattcgtactgacctggaccagggagcactggtaggagtatctgatttctatgaacagtgcttgctggcactgactcaagaaagaagacaggaaggaatggtgaatacaacttccattgagaaactagagtggaaaaaatgtgcaaattatgctaaaattgtaattaatctgggctgtacaggttgaatatctcttcatcctgaaagaaaaggggaggtcaccatgagaaaatgggattgagggaccataagaactttgtcatacctagttatacatttgtttttttctcttagaacttctgaaaagcttgaagccccagaagcaatagaatagagcttttagcatggttttgttgtgaactaaattcccaacagttcacctttagtgcataagcttaactttctttgatggtttgccattcaaattagattactgtggacagtgtccctaatattgtcactaatattatgatacagtatcagttttacagcaggtttgtgcatcatgaaggaagtcagaacgttttagtgagttacaaggaaaatagccatcaaaagtccatataggttactctgtggatgggttggggagccatcttctggtcttcatccagacttgattgacttaaaattgagtatataagagtgtaaaagatggtaagtgataggcttgaggcagagacacaggcctgcagccagaactggaaaaaaacccacaagtatgaaaagtataggcaaaactataaagcagccaggcacggtagctcacacctgtaatcccagaactttgggaagcagagatggacaaatcacctgaggtcaggagtttgagaccagcctggccaacatggtgaaaccccatctctactaaaactacaaaaattagctgggcatggtggtgagtacctgtaatcccagctactcaggaggctgaggtagggagaattgcttgaacccgggaggcggaggttgcagtgagctgggacggtgccattgcactccagcctgggcgactgagcgagactccacctcaaaaacgaaaccgaaaaaactataaagcacagaaatatgggaccatttggtagatatagtaactgaaatcacatcaagttttaataaactaattagtattcataatggcagccctacatcttcaagaaaaatatacaataagcgagtttcaggatgctcaaaatatttaagatggccaagaagaaattatgcatgtagtacattttaggcagattttccttaaaactgactaaagacacttacttttttgaaacaagaaaagacttagttatttggataatttgcttatgtggaatatctcattgccagtcaatgttgaataagtgaggcatttattgtgtggcggaaaggtggttctttgggccagatgaagtaaggtgggaagaaaggaatatgaaatactgagagaaggaattactactttaaataatagatgtagctttggtatgtttttctgtgcaaatcttgagacaaagccctttttgttggaggaaatggcatgcaagggattttattttcagtttgaccatttgcaagtattagagctgtctccatgggagaaaggtgagttccctctggcagtgtggtttacgaaggtttgcttgggaggaaaagagaggagctagttgatccagagtggaaaaacaccaaagcaaagttttctccaaaataacacacacggatttctgaaaaacagcagttactttcactgaatgtgacaaacttcaaaaaaaaaaaaaaagggaaatcagctttgaaacatcatatgacacatctgttttggaaggttgctttgtcagatacagatgtatgttttacagtatgttactatgtaaagtttcgtcttgagcaagctcaatagatgtttttctgaacaggtatctcatttatcccagttttaaatttttgggggagagtttattaaacaataatagtacagtactttatcttatttttaggttaaatacaatttgattgaattatacccttctctcttagccttttattgaactgatatctctgcttagattttatcctttcagaaattgcttattgacccgacacagcaaaatccaaactttttgatatatgtcatggcatatatcatgccaagatcacaaactccatcacatgcttttagcaaataaatgccagtttgcttcttgctttcatacctacaataatgcaaattattggtttaaaaagttaaaaatcactgattcttgctttattacaggcctcttaaattgagaccttggaaaagtattttcttgcaagagctgatgtttcctattattattattattaatttattttttaagacaaggtctcactgtgtcacccagactggagtgcagtggcactatcttggctcattgcagtcttgacctccctgggctcaagggattctcccacctcagcctcctgagtagatgggactacaggtgtgcaccaccatgcctggctaattttttaatcttttgtagagatgaggtctcactctcttgcccaggctggtctcaaacttatgggctcaaacaatcctcccaccctggcctcccaaagtgctgggattacaggtgtgagccactgcacctgcctgtgatttgtttcctttttatgatatctatgtgagcatcatattttcttttcatcctgcctgctagaaagcgcagagctaggtttggcactcaaatgatgtagtttcctttagctaagtgctttgatgaagtttctcttttgcatttttttttccagaacacatctcatagttgaagagatggtaataattacagtaatacaataataaaaatgagttgatcctaagaacagtcttatggggcagatcctgttattatccccattgtatagataaagaaacagaggcagggaatggctaagtagctgccccaggttaaaaggctaaaatgtggcagcgctgggattaaacgtaggagactggctccatagtccttagagaattagcagcttgggagtttggttgtttggcacatgaattcatcactcaacaaatgtttatgaacacgtgccgcatgccaggcactgtgtcaagcactgggagagaggaagtaaaagaaacacagtccttgccctcatggagtttctggtaagtagaggacacacaaacatatgcccaaataaatgaagcaatagatttataaaagcttatatttgctataaaggagtaacaggtgtaacagtttaagggacctctgaattttatcaggtgcaatacaaaagtgtagttctgggccaggcacggtggctcatgcctgtaatctcagcactttgggaggccaaggcaggtggattgcttgagctcatgagtttgagaccagcctgggcaacatgacaaaaccccgtctctacaaaaaatataagacatgagctggtgtggtggcacacacctgtagtctcagctattcgggaggccgaggtgggaggatggcttgagcctggaaggtagaggttgcagtgagcccagatcgcaccatggtactccagcctgggcaacaaagccagaccttgtccccgtccacttacccccaaaaaactgtggttctgaaccacagcaactgagccgagcacaatccttctgtctctctaagacccagtctacactgagtagttctgttgatggcactgcttgatgggcctgtaactgccacaagctctggaaaaaccaggtccacagcttctcagagccttttagcttcactgtgaaaggagcaagagcacaccagtgaccaggtgttcataatttctctgcaaatgtcagctctcagtttccctcctaacagaagcacctgaagcagcaggctagctagcctgaagaggaaggaatagagtttagtcttataattgggacctatatattaagctgaataatttggcattcagtgttaagcatttgactcattcctgtaaccaattgtgagtgccctgattatgtataaactccttaaagtaaatgtgttttagttcgtggcccagtgtgtacacatggctgtaattaacaatattttgcacagccaaaccaaaagtttgcagattttccttttttaatccatggtctcctatctgcaatcaggaccagtggttataggcgatgattcaactccccagcagttgtggtttcccccttctgcccttcctgaccctcttacagtttctcatcttgccacttgtctctgcttcagactctgcaccccagaccctggccaccagccctaacagaatgctcaccaggcccagagcatgccacatgcaatgcatgttattcctccgtgcttttgcacacattcttacctctctttctcccatctttttctttcttgctagacaccagtttgcaaatgataaaaaagagaaaattagtgatcatcttaggtacaaatcaaggtctgagagatgaacagatttggtaatgtcatccctcagggttaatgaggtgtagctttgtagctctgcaagtcttactttgccatcagatattgcattagtaggaattaagttgtaatttttttatgggataaagttcagtttaatattttgaatctaagtcgataaagcatttgcattttaataaagaagtgtactatccttcagttattttgtatctgccaaattcatagggtaggagaaaaaagatcttattttctcccatccttcaaaccttcagatttgttcttggtctctgttctgagccaattaggcagtaacatcccataaattcttatcccctccaaaatgaatgctgtagccagtgtctccttctgtttaagcttccttcttgtgagaagaatagggacaggtgcaccatattattggtcaaaagtaaatcagtgctcggtgtggtgactcacttccagtactctgggaggctgaggcagaggcaggtggatcacctgaggccaagggtttgagaccagcctggccaacatggtgaaaccccatctctactaaaaatacaaaaattagccgggtgtggtggtgcatgcctgtaattccagctacttgggaggctgagggaggagaatcactcgaacccaggaggcggaatttgcagtgagttgagattgcgccactgtgctccagcctgggcgacagagtgagactgtgtctccaaaaacaaaacaaaacaaaataccaaacaaagtaaatcagaagaactgttggccaagatgatgccaactgattgtctttatggattgatggaattccctggaggcagaaacatggcctgttctcgcctttgggagttgtacttccagaatgtgctcagagaacaggaatttttactctaatactgtgcatagtttaatttaattaaaaaaatttttttaaagagatgggggtctggttattttgcccaggctggtcttgaactcctggcctcaagcactcctgctttggcctcccatagtgctgggattacaggcatgattacagggagtacatgcccagctgtagttttattttaagtctttccagtgcaattcatagaaataatttctggggagtaatgctagggagtagtataagaacatcttatcttagatattttattaatcattctaaaagtttttagagaaaacagtttttgattggagaaaatgttctcattcatttatttctcttcccctcaagggactttatgtctctaatagtatttgaagtttgtaaagcgttttcacatatagtgcatcatttgatctataagtcaagcctgtcatagaataagagatcatggaatgcttaaaacccagctcctgtatctcctggttcactatttcccggtgcttctgtaatacaaggacacctcttgctatgtccagtggtgacttctgagacatgccactgcttcacttcaggtcataaaaaccatgaaacataacagcaccacttcctcacagggctgcagaaatccccctctgttggcacgtccagattgtatagtggtatcttgtttagatggaagagtatgtgccttttatagcttggcacttcccaacactttgagaatttggattcctaaagaacctgtgccctttgtttccttttgaacatttgaaaacacaattgaatacaggaaattctccaacatggttgctccatgatttcaacacaacaatacacaaatatgcactggcttttggcccaaaaagttggtggttgacttcttggaagagggttagtttgttaggaggaaggtttggatgtagattttgcttggagggtgaaagaaaccatgataagatatgcctaagagttgtgctgtagaaaaatctagtttttttccccctgagaaatccaaattacaagttttaggacttgtctacctttttcctactagggataagcttcagcctgaagccaggttttattgttgaaaaacccaggtaggagctgtggtagaagcgccctctttggagtttaatggtggtacattccaccgctccatccccaaggcgctgtagttccaatgaattgtaatttgagatggtacaaacatgagcatatgttatgtacacgtcaggcgtgtttgtgagctcagggcattccaggtgtttttttcttggagctttgtttttgcgtcatatcctgtgttggtaacattccttctcatgaagctcgattgaagtgaggcagtgctattggctgagaaatcatcctgggtgccctttcttacagattcttgcatcccatgggggtagaaaggattttcagcccaagggcagaatagatcctgtagtacccagtcccacaatctgtgggagtttgtccctctttgcagctgacagcatttcagaattccctgtgggacaataacaaaaaccttattagccaatggtgtcattagaataaaatctccccactgcgatgtcttggtcccagcctataatgttaccccttaattccctctgcatctttaccacttttattacagctgaacacacgctcctcattagaaccctgggtgatatggggaatcagagtgctgaaaattatgtggaataggtaccagatgtttgtgtcaacttggtatgcattggtatttagaatgcttgaggatcacatttattaaatgtgaaaattacttactatgtcttctccaaaacattaccccccccgccagtatttttgtccatgttgcatgaggtgtgatattagtaatttcttttggcactgattaaatttaaagtctgtgcagcaaatgcatctgttcccaaatgctttgtctgcgttctgtcgagttttggagctggcccaccgccagcagggatgtgggggttctgtaactgagattggaatgctgtgttgcagctaaaggacataatgaaagggtgagtccatttgatttttttctttaagtggaactgggaatttagacattgatgttatagcgagatcttaggaacgtttcccatgtgtccagataagcaagcattagtgaaaaggatggaggagggcatttggtaaaatgagaaacgagtttcattaagttcatgaagtcttttaagtcaaccaaaggtgatacgtgtgaaccgagcagtttattttattttagtagatatgaatgaatgtttacatttggcctatgcatctgttcacccagtcctgaggcgaggaactggaaagtacaaggcagaggcaggtggtgctctgccaggggaaaagtctggagctggagtctcagagacccaggttcaaatcccctattgccacttcctgctgatgtgtttcttagcctctcatgagctccagtttcccatcactctaaaatgagggcattaacactgtcttcacagtggcattgtgagaatcagaaacatgtacaagatgtgtggcccctagtggtgtggtaaccatacatatgaagagttaacccccagcttctcacacaaggcagcggcccagggagccaccatgtgcttcacagtgtggcctcaggtggcccagctgctgagcacccgagcggtgggggcctgctttgtgaaggaggctggtttggcagtggccttggcagtgtggccgtggtctgggccacctggggagtttctcaccagagtttatttgaatttgtgctgtcttcaggtcagtaaatatttttgtcagtagaagtagcatcttgtgggtgaagggggctgtgcctctgtgctggtggccgaggagagtgtaccaaacagaagagcagagcctgacttcagttcaaacaagacacgacacccggcaagattttgagatcagatttctcgagtaagccagcaggggaggattaaactcagctcacactttgagtccaaggaaaagttagatttctttgggagctacccttaaggaatcttgtactcgtcacataccagatgcccagaatgaactgaaatatccagattgggaggcaccagtgaggattgtctctggaggtgaatccatatggacattactgccaggaagcacttttctgaaatacacattctacctctgtgtggctcacaacagtttacttatagtgggttatagagtttctgtgaggctttggatgaagtatctgcaacatgccttttcatgatagagtatggtgtgaagtgagcacgcgtgtgtgcttatgagcattgttgctttcaggtgtgttctttcgtcatcgtccacgccctggttgatccttacgtggtaacacagcttttgctgtgctgctgataaggagcatcatcagagcatgtcactcacttggctcttgactgcagggaagagattgcgtagggaagacgggatgtgggttttcagccgtggccacaggagacactcccagccttttgaggctgccggtgagggcctacagtagcagctccagagctcacaggtcaccacaaaagtgagcagatgagtcagatggggtttcggagcatgttttcctggtttccaagccttcgtggctgggaggtgctatactcgggccccatggtggtcaagtgagaatctgagccactgtgttaactcaggcacttgtgctagagcctgtggggtggatcatgctgttcccaggtggaagccttcctgaatggagctggccctggcattgtgcagacagattgcggaaggaaccactatgaggccaagggggaaggatgggagacaggttcatgagctggctgtggcagagggaaagggacaggaaggctagggcctgacccagaagtggcaggatgaggctggggctgtggtgtgccaacggagagatagaggattgtcctgccacctggagagaggggattggccagaagagtgtccgggaagagaagacaaaaacagatttgtgtttcctgctttctgtgacagttgaaggtggggaagccccaactgggacttgattcttagcaaccaaaaatgccacctccttcatttcatggttggtgttttttttttctgccccttttagtataagagtgaggctttggctctcaggtaaagagtgaaagcaggaagtctgagacagacagtcccttattggcacaaagcccatgcagcatgcatcaccccatggttcttccccatttctcagcgataattgagtgtctgttttgtgccagatactgtgctggggtgaggcaggcagcagcagacagagtggttgggttctgttctttcgtggtgtttgcagtctttgggagcatgtagatgtgaaaccaataattgcacaaataattatgtacatctcatcacaggaagtgctgtggagagaaacggagagtaccatgagagtatgaaaaaatacagatctaacacagtgagggaggtttggggagcttccttgagagatcagtagaatgagcaggagtttgtcaggccatggtggtgggaaggaacagaaacggtggggaatgtgttcctggaggaaaccttgctattcagaggctcctttgggacaaaggttggcacttctgatgaaataaaagaaggcaagtacattaattagggtaggttaagctacaaatgtcagaaaacccaaaataacattggcttatataaaaaaaagagtttacatttgtttcctattaaaaaaaaaaaagcagttcagagctgatcccgtggctccatgttcatcaagtacccaggtggcttctcagttgctgtgccctcctcagcatgctgcttctgtctcatggccccaaaggcttgctctagtgctgcctgttacatccacgttccaaccagcagtcagaaggaaatggcagaagaactgacctccttcccttcatacaggaagctgccagctgctagcgggattgggaaacatagctttcgttctgggtggctgtgtgtccagctggcacttgaagaaaggagaatgatggctatagggagacagtgagcacttctgtgcttcaccagaatggccaaaacacgggagcaagtgtccgaggaatgagagacggggccgtggcaggaagcagggccagatcttggagggccttgtaagtcacgttgaggttttggggcttcatctggacagcagagatggagtgataagtcttttaaagcagagaaaagcaggatcagacttgggtttttcagatcagtttggctgctctatagaagacattttggtggagataagaattaagagcatcttgcagtaatcagggaacgagagacgatggtgcccatggagatggagaggaggggtcagagttgagtggccagagagagaatccattgggtgaggagagggaaggggtgatgttggggcacctcccccaggttggtgccaggtgtacgtaggaagaggctggtgccatttacttagggagggaatgaaggaggaacaacaggcacgaggggtaaagatcctgagttctgcatgttgagattgggtgtccatgagacaaaagtagatggtgaaggagctgttgaatattcaggcctggagcttagaaaaagaagtatgggccaggcatggtggctcacgcctgtaatcccagcacttcaggaggccaacgcaggtggatcacatgaggccaggagttcgagaccagcctggccaatatgatgaaaccccatctctattgaaaatacaaaaattagctgggtgtgatggcgggcgcctgtaatcctagctacctgggaggctgaggcacgagaatcgcttgaacctggggagtggaggctgcagtgagctgagagcgcgtcactgccctctcgcctggacgacagagcgagactgtctcaaaaaaaaaaagaaaaagaaaaaaaaggagaaataagtaagtctgagatggcctggagtcatttctgtaaagagatgagagttgaacccatggatgtgtttgagaaaatctatggaaaaaggatagtgcactccaggaaggcctggcaggcattttacctggaaggcggcgatggaacagctggtggcagaagagcgtctctccaagatattcaaaggaaaacttcatacaatcacactgcctctttcctttcttggccagagaggcttgttttttacccaaaggaaaccctctcccctgattcctacactgtgtctgttctcttaggagaggactactctaccccatacttagagtttaacctacgtcctttagcctgggtgttttcacagggactttttgtcccctcccttaagtcttaatttttttcacttgtacattctgtaccccttgcaaacttatccagttatgtttttcaggataaaattcctagcgggaagttgctgggtcaaaggatgtgtaccttttgtggggccttggataccactgaaaaattataccaatttgctctctcagcagcagtgtgatgctggcacactttttgaggaaggtttcttaaggcatttctgggcttaattttttttataagcattgcctccctctcccaacttttctttaatgaaaagtttcaacatgtagagatgttgaaaccattgtacagggaacatttagattccacaattagcattttgcaatagttgctttatcaaatatctctccatctgtcaatccatcttattttttgggaggtatttcaaagtaagttacaaaacggtagatctcacccctaaatctatgaccacttttttattttcacagaaagtgttggcacagtagcccaggcattgggctggatgttcaccgtacaatgcttggtcaccctttccctctcctcacccagtggattctctccctggccacttaactctgtccccttctctccatctccacgggcaccatcatctctcttgccctgattactgcaaggccgggcacttcaggaccctgcctcctgagagagagagccgcaaggagggccaagtctgaagctttgggtgactggggcaaccttgaaacagttacttaagcacattgagcttactttgctttctttaaaatggggttagtgctgcttccttgcaatgtgtcagaaggatatgcagcacctagcattgcatagtgggcacttaataaatgggagcagtctctctctctctctctttttttttttttttttgagacagagttttgctcttgtcgcccaggctggagtgcaatggcgcgatcttggctcactgcaacctccgcctcccgggttcaagcgattcttctgcctcagcctcctgagtactaggattacaggtacacgccaccaagcccagctaatttttgtatttttagtagacacggggtttaccatgttggctaggctggtcttgaactcctgacctcaggtgatccacccgcttcggcctcccgaagtgctgggattaccggcatgagccaccgcactgggccgagcagtgtctcttattacgttgtatgctgaactgttaaagataccatttcttatatgaccctggggatggtggtagataattcctgattttttttttttgtctttttggtgtaaggatagtttaatcatatgttgtagctttttttctttttcaatcttggagggaaaaaaattctatgaggaacttcgaaaaccaaatactactctattgtgtcagatggtcaggaacacactgttgagtgtatttaaacgtcaagccaagtaagtctctgtatttttatttttattttctgagatagggtctcactctgtcacccaggctggagtacaatagtgtgatcacggcttactgcagcctggacttccctgggcttaggtgattctcccacctttgcctcccaagtagctgggactacaggtgtgcaccaccacaactgcttttatacacacacacacacacacacacacacatatatacacatatatatatatatatgcatgcatatatgtatatatatgcgtgagtgtgtgtgtgtgtgtgtgtgtatatatatatatattttttttttgtagagatggggtttcatcatattgcacaggttgcttttgtactcctgggctcaagcgatccacctgccttggccttccaaagtgttggtgttacaggcatgagccattgcacctggcctccagtgggtctctgtaaagagtcgctgtcctgtcacttcatcagggtgtgccccatgcattgctttctcttttctttgaccttggactgactcatataaccaacccgtggctagagctctagcccttaaagagggtgtttgccctgttctggactctggcaaaacagagagcatagactctaaggcaagaagtgcacatcttcagcactgaaggcttcctggcactagttccctccctctttgggagtaccttattatttgatttgtttccattgagtttttgcccctgccccagtgtggaggtgagcagtatggtgatttaaggaagatcttaatgggtgatggtggcatcatgcagaggagggcagatcaaatagattgcaggcctttttgcagatgtgttttcagcctgttcagagctttgcacacatacaagaatggaactgaaaggcatttttatttgtgcttaatttgtgataattgtaaattcatggcaggaggctctgcaaccagttcagaagggtttcccagtgtgggtagctgtagccagtgtgtgtccccagaattgagtaggagtaggataatttcttgaagctctgggtgtgaagtataccagacatcccactgcggctgggaaagccggaggccaggagggcaggatgagggcagcagagggagcacctgcccatatggtttccccgcaccccgccaggggctccagggaatttacagtcagtacctcctgttgttgctctcgggacatcttccttcaccaccttatgctttctcagaaagcagctggccacagtccagagagtggcagtgactatttgagaaggcacatacttcatttcagaccagatagctattatcagcctagataatttctgtaagtcctgaaatagacttggcccaccaggcagggtgtctgcttctgggtgcagactggctggttctgaactttgtttgcaaccctggagggtacctttattatttagaagtcaggaagaacaaactggagtacattcaggcctttttcgtgggttctatctgggaggttgtggtgtagtgggcactgtttcagcccagtttcctgggtgattgaatggagacaatagcaccaagctcacagaagtgtgtgaggagtaagcatccagttccttcttcccctgggtatgtctctatcaatccagccaatgtgaaaggaggctgcagtgatgtcagggctgtagcagcctatttcccttattccctacagccaaatccaagtccctggaatggtgccctactcactgatctgagagggggcaattttttttaagctcaatgattcatttatacatttaacaaacgttttttgagcatctcatatatgccaggcactgcagatgaatgctgaggatacaaagatgagtacccacagccctcagagaggtcacattcgaccaataaagatggatgtgtacaccagtggctatcatgtaaatgcagtagtggagacaggcagatggattgcgggagggcagagaaagagagccttcctcagcttgagatgtttgttgtgggggcggagtgagagtggaagaggaatttgggtaaaggaagcaggcttgaatgaggacatggagttgggaaacatcctggtgtgtctggagacctttaaataagttgacgtggagtggggagggatgagacataggaaggggctagatcaagaagggcctcctgtgctctgtggtggagctcaggctttatttggtagggcagctattctgaagggacaggaacttcccacagagatgccaacggcaggcatttgctttgggaacacccgtaacattgagtgcctctaggttaggtggacagtgcctgtgtggaaggtggcatgcagagcttgagtcctcagactccgttcaggaaggtttgtaattgtctagggttggtaaagaagtagagatggagaggagtggatggatttaggatttaaggcttgactgattagaggaagagggaatgaagaagcaggaaccaagtatgaccagcactctactttttctatttgaggctctgctcagatcctacttcttttgggaggatttttctgacctctggcccaaattttgctgtacagctctggccctgatcgcctctacatgttacatcttgctctgtattgttcttaagtttgttttgctttccctaataaagggaagctctgaaaagataggatctgtatcttatacttttgttaagtgcaattttaggtatttaatattatttatgtatagtattattgggactttaagcaatttattttatctctgattttctaccaagagggaagaaggaattaaacacaaatgttaaatgggaagtgtcttctacccagaggaatgcattcatgacttgtgagtccaaaagggaatttaaaaaatcaaatacataccaaattatccaaaagaaatttaagagattgggattttagaagataggctagctttttggccacttagtcttggaacagtttacctggaaaggcatctctggtgggttggcagtggtttgatcacccttgcccctttggggcagaattaattgctgtttctgagtggcttgtgtttgtgattcccttggcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtaggtgcaggtgtcagctctcagcccactgccactgagtctgcagagatgattttctggacagaagtccttttcttctcttctggggttcaacaaaagaagctcatgtatgaacataagagaacagatttaaaataccagctgctgtctggattgggcaactttaggatttctctgtctagagattggttggctctccccatttcctggccctccgtattggaaaaaaacgttcataagaatttcaacttttaggccaggcatggtgatggtgcacacctgtaatctcagcactttgagaggccaaggtgggaggatcgcatgagctcaggagttcaagaccagcctgggaaacatagcaagacctcatctctactaaaaataaaactaaaaaaaaaaaaaattagcagggtgtggtagttagcacatgtagtcccagctacttgggaggctgaagcaagaggattgcttgagcctgggaaatcgaggctggagtgagccgtgattgccattgcactccagcctgggagatagagcagaaccctgtttcaaaaataataataataatttcatcttttaaacatgattgtgagaaaccaaataaggtaccgttttctctgttgttgtgaaatgtctttcccatttcctcctgtgtcctctgtcttctttctttactttgtcatatgaacttattgcttctgcaggatgagtgaggggaaatgggaacactctggaataaagatggcggtactttgtacttgcctgaaaatccctgagcatagctccttatcactatctaggcagcttcccaaaggtggcggtgacattagcggagatggtgatgataaagatatatgctcatagttactcagcatttactctgccaaacactgttcgaagcactcatacagtaactccatgaatcctacaattatactcattttacaggtgacaaaacaggtgcagaaaacttatttgcgcaaggtcatcatcttcagagagaaatggcgtcctctttcctgtggctcaaaaatggcctagattgtgggtgaatggtcatcatttaagagtacagatttcccaacaagataacacagagtattctgtttttaagcttctgtgtgtcagaaatgttatcactcaggtattcgctctccagggagagagaaaccacaaaaaatcctgatcatagtgaagtataggaaaagtaatgcagaatggaatttatctttgagctttcttctggtcaagaaagttaatttccagagccacttgtttatgtgcctcagccaccccatccttttggggtggtaggaagaggagaagcacgagatgttaaggaaaagcaagctgattttaatctcatgaacgtgtgcagagttggctcatttcaaagacagatcatctaacctttccagcaacattggaaattattgttaatactcttggttgcttgccattgttgctgcaactcatatttcaggtcagatttctttatcccagtaatgtgcctttaattctgaactgatgggggagagtttgtggtgagagggaaaggaggagaggaggaaatgcagctcctatgaagcgttgctgactccagcaattctttagcagcgacaattactcattttatatatgcttctctcagaggaactcagagggaaaagaaagtccaagctgttacagaagcagcaacagcagaaaattcttgacgttaaattgtgcagtactgttgttgactctgaaaacaaattcgagtaagactactgaaacaagagaaaaatacctcgaggagtgacagcagagctctcctgcacttggttactatgttattcaaaatgggattcattttaggacctggcagtactgaggatacataacattagctggcatcagggacatagtgtgttcagtgaggaagaaaagaaagagggcctacaaagggtagtctcaaacttgtttaaaaacctgaacattattctctttcgatattagtatagtatatgtatgattttgggccagtgatttgaagatgtttctgagaatagacaacagacggacctttaagaattagatggttgtagttcaatactgtttgaaaacaagattttgggataactgatttttggagattccatctggctctgcgttgctcacatacggcagatctcagagtagtttgcatatacaaagtgagcatagaggataacatcagaatgagggtcaggacgagagaatgaaagattgtttgtggttggtaagatgggtgtgtataaggattaaatatcgctcactcttttgacatatgactatggagaacattcccgcagctatgcaaacagtttttaaaaatcatttgaaccacatgacccagcaattccactcttaggtatatacccgagagaagtgaaaacacatgtccacacaaagacttgtctgtgactgttcatggcagcattagtccaaaagtggaaaaacccaaattttcatcttctgatgaatgggtaaataaaatatggtatatccatacaatggagtgttactgagcagtaaaaaggatggcatactgataggtgctacagcatggatgaaccttgaaaatccactaaatgaaaaaagacagacacaaagaccacatatcatatgattccatgtatgtgaaatgttcaggatacagaaatttatagagacaaagtaaattagtcattgcttagggctagaggggaaagaaggaaatggaggttgactgctaaacgttacatgtttttttaaaaaagtggaggccgggcgaggtggctcacacctgtaatcccaacactttgggaggccgaggcaggtggatcacctgaggtcaggagtttgagactagcctagccaacatggtgaaaccccttctctactaaaaatacaaaaattagctggcatggtggcgggtgcctgtagtcgtagctacttgggaggctgaggcaggagaatgacttgaacccaggaggtggaggttgcagtgagccaagattgcgctgctgcactccagcctgagcaacagagtgagactccatctcaacaacaaaaaaaaaaggtggaggagatgacaaaaatgttctaaaattttaatggttgcacaattctgtgaatatactaaaaactgttgaattgtaatttaagtgggtgaattttatggtatgggaattgtatctcaatgaaactatttaaaaaaaccgtttgacctgctgacatgctaattagtctataaagtttacgttggctcaattcacttttaccaagattgcttactccttcaacttaaactcacctaatgctttttgttattttcaatggataacttggtttttgtagatatgtcatgatatggtctatgctaaaaataacagctgatctgttttgagggtaatagtaggagggccagaggcagcctttgtgcagtctctaccaattttttttttttttttttttttttgagacagagtcttgctgtgtcacccaggctggagcacagttgtgtgatcttggctcactgcaacctccacctcccgggttcaagcaattctcatgcctcagccacctgagtagctgggattacaggcatatgccaccgtgcccggctaattttttatatttttagtagaaatggagtttcatcatgttggccagtctggtctcaaactcctggcctcaagtgatccgtccgcctcagactcccagagtgctgggattacaggtgtgagccacctcacctggcctctaccaaatattaaaggcaaatatttttcaaaatgaaataagtgccgttacttacaaattagcaaaacaattaccgtgctggctccaagctgtaattgactatgactgaagactggagtagttggttttcatgatgtcatccttaaatgtgagggaattactaaatcagccccatttccccttggcttgttattggtgcaagatcagtatcaagatctattataaatcaccccatatctaatattttactattaataaattcctacctcccaggtgccttaaagttcttcagctggggagagatttttaattttcctgtgtagaggcggtgacagagcctacacccaaaagtagtaactgcagcaggttgacaagatttagggagacagtaacgcttaagttggatgaacagttttataggccagcagagaatttgtatcagaaacacacttgttacaacagtacataaaaagccctcagtaccaaagcaatgttttgtcatcggcctccctgctgggttctcctcgggtcagagtagacctattgtatttttcatctgagaacacacctctcatttgtaatcattggtttcggaaacaacagccttggaagcgaacaggaaactggaaaatgactttctggcaacagaggacagcagaagagcataaacaatgctgagagatcagatttatcttttagagcaagtgaggaccagtgtcatggtttccatccccatgaaaaccagctcctagtaccctctgactttgaagtaaaatgcagccgcccccttgtgtcggactcccgagtttaattgctcagggcgtttcctgattcctgagaggggttacagcaccattagaggcttgtttacagtaacatactttcattagttgctggaatggcaacaattttgtttcctatcatctaatttttacttgtgacctgcttttatgtggtggtgtgtcttttctatttctgacctatctaattgcttgcttattatgaaaagctgctgaggataagtcccaagttagccattacatatgtgtagaaaagatatggacatttaaatttatgcatttgttttgacattaaaggagcaatgggcgtgccagtgcctggctgtaggggtggagtggggatcaggaggctccattaccatgggaaaggggccaggtttaataacttcacccgtcaaaaagctcataaccctatgagcttctctgcctcattccaaaagaggatttgggatgagcctccagcaacaggcataccaacagtgtaagcagaaatacagaatgaggaccaagggaaaaagaagggtgcagcttgcgagccatttgggtttatgtggttggtatgattgtgtttgaaatttggctccaggctttttggcaggcacagacaaatgggatgtgtggttaatcacacatgtggctccaagtcacttttactttgtaccttctctgaggattggcataaagctgtcccttttttggttctttttgagggcaggaaagaccacagtggggagaaagagaaggaagtaaacactgtcaagtgctaactgctcgacttgcctcttaacagctctcacatcccccaaatgacaatactagcagccgtagtggtgaagactgcgtgtctcctgtgggccagccacctgccaggcacttgtttggttctgccagtcttgtcgtcagcctgaaagggaggcttggtggtcactgtttttgcagaagaggatgcttgggcttagggaggttatacaaccagatggtgagttgtggagccagcccccgagttgtgtctgttggattctacagtgcaagctgcaagcttttcccatactccagctagttgtcctttccttttagctcttacttggttctgggctacagaacctgctagtctgctgagtctgctttgttagacagccagcaagtaggtctgttagtgagggtttgggttctgtgcataggtttgtaataactctttgcagtgcttggagtcctttttgattcccttccttgcagctttggggcagtattaagttggtctgtgtgtggcagtgtctctttttttccctttcatggtttaggattatcacaccacatgtcagtaattataaaatgcagggctgagctcaggagccattgtgctctatgtggctgctaatccccatgctaaatggcaccaccaaggggccttttatgttcttgtctgttttcatagttaaacattccccccacccccaggccttcagctgtgttcacacaaatagctcacctgtcctctgcttataatttactacgtcttgtatccaaacttgttttaactgtgtggtaagagagaactagcatattaactgactcttcttgctaagaatgatatgcaagagcttcagtattcagacttcgccatctgatttgacatctttttgcttacattgaggaatttggcaattcaaagattgaccattttggagatctttatctacctacctacctatctatatgtaatccttccccatttccacaatattaatacacgaacaccttttctctttttccccctcgattatcgagattcagataatacagtgcttggggaggagtgggtgtgccttgcccaacaccactaaaagaactgatacaaaatctcaaggctgggttttgggagagtacatatgtgagagcaaaaacattaaactagctacattcttttctctatctggggcattttttaccctgctgctattcataaatgacttcctaatgcagtcctgtgcatatgcagaaaaaacaaaaaacccagggctatttatgtttgagataccttttatgtggtatgtactaagcaagtgtcaaaggaaacccctcacacacagacactgtatatcagtgaaatttggtttctaaacaaatacattccgcatataagcactgcctggtgtttgtttaaaaggaagctgttctggaaatcacccagcttgacagggaagattacctctgaaatggtcatttagttttccaccagtccttaacagatactgtcatgcattgcttcatgacagagacacattcagagaaatgtgttgttaggggattgtgttgtgcaaacatcatagtgtaggtacacaaacctagatggtatgtcctactacgcacctcggccatatggtatatatagcccatggctactaggctacaaatgtgcacagcatgttactatgctgaatattgtaggcaattgtaacacaatggtaagaatttgtgtacctaaacatgcctaaatgtcaaaaaggtacaggaaaattatggtactataatcttatgagaccaccgttgtatatgtggtcccttgttgattgaaacattgttatgtggcccatgcctgtactatttctctctctctctcttttttctctgtctctccccacctgcccatttcctctctcctttcttcccttccccatttatttgagtattactatagaaatcatttcattacctacaaaggcaactgaatctgtctgtccacataggattggagggcctgaatgaataggacactcatattatataaaaagagttactcctttacttgaagacactcaatgcaatttaaacaatgacaccctgctaggtcgtgtgaaggtgccagtccaggcctggaaaggggagcagggttagggacagcaaggcaatgcatctgctagctgtcacaacagaggacaatgcaagcgagagctggcactggtcacactagtcaaggatgatgtctaacactttggggcaagatgttcaatctaaaattccagctaactctccaataggaactctccaaaaatgcagtcttggacttttagaaaaagtgaaagcagaaatcagagaggtaatagcaaacaccggggtttaggaaacaaaccaggacacaaggctaagctaagaagttaaaacgttcctaccaagatgcaggttggtcacgtcacttaaatcctgtcattcgtcacagtaatatccagatgctgtaaagttgccccaggaaagtacagcccctgccccggcagagggactgagcctggttggactcggcctttttagaatgaggtaatgccgatttatgttctatgctggctggacagattgtaaaaacctgtcattattgcctcttcccccagatagagactgccttgacaccccctttttttttcgagacgagtctcactctgtcgcctaggctggagtgcagtggcacgatcttggctcactgcaacctccgcctcttgggttcaagagattctcctgccttagcctcctgagtagctgggactacaggcatacgccaccatgcccagctaatttttgtatttttagtagagttttagtagagacggggtttcaccatgttggccaggatggcctcgatctcttgaccttgtgatccgtcagcctcggcttcccaaagtgctgggattacaggcgtgagccaccgtgcccagctgaccccttttaaaatttgtccagcagcagcattttccaaccagtatggtgttttgtctttatggaggttagggttagaaccctgacctgtactactgttgccatggtaactgcccttggctttaaaaaaagaattatataatttcctgaaagtgttgttagacaatgtttttacaagagcactctctgcatttaaaaatgtgacattttgctcttagaacttttgggagagtattaaaaaaaagcaatagacccaagtcaggagcagctctgcaaatctgagatgcagatgtgctgattgggcaaaggcccagtgcatgcgtgtgcagcgtctccagttttccagcttgagccttctccttgccattgcttatctgcttcttgacattctgtttgagagtaaaaggaaacttaactgctaatcgctgatttaaatacttaaactctgcagaagtatttattgcattgacttcaatcactccttccacggtattttctaaatatttctgtgtaagtttagacacgtttaattatttcacttttctttcttccacgatgaagaggccatgtatgacttggcccctctgatgcctcaggtcagcttatttctcttttccttcccctgctccactggaatgagtgaacatctgtacgtccttctttcccttcttccctctctgtggcctgagctaatctctggggagaccctgatgatgcccctttgaacaactcaagggctgctaggactagagggtccctggggtccacctagccctaataccttaggggaaccaggccagagggtgtagcggtgacatgttcactattaaccaagaacttggtgctagcactggactagcccctcggggcaccaacttctgttgcagagctgcctctacacatctgcctgccccactcttgctcctccccagcttatgaagcctccagtgctgtcaagcactccctttctggcacctccctcttggtttcctggttctcattctaccattccatctgtttttctgtttctttctcagctgctcactctttcttcttggggtttttttttttttccccgtgagacagggtctggctctgtcgcccaggctggagtatagtggtgcgatctcagcttactgcaacctcaagcgattctcccatctcagcctcttgagtagctgggactataggcgcacaccaccacgcccggctaatttttgtatttttttcaccatgttggtctcaaactcctgagctcaagtgatccactcgccttggactcccaaagtgctgagcttacaggcgtgagccagtgtgcctaacctcgggggttcttgactgaggcatagcccttggctttctgttttcctctgtctcctctccctgaggtggcttgtctggtcttaggattttgcttgtcacttccttgcttacaactccaaaaactctgcctgggcttctccagtggaactacagtcagatggctgaagcatcccggctcttgggtcccatcttgagctgccaggtgcctcagatatggactggaggagtggctgtcactgtggttcgctcccatgttagatacagggctagtctcagctctgccactccccatgtgtgaccctgggtgagttacttaattccctaagccctgtttcctcatctgtaaaatggagatgttaatagcacttttttttttttaattattactttttgtgagatggcgtctcgctctgtcaccaggctggagtgcagtggcgtgacctcggctcactgcaacctccgcctcctgggttcaagcgattctcttgcctcagcctcctgagtagctgggaccataggcatgtgccaccacgcccagctaatttttgtatttttagtagagacggagtttcaccatgttggccaggatggtctcaatctcttgacctcgtgatctgcctgtctcagcctcccaaagtgcggggattataggcgtgagccactgtgcccagctagtagcacttctttagagggttcactgaccattgagaaatgtctctgtggcacttagggccggtataggtacagtcaactgctagctaacagtaatttttattctctctaaaatagaatttaagaaccctcccaggccagttctcctgaccctagtgctggcttttcaatctggcttccctgacccatcaatgtcaccagtaccatccatcttggaacttttgaaccatcttgtatttactcatcctctttttttttgtctttttttttggagacacagtcttgctctgtcacccaggctggagtgcattggcgcgatcttggttgactgcaacctccgcctcccgagttcaagcaattctcctgcctcagcctcccaggtagctgggattacaggcacccgccactacacctggctaatttttgtatttttagtagagatggggtttcaccatgttggccaggctggtcttgaactcctggcctcaagtgatccatccatctcagcctcccaaagtgctgggattagaggtgtgagccaccacacctggcctgcccattctctttaaaccctatatttggccaatcaccacattttattgacatttcctctgcaattgcccttgaatttctctgtttttctccacttaccctggagcctccttaactggtctcctgggactggcctcttcagctttagaccctgattctttctgtctagcttgtgaacctcttcataaaaccaaacttctctaaataatgctctcataatgaatttgtttattcattcacaggcctgttcaatgaatcactattaagaacccactgtgtgctaggtaggtgctctgccagattcttactcatttttatgtctttagcacctattagagttgagagagaatgaatttaatgaaacatgacaaataatatgactaatatattttaaaaatttgcagaaggccagctgtggtggctcacgcctgtaatctcagcactttgggaggctgaggcgggcagatcgcttgagcttaggagttcaagaccagcctgggcaatatggcaaaaccctgtttctatcaaaaatacaaacagccaggcatagtagtgtgcacctgtggtcccagctatttgggaggctgaggcaggaggatcacttgagcccgaaggttgaggctgcagtgaaccacgatcgcgccactgcactccaacctgggagacagagcgagacgctgtctaaaaaaaaaaaaaaaaaagtacagaagcccaacaaagggtgtgttcattctctctggaagtgagggaaggattcccagaagaaagaacatttgacggagggcttaaaagtcaaattagtgttgttgagccaagggatgggaggactcaatatacacagagtgggcgccaggtgtggaggaaagttcttcacctacacggtgtggctggtggacagatcaagggtgctaggcaggactgaattctgcctgctgcctgtttgtgtttttaaaatagctttaatgagatataatttacgtaccataaagtttacctgtttaaagtgtacaagtcagtggtttttagtatatttatagaaatgtgcaaccagtggcccataatctaattttacaacatttccatcaccctaagaagaaaccttgtatctattaacagtcactctcccattccctgtgtgtgccccccacgacccggcactagcccaaggtagccactaatctactttctagatttatctgttctgcacattcatatgaatgggatcatgcaatatgtatcttttgtgtctagcttctttcacttagcgtaaagcacttgaggttcctcgatgttgtagcatgtatcagttgtttcattcctttttattcctgggtagttttcattgtgtggctataccatgttttgttaatgcattcatcagtccgatgcctgtttttaaagttttattagttttaaagccacacccatttgataatatgttgtctatggctgccttctcactactgtggcagagttgagtattgtgtcagagacctgcatggcctgcaaagctttaaatagttactattcagccctttgcaggaagagcttggcaattcctgtaatagaggatgaagacaatgaagggggtaggctggggctgagtggaagatgagactggaaaggccacgtaaggatttggacttaatcctgtggatcggcttctcaaagtgtgtgtgctgtgtgaagcccctgcatcggatcccttgatgtatagattcctgagcctccccctgggcttaccagctaaaccccttgccccacgcccttattcttaattccacctggacttctttcttcagtctctcaattcttgccactttggaagcccatgcttaggtcttagctcttcaccaaacccttgcctgattgctttaccctcctccatttctttcttttctaaacatcgctctgaatcttcttccccctaccacaacctgtgccttcccacagtatggaattatatgttttattgtattacttgctgctgaatcgtgtgtgttaattctgcacactcagctggtgagtggactgctttcgggcaggaactaggtcttgggtctttttttgcattatgcaaattgggttattgcatggcaccaaggatgttatttagagtataactgaaagtcttcttaaatgactttccttttgcatagtgcatctttatttgctttgcattctattagtggacttagtgtttggtccctaggcccctcaacattggagctaagcaggtgtcctccattttgtatgactgctttgatttacttttttaattaaatctcttttaattaatcttattttttactctaaactgcagatctttgttcagtcttttccctagcccatttctaaatctttgttacattcttctttactctgaggggttttagtcatctgctagtaaactagttagtcctttccgtcagctgggtaaaaagctataaatggttttcaactctatgcagctcccttgggttgctcatttgatctgagccaggtttgaagttgggccattgagaatgatctgtcctcatgatgtagggggtgactccagccaattcttaatattgctggaattaattaactttgattcctctaactgaaagagggcattttactctaccgtgtattattaaataccttataacttgatttttttgattttgttttcttgctcagtgagtacttaaaatatccctgccgatatagtaatttgttccctgtttaatatggctttttcctttgtttactctggactcaagtctttgtagcttgttttctaagtcagctcaaaagttgctggtcattggatttggcagccttttcaagctttacccaccagaatcctacaggaagttgtgtgtcggccagaagagtctgtttatttagagcgtggtgtccagcagaagcaatccatttatgagggtctggtcttaaagacacaggcatctgagtctgtgtttggaagacctgctgctttggcttccattgcagccatgttctccatgctttcctgtccagcccgccggggcacctcagtggcactgctggctgattgaaggagtccttgtctctgagctccttggccttgtctgaaaggctgaaatatcaaggcccagatattagacagggttctagtccaaagcaccctacaataatgctttgtatttatggctttttttttcacctgaaccacagagtccttcagctgaacctgaaatttgtacaactcttggaggatgaggggcaaattacaggtatgacttggatacttttgaagataagagagctaatgagatgaggtgttactgattctcactgtgaagcaaggacagagcccagctttaggatccaaggtcactaccatagcctaactcttgcccggagctgaagtgtccccttgtgcccattatggcttaacttctatttgttgatacatgtgtacacacatctgatccattttgaatttgctccagcaagtcggtgatgtggctgtcggttctctgtgcctagcactgggcttgccacaggttagggactgcatgcctgtggacccgtttacgtggaagctgcatcgatgtcttcttaaaaggtgagtccccctcccagagtgaggtgtggcctcactaccagtgatgtgagcacataccgaggtgccttgggggagaggggcagagaggtatagcaactgctgagaggcctgagcaacaaaaggtcgaaagtgagctgtcgtacctctcagccctcgccatgcccctggggtcttttaatgacctacagttggattttttcatgaggtggaagttatattgaaatttctgcctcagaatagttcctgaagagcattgactctctgggagtcttaggtaaatttaacacttaatgaaggtaaaaacaatcctttccacattcctctgctcctcctctcaacctcaggtcagtcgatgtgcaagcagtgctttccttgggaggcagcagtttctgaaggtaaaggagaaagccctggtccaagggagccaaaggtccgttgggacacacatgattccgtgttgggcacatgggcatgtaggtgtctcctagccttgccaagctgtcttaaattcgggcatcttccaaaatcaaaggcaactgaagagcttaatttccaatgatgatacattttgcctcagtcatctggccccaaaagacttctgggggccgatcaccctcccttctattctgaacgccctcatcccctagattgtcacttggtgcttttggccagggggctctgcttcttccttgctgcgagttcttcctgctgagcccagcatccccgtgagggctttcacgcaggcccttcattgctctcggtatgttgtcagcccatgtgttgcagtttatttttgattcctgctttcataaggtttgaagattccactcatttttccagtggttgttaagatagtgagaatctaaatgaaatggtaatattaccattgtgaacaattatttttctaaaagaatcttttgtgttcatttttaatgctgttaagatctaattcccagtattttatttggaagctcttcaaatttcccaaatcataaaatctttcaaagcctactccaagttactttttcttgattcagctctcctatttgcatttaaaataaaaaggccagcctatttccaaatatggaaatgatctatgtttattagagatcagcaaagtgatatgggcccttgacttgctgtgaggttttttttttaaatgtgttttagagcaatgtacaagggcaatttttcgtcctgttttgtcatgtgttcttaaatacatttcctaaacactttctctggcttggtgctattactgtgtatacgtcctacatatgtttcctattttttatgactcatacttacggtactcataaagatttatcctttatcttggctctgagtaatgagcccacttgcacatttccagcagaactgtgggttagggattttacatttcattctgctggagaggcctctggaaggcatagcacaggcagcgcagcatgttccttgtaggcagtactcacttctccctgagggaacagttagctcagtttttgtgaatttactaatttttgttctctagcttttcctttccctttgccctttttagccattttgctgtttgagtgaggccacacaagagcatgaacagatgaaacaaatgctctactcctttttgctgctgagtaactgtggtggaggaagaaatggaaataatgaactgaaacgatattattacatgtggcaacaaactcaggcaaggagtcttcttgggtccaaataaacattcagacccatgagactatcataggccatgggtggctccattatacttaaaagggtataggacaaggaccacagcttacggcatggcagcaaggcattcctccttgttgtgtgccttgtgactgttcacacatcagttcatcagttcacatagccatccagagctctccagctgatggctcaaatgccaggagatgagatctctgtgtgtgtgtgtgtgtgtgtgtgtgtgtgtgtgtgtgtgtgtgtgtgtagttctctagtttaaaagccttaggaaggccgggtgcagtggctcacacctgtaatcccagcactttgggaggctgaggcgggtgggttacctgaggtcaggagttcgagaccagcctaaccaaaatggtgaaacccgtctctactaaaaatacaaaattagccaggcatggtgacgcatgcctgtattctcagctacttgggaggctgaggcaggagaatcgcttgagcccgggaggcagaggttgcagtgagccaatatcatgccattgcactccagcctgggcaacaagagtgaaactccatgtcagaaaaaaaaaaaaaaaaaaaaaaagccttagacccttgcgggaactagtaggcaactatgtaggaatagttttcatggtactctgtctcataaatatgccccatttacaagaatcactgctctcagggaagcccccagatgtcacttcttatcagatgtcttaaaattttccagtcccaatagcaagctgccttgtgttataattgacatattgtcttaccagattaccagggttacagaattgagagagttaacagaagatcaaattctcatgtaaaagggaaaagctttgctcactgtttatccacacctgtacgttttattgtttttatttgtggtattcctgactgtgataggctaaataatggcccccaaagatatatccacgttctaacccctaaacctgggaatgttgcctttatatagaaaaagccttagcaggtgtgattaaattaagaattgtgagatggaggattatcctggattatctggtggcccctaaatacagtcacatgtatccttataagacagggatttgatgacacagacaaaagggaagactgtgtgaccatgcaggcagagattggtggtctggaacccacaagccaaagaatgccagcagccacgagaacctgaaagaggctgggaacaggttctctcctggagcctctggagggcatgtggctctgctgacaccttggttttggcctagcaatgctgattttggacttctggcctccagaactgtgagagaatagccttctgttgttctaagccacccagtttatggtaatttgttacagcagtatgggaaatgagcacacactcacattagtttgagttccatgctccctcctgtctccagtttgtttactcctgtgttccccagctctgtaaaggacgctaccacacagttgccagggccacagtccttggcattattatccatgacttcctgtgtttgctcagatgtcatatccaatcctatttgttctaccctaagaccatattctgaatctgcccacttctgaccaccaccttcggtctgacccaccatcacatttttacttgagaggcagtgggcctctggcccatccctcttaggagtgcaagatctggggtagagcgccagtgttggaagcctggctacactgctcatgagctgtggggctttgggcaagtcagttaacttctttatgcttcattttcctcatgtgggcataatcatagtatctacttcatagagttgctgtgacgattaaataattaaagcatgactggtgcttagaacagtgcgtggaatatcatcagcactccataaatgtcagctgctatcattgttagcaattaagatctattctctaagtggcagccagcatgatcttttgaaagacttccgtccagtcacgaagttcaccagttcagcttcctgccatggttttttacatttcaatgaaaatgcgcaatccccaccagagccctgaatgatcttttcccccttctcccagcactctcaccattgctcactgtgctgcagtgggccctgacatcttgcctcctgtccttggcatgggctctttgttttgcctgaagtacttctcccagttactcatgtggctgccttcacccagtccctgctttgccattacctccactgagaggccttcattgaccaccccatttaaaatagtcatagcaccccacaacagacacactctcttttactgttttactttaaaatgtaacttatattaccacctgatatttatttttaaatatgttcactgtctatctcttctgctagtatatcatcagtatagatgttttatctttagttggtattgccaggaattagaacagtgcccactacatagtaagcagtcaagaaacatttgtgaaataaacatttgcatgaataaataagtatgttgatgtagcagtttagcaaataggttaagtctagaaattctatatatggaagtttctcattaattatattttttgaagatctagttattgatattggtatgtatggcttgggcataaagtaatgtttcttaaaccaaggcttcaaggtatagaagacagcactggattgtgagtcttaataaaagacttccctcttttttggtcttccctctgttgtgatcttttttgtttaaacttgagggcaaatgtgtagacccatttggatctcagtttctttttttattttctgtcaatataaagacattgagaaaattaatatttcaaaataccaattgagaattagagtcaaaagcatttctggagttgttaaactacaaaatatccttaaagaaaccctcagcattcagtgaataaggaaccacctaagagctgaaatgtaaactaagggtgtctcatgtcttcttatgtgtgttttttttttttttttaacctagattaagtaggatttacagatctgggggcagatctggtctctgaatacttgggaaaatgcttttgagtttcattgcttatatcttactgccttgcacagtaaaaatttcatgattttccaaagagctctactgtttcgtcaggacagagtacatgtgaatctttccctgtctttcttttatttattgaaatgcagaagattagaagaactaattatttcagtttgttgagtggaggcctctctccacataaattagaaccaggcagttggacagtcagctgcagctgcctttgtgaactgggcaccggtgcaaagcattgcaggagtgaggagacaggcagccctcggagctcacggtcaccgtgcatccagggacaaagagcaacacctgtaacagaaagtacggagacgtagaaacatctcatcgccctaaatacacgagatagaaacttaaccaaatagatgtaatcaactacagctgggctgagataaacacgttaagtgctaagtaatcaggcatgttagggggatgtggggctggggctagggctggggctagagctggggttggggctggggctgggggaaggcattgctggaataattggagccaggtgtgcttgcctggtgctgctttttggaggtgagaaattggaaaggtttgaaatggggatgtggtttggcagagggctgaaaggagaattttccaagactaggggaggagactggtaaataaaatagagccgagttgagtatgaaatatgttgaggacagcaagtaccttggcagctgtgaaagcttcatctgatggttttgcctgttggtgttgatgctgggagaatggtcttcagctgaacaccacaggtcttcaaagccaggtgaattgtgacagcctgtgacactggaaggggcagtgtagacaggcctctgaagataaatgtttgtccccagatttccccactacagattgggagaaacctctagctttacctcacaatccagtgatgtcagctgccttggaagcagttccttgctttggcacttcctatgttcctatttttttggaaggtacctgccagggaggaaaggcagcgagcacaggtgattgagtttttgttcagagatttggggtaacctcagagtagatgtggtgttggggtcaggtgtggaatgaatgtggtcttcccaggacctttgtttgttagattcagaagtctccagaactacggtgagatttggggagcaaaacctgagcttgtccaggttagtggtgcctgaacaggaacaactagcaaagatgttgatgtttgtgctacctttcggccctcgtctttaatgagctccaaatcccaaaggtgaaggaaaagcagacaaatgacagaacaaccattagttcctcatgaggaagccaagtgtttggagggtcatgtatgcagctgccaccaatttgtcaccctgcttgaaaatccagggacctgtaggcaggaggtaatggcactacactgatcagagccaaagtcaaacgctggtaggcttctttccagagaattacaaaacctggcattttatttgtttttttcaacacccctggaagggagattctgttagctctgttttacaggtgtggaaattgaggctaagagaggttaagtattctacccaaggtcatgagctgggaaataattggtagaacctaaccttgaattcacaacacacttcctatagatggagttgacatgcactctgagtggctctgggcaaggtgggctttcccaaggcttaggcatttattcaataatgaaatcattatttattaagcacctgtttgtaatgtgtcaggcacagtgccaggcactggcagtcctgaccccctacccttgagaatttgccaaaggtaacaaaaacacagtggatagtgagttctcccttgctcccgctcccatttagatgatctcaagctctttactttgcttaaatgtgggcttagatgttgcacccagtgttgcgtgttgacttaatcatatgcaggtaagtctttgagctgcaatgaaacagccatcaggtaagagttaaatgtgaatagctgggctgtcatctataggtgaagagcttagaaagaggggcaggttagggcaccctgttattaacatcagctctgttctatacaaacaattctcttactggattacctgtgccaaaatattgctgaatagcttggaaacaggttagtattttgccctttagcaaaacagacaaaagaaagaccatggagttgaatttggaaaggaatcttggaaaatgaatgtttcagtacaacaatgtatcattcacatgcccagaaattcagcactgcagggctcctgctggcagaatcaggtgaactctgggatgcattctgatttggtcttgaattcttgcatgtcttgagtaggttgaaagttggttatttttgttttgctggcagtggcctttacttagaagtgcccaggagatattcttgggatagatgccaacaggctttgtgtcttttcccttcaattttataaaaatgtaaatgaaaggatttcccagcaccaagttgtggagctacctgggtattcaagtgacaggaagagttggttgttagggtggttaggaagggcttcttagaggaagcgtgcttgaactgagacctgaacggtgaaaaggcgtgaactatgccgagatctgggtgaagaagaggccaaataaagggcccaggccctcagcttggaagcagcttgttggagatgagagaggggccagtatggctggagtggagttagcaagggggagagtggtgggaggtgcgattggtcattgagggttggatcacgtggggccctgcggagtaagaagttgtttcttggcatttctttacatttctgtgttcttatctagtgattaaaagagctgaccctaaattctgaagacttggggagtccgtgtttgctaacaacggagaattggttctataaggagaaatgcgaatagttccactggcaagggaagtagaaactagattactagagtggatatttgggctctagtcccaaccatgccataaccagctacagaacttgggcaactcatgacctctttgggcttcaatttccttatctataacaaacatttggagtagaatgtctgtaaaatctcctttctcactagaagtcaatgattttattatatataaatttcatttttggttttatccttttgtttctttcagacttttaccagtgatcttacagtaaccaagtccactcactagttctgatttcactcttttctctattcctttgcttctggagtagccagtgaagtacttggaaaaaaaaatgtcaggagggaaagagagaatttcataactttgcacagtgtactcaacagtgcatatttaacacattgcctgttgccctgaaagaattcccaatcaccgcatgagtcgattgtgatgaccgagacttgttctcagactagtgatgtagggtttaaccaaaaaatgccattgtccttactgaggaggatttatcccatcaaaacggcatttgagaacctgacagtgggatactgttgtttgcatttactcttttttttaaatcatattttgatttattggaaacttatatttcaataaaaaaaacctgctcatctttcagtatcaattatacaactctctcattgaaaagtatatctaggccgggcgcagtggcttacgcctataatcctagcactttgggaggccgaggtgggtggatcacttgaggccaggagtttgggaccagcttgagaacatagtgaaaccccatctctactaaaaatacaaaaattagcctggctggtggcgcacgtctgtactcccagctatttgggaggttgaggcgggagaatcacttgcacctgggaagcagaggttgcagtgagccgagatcgtgccactgcattccagcctgggtgacagagtgagactctcaaaaaaaaaaaagaaaagtatatctaaaagaaattagcaagaccaagtatattaacttgtttttagactactaccatgtcaacacttcctattttaaaatgcactgtaaatcatggtttacccttaggattagctttgagtatttcattatttgttttgcttctgccaaatgtaaaagactaagtgggcacactgacccagaattaaagttaaggaaagcaaagaaactctctaaaacaaacattatttaatttttcaagccagcatttcaagacattttcacttgttgaaaggagaaagcacttctattttgttctctagtattcactttggcaggctaaactaaactttttaaaattgttccttttaattgagtacacagatcattttagtgtgacatggcatttatgaaattgataattcagtcacatcaactcatttattgagatacattcatttctagagatcttttgttttttgagatggagtcttgctctgttgcccagactggagtgcagtggcgcgatctcggctcaccgcaacctctgcctcctgcattcatgcaattctccctgcctcagcctcctgattagctgagattacaggcgcctgccaccaagcctaactaatttttgtattttttagtagagacggggtttcaccatattggccaggctggtcttgaactcctgacttcaggtgatctgcccgccttggcctcccaaattgctgggataatgctcatgagccactgtgcctggcctagagatctgtcttgaagacttttactgactctattagttgctgaaagaaccataggctctagatttataggtggccatagagatagagtctaaccttttcatttatggggagactgaagcccaaagtaagatacttaagccaaaaaaaaaaatcatttatttatttatttttattatttttagagacaaagtttcactatgttggccaggctggtctcaaactcttgtcctcaagtgatctgtccgcctcagcctcccagagtgctgggattacaggcctgagctactgtgcctaaccccctttttaaaatgaatgatatgtcaggatcttacattaggaggaaggcaaaattggggagcaccggggtttgtggtttatagtgaaagttaatttcctctgtttctcagacaattaactttttttctccttgagggcaaacaacaaatgattattttctagaaatcagacaatcctatttttgttctaaaatttcatgccaacaatttacttactttcttctttgaaaagaatgagagagattctgacctaaaattgtctgaaatgtgtactgaagatgctaatattgtattggtaggtcttgccaagatttaagagggcatctcagaaagacattgtacaccattctacaatggtaacttgttttcaccttagagatgataaagtagagggatagataagaggcttaattcagctcatttcttacacagtagagaattatggatagaacttacagacttttacataaaataatgtaaccaggacaagaattaccaggccctataagttgttccttatagaaatgctcaaggctcctagctcagttgcttaattcattgatagtttatggttataccccaaactcaacaagtgtttattgagggactatgacctggggacaaagccaaggaacaaactcctcaagtctaggagatttagggttgagggctagagtttgatttttctcaccatgcaagatattccttggtaattcagcaacaatctaaaggtaccctttagatcctaaacaaaaatgggatcctaaacaaaaatgggatttaaaattgttattagatttatgaatgatatgttttcttttgggcaagtaagtcaggtaatggaagttcatttagtgaatcagtgcagtaatgtggttaactaagtgacacttactaagccagaagttaatgtactcattatctatcaggaagcaaatcagggtctatgtctctgaaaagcaaatgatcgtctttcattaactggttaagcttggctttcaaggctcattgtgatctggctccagtaccctttcaacgacattcttctttattcttttttgtatttccttagctccgtctgaattaagtattcttcacacccactcatgctgcctccactgccctcctccttgtctggaccccttagatccacctttccccattcaccctctggcccagctgaagtgcccccttcctgctgcccacagatgtgtttgtatctgcctgtccctctgcccccatcaaactgtgaacttcttgagggcaggtattgtgtctgactcacatttgaagtcctttcattacttagtggtgcttcccaaatataagtttatatgtgctattagtcttcacagtttgtgtagtattcatatattatttgcattatttaccttttttttttttttttttttgagacagagtcttgctctgtcacccaggctggagtgcagtggcacgatctcggctcactgcaagctccgcctcccatgttcatgccattctcctgcctcagcctcctgagtagctgggactacaggtgcccgccaccacgcctggctaatttttttgtattttttagtagagacggggtttcaccgtgttagccaagatggtcttgacctcctgacctcaggatctatccacctcggccttccaaagtgctgggattacagatgtgagccaccgtgtccggcccataatattttttcttaaatctactcacttaaaaaatgactttagcttcatcctcaacttcctaaacatgaaatcatgtttttaattcctgtaaaaatatatatacataaagtatatcttaaaacattcttattatctccacactttgggaaggattgactgagtaaagtgctttacacatagtagccattcagtttctgaggaatgaatagtaaatgcgcaaaacataacatgagaacctcttttccctgttagtttagtaacttcacgcttattaacctagagataaaaggaggagggtgcagctagaaaagactgagcaagcccgtaagccaagccattcattcctgtctgtgaagcatttaggtgttagatattactaattacctcttatgcattgcaaactgctgggctagaggggcctatggaacaataaattttgtggattgcagagtccctgctgacttactgagtgagcctctgctgaaactccagaaattgtgtaagtggaccccttccccacaaaagattcagaaagcagcgcactatacatgggacacatcctagagaaaaggggtgtggtaagtatgtgtacacatcacatggttgttgttgtatttctcagtgttcctgtttggggcagtttaagttacagatttctcactaccactaagtgttttttaggaatgcattgtgtactgccaacataacagaggtctgaaggatttttctataaatttgctaatgggaattgtatattttttaacctaatttttgaggatattgtaagattactcaggtagaccaatttgagtttctttaaaaagaacaagttcctatatattcaagctatagttaacatagttaataattaaattaatcatactaataaatattgaaggctcttataaatccatgaagagatttctgtcttagttactatactctatatttgctgcttctatagagtgtagaaatagtatgctgtagtttcttatttattatgtaaactgcagtatagatttagggtggcagatcagagactagaacaggtgatttttttcatttggtgtttaataaagtttaggtaattttttcttaaatctgtaggaatcagtctatgtaagttcagcatgggataaagtctatttagggttttatgagaaaaatcacccactcttttttttttttttaatccagggttgggatcaacagttgttctagcatgggcagggtaacttgatataatggcatacatttttaccctggtctgctcttagagcaaatttgaaatggttgttttggaaaatgtgctatgagtttctctccagacctttgcaccagggcaggcagtccagcctagcaaatctttggcacttgatgcgcatctttcataacagaactttgatgctgagactcagtgtcttgaaatcagcacaacaaaatggtgcctgaggagcagtgtttactttgatcattcttcaacttctgtgccccagcctttcacagagcacaaattgctttaccagagttacggtgctgaagcccacgactgtttttgtagtctggttgctgtggtgatccttagccttccatgaaactcccatctctagggaaatagaaacctttgcagctgtctcggcctttttggttttgtatctggtggaggtcttcaccgagcttgttcaagcctgagagtgatcggtttgtgtcagagtaaaatacacacatggaaacagggcatccccttcaggatgtgttgtattaaaaaaaaaaacaaaaaaaacaaaaacacagctcccttatccttctctccaatcatgtggggcctttgaagtatctccaagtctggctagagtgaagtgagccttggagatgttgttggtcatgatagtgctgtgagtaagctttgggagcgtgactcaggaagtggggtggccaggtggggaagaaagagagtgggggcaaaggggaaggttaacagggcccgtgtgtgcccagagagaagttggtttaggaggagaatgtgggccgagtccaaggatgccagcagcttgatgtttagaggactatgaggaaacccgttttgacttgaagcctcaatggaggatggtatagacaagagcttccttccataggaaccaagggaatggagaatagcagctgtggttttagtgggtagaagtaataatagctaacacttagagagtgcttaccagatgccagtcactgttctaagtgctttcgacaaatgacagatttaaccctttgacatctgatagaatagatacaattattatccccatgttacaattgatgaaactgatgtgagtagagtcttaacatcctcgaggccctagggtgggtaggtggagagctgagattccaacctaatgcctggctctgagtcactgttcttaaccaccaggtcaaactgcctgtaatttagaaaggaaggcagagtgacccaaaggattgggttacgggagatgtggccaacttagaagaaaatgtagatcttggaagagatgaaattatgctttaaaatgtgtgtgttgattcatgtattagtccattcccacattgccataaagaaatacctgagactgggtaatttataaagaaaagaggtttaattggctcacaattctccaggcagtacaggaaacatagcagcttctggggaggcctcaggaaactttcaatcgtggcagaaggcgaagggaaagcagacacatcttacatggatggagcaggaggaagagagagtgaagggcaaggtgctacacatttttaaacagccagatcttgtgagaactctctcatgagaacagcactagggggatggtgctaaaccattcacgagaaactacccctataatgcagtcacctcccattaggccccacctccaacattggggattacagttcaacatgagatttgggtggggacacagatccaaaacctatcaatttcttcattcagtcattcattcgttaccaaatattaatgtaattcctgtaagtgctagatactggacaaggttctaaggtgataaaaatacaagtcccaccccatgctctgagatagtttatatgtacaaagttaatacaaggcagcagattctggatgctgtaagagatgggtcaacaggacataggtcagtaatatcctctggacacaaagtcttctattttttttttttttttgagatggagtttcgctcttgttgcccaggctggagtgcaatggcatgatctcggctcaactcaacttccgcctcctgggtttaagggattctcctgcctcagcctcctgagtagctggaattacaggcatgcgccaccacacccggctaattttgtatttttaatagagacggggtttctccatgttggccaggctggtcttgaactcccgacctcaggtgatcctcctgccttggcctcccaaagtgctgggattacaggcatgagtcactgcacccggccaacacaaagtcatcttaaagagcatggctttttttttttttttctgtgatccaatgtgaaaatacaaaacagtaattaatgcatttatccctccttccagaaagaattgagaagttactttgctgagtttgtatatagtttccaggagtaaaatagttcctgcctcttactgctatagagcagcttcccattctcctctatgtcccaagactaacacccaagattaaagatgggggtgggtaggtagggggagagacagacagacagacagggagagacattcattctacttccagcactgtcattttctagccatatgactttggcaagaacaccaatttctttacctttaagatgggagtaattagatattacgcagagcacttccttttgatgagagcagcaaatctcaacaggagccatggatctacctattgtctttccttaggagatgatgatgatgatggttattactactgctgccaccatgatttttaacaataatccaagtgcggtgtttttgaatgttcatgtcttagtaattactcctctctggatttctgatttctgctagcaaggtaacactgtactcctaaagaattccttaccagcttcaggttaatatactttctaagattgtactttagcccaggggaatccaaatgccatcctttgctgctgagagcatcttaaatcgctacctgactacaactgcattttgtggggttttgtttgtttgtttttgctattacaaattaactaactttaagatgctgcttaaacagaaatccttattgagatcttacagccataataggttcattgtccaacgtgcgtggcaagtcaatacactgagataccaggttgcagcagagacagaggtttaattgtacagctgctgaactgggggaaaactcaaatccatctcccacaggagtttggggttggagtttttaagggttttgggtgggctgaaatatggagattgttgatgggtcgaagagtgcagggtaaagtcgtgggacagggggatgaagaaactgtgttctcatgctgatttggtggttcctttgtgggagtctttaaactggttggtgtcagctgtcccgttggaattcaggatctgctcatgcaactctcaaacaaaacccttaggattctaacatcagacatcctatctatctataggagcaatggggatgcaaatggtgagaatctagtgctatgtgacttggttacaagaaactaggtcaaagagcagcatgttaatgcttaattatattttctgtccggaattcttgttaacccagtgaggacagcttcaatctctgactgcacgtagcaggtggaatgattactccagtactcagattttgtgggaattgagttcctgctatgcttattttgtaaatcagcttctaatgatcactctagtgattctctttattatgcagtttgatacatcacagtactgatgcacaggccattctaacattctgttgttggtaaagacatatacatgtgagcatactggcttactaaacaggtatgtagcaaagctaatttgaagcccattataaaatgtagaaattaggctaggtactgtgtggctcacacctgtaatcccagcattttgagaggctgaggtgggaggattgcttgagaccaggatttgagatcagcttggacaacatagcaagaccctgtctctacaaaaaaaaaaaaaaaaaaagaaaacaaaattagctggttatggtggtttatgcctgtggccatagctacttgggaggccaagacaggagattacttgaggagttgaaggttacggtgagctctgattgtgcaactgcactccagcctgggcgacagagtgagatcttgtctcaaaaaaaggagaacttgagaggaaatacgtttgtatagcacatagttatatggggctttggttacatattagtgttaaaaacaaaaagtgatctgaatggatgtatttattaaatgtgacagggaatatatatatataaaaagcaaactttccctccattttaatcaatttgcaaatattgagtttcttcagtttgtctaaaattttaatttctaatcattctaacacacttaattgcctacatgcaaacccgtgtaaaattctatgcctctaaaagatagtggaatatttgctcaaaatattttatctttgttatctatccctaaggaagaaaacacgctccaaaggttttttacattttatgtgtttttatttgcgtaactgtttaagataacaaacattttctattttcttttctttgccttttatggttcccatggatggcccaagtgccattctacgctgtcttacacacagagaggatgatgatcagggtggcttgtcctacaaagcctgggagtggccttggcatgctgtccagcataccttccaggaagcatctccgtcatttgtttcagtagctggaatctgcttatcttgactgtgtgttaatgttctgtttactatatacaccccaacccccttgttctggccagaaaaacaggtcaatatgactctgtaattattatcctagtcacatttcattaataacttttgttcgttccttcttttattccttctttcagagaacttgtggactgcctactagatgtcctgccctgtgctaggcctaaggatgcagaaatgagtgtgactcagtttctgcccttgaagaatgacctgaggaatttatactgtgacaggggggacaaacatccaaaccagggcgtccgatcttttggcttccctgggccacattggaagaattgtctcgggccacacataaagtacatgaatgctaatgaaaactcatgaacgaaaaagaaaaaaaaattgcaaaagaaatctcataatgttttgagaaagtttacgaatttgtgttgggcctcattcaaagccatcctgggcagcatgtggccgtgggttggacaagcttgatctaagcagttcattatagtgccaggcagaggcagaggtagaaacaccagtgctgtctgagagagctctggctctgtctgagggagggggaaagattttactggagatggcattgtgagctggacccacaagtccatccggagcactgtggtgcactttaggccagaatcctgcaaggctgcggtgtgttagtgatgtacacagtaccccattcacacaacctatcttaatgccaaagaatgatagaaaagtgcctgtctgtgtcctcagacttgcatcagtagtggcctgctgagggcactagcagcgttcctccacccgaaccacccacacatcagggtctccgctttgcctgcctctcttctccgcagccgggggagctgtggctgctctgggaaggaagggcctgggtctctggaatctccttgcaacggctcccaggacccctttagaaggtcatgacctgtagtttcataaatactcctctgtttatatgagctcttgcccctcaacccccaacccaaatttagttcccagtatttttccagggcatacaaaatatggagcagagcttatttctgcatcccgtttcagactttcattttaggttttttttttttttttttttttgtctcttttgtggttatattagatgattttcagaggctctcagggaatcctgaatcatgtccttgttggggggaagggagattagttttgaaatagactgacagtgcccctctcagcactttaagtggtttcaagacaaaaccattgggaaagagcttgataccatttgaccaaggagaatggttagttgagtgccccaggtcaggatggggaccctgggtgtgtgtgggggggaatgtgtgtgtatgtcaagatttcttgaattcagcaccaactgattaatattcttctagaaattcagagaaatataaaaataaaaaggaaaaattttaaagctccacacccagttctctaaaaatattttgagggaatctttttatgccaattcccaaatggtgaaggacaagcaatggtgaataaaatatcagctgtaggggttccttagatcagaatatactttaaatactgcagcagcaactaagtaaatactgttcccacccctagcagtcagttgcacattttagatccatctggggtcaggtttgagttcctaaaagtcatattgcccaaatgtcagtgaaatttgagttcagtgggaccctagtgtcctgaaataggtttgtgcctttccatttgtgggtgcaaagtgtgggtgctgggagacccagattcaggatgttttcagttactactaacattgttgccaagtgggatgtctccttacccctgaagaggggacagatgatggctatatacagaccagcatgtgattttatgggtcttggttgtaggcacgctgttggagttcttttcttatcttagtgtaaactgattattgaatcatccatttcagagaattatttggtctggttttagataataagagtttccctggtagtgttttggatgacttcattgcttcatgaacagcccacaggggctgttctaagaatcagaaatgttgaaatggacctcactgacacgttagcaaaattggacagctgttagactagcatatcagttgccttgctcactttgctttttcgttcgttttaatgaaccccagaagtagggggtctaactaattcatattctgaaatctctatggtagaaatgccttgcatctatattatgaatcttgggaaattcaaaacaattttcataaggaatctttccataaagcaagtagggtttccccctcttcctgtaattcattttcataaagtaatctacagagtttgagacaatagatagtttttgcttatcaaagataacctttggagaacccagaagccttcactataacaaggtccagaaaagattgtccttgttattttctgctgataatgtgagcaaagacgttcttcccaagtgagagatagggaggtagtgtttccactcagaggctttgtgctccttagagttgtccttgactttgggcaaagttgtgttcagattccccagaaaaacactcagaagatctgctttgaatttctttataaaattgtatgtttgttgcattgcacaggtaactgcagaagacctagtatgaatagatgttgtagaacaggttagaccaattaactcttttccatttaggggaagaatcagcaatgtatgagggatggtgttacataagggatgtggcagatcagatttgcttgcattttctcacaccatcaggaataccgaatatccagcactgtttgaaaccagcatggttagaacaggaactcttggattaggcttcatggaccagtttgtggtcaaagtacgggtttcacgagaaactgcatgtgaaagtttttttagttctgagtcttcatctattaagttcttctgctgaaaggatgacatcttaagaccagcggtgtaatttgtagtttaattagatggatccattttgttaccattgttgctcttagaactttcttactcttttacgatggggttcttaatctgggttaatgggtgcctaacggggagttcatgggccctgcaatgaatgtaattccctgacattgtctgcaaaagtttgtgtgatatggatgttttttgtttggtttggtttggtaaggagagggtgcacacatgcattcagttctcaaatgttccatgactcccaaagatttacaaagaagccagtggtttcgagactggtcattgctgctcctttgagctgcatcccctttggttctaccagccttcacagcttgcatggtcccagtgttcaattccttattacttatcagcccatagacaaagctgttaacctgtatttttatgtgtaaatttgacataggattgatggtcaactctttaaactactgtttggatttccaagctggagatttctggatactctttgtatcatttcttcatgggatatttatttgctgtagtctgcctcagctcggcctttagaccatgagcactggagagtgtaaccacaaaaagcttcaggatattcttatatttgtaactgtagtctaccctgagctataattgatcctaaggaggattttctttttcttttcttttgtctttttttttttcccccaagcctgggagaaattgagcaacttagccaggaattctttgagatattgctgtgtgttctctctacatttctggaagcttttataccatggttcttttgttagctgttttggttgtcctttatcttcccttcagcaagatttactcaagcgggggaagcatagaaaagacaggttgctgagggattaggtgagcaggcacttgcaggactcattgtccctgccaaatgatcttttaaagaaactattgggtatttttctttgaatttcccaattgtagtgtgaattcttctttgccaaatggcttttggggctctgcctggaccctgtgtgccagagtcagagattcatcttggccagacactgccacatattgaagagggagctgtttccaggaaagctcagagagctgtggctcctagaaatcttcccttgattgtatgagccaggcctcagcacttttgaccatctggaaaattttggacctgagcaccaatatctgtctcatagatctttttcttctcatttcatgagcttttataaaaaattcttgttcatttgaaatacatacttactagtattttgtagtatatattttgaccgaaacttctgcatatctatgagctctaagaagaattgtatgcctgaggactgcaaagaaaatcttcagaagaagggttgatgcagcccctgcagatatacattactagtctttgcatcattatggtactcagtaaatagtcttgaataaataaatagagaaaccttttactgatacatgctattagtgaaagagtgttgctttgcagttttcaggtacactggaacaaatgatgatttcatccctccttcattctccatagtgtgtgtgtgtctctttgttcagtacagtttgaatctttgcttctgctatttctatagcatctcttcttctcagtggctatcaatctgtttatttctagatgcggacagcatctccaaagtgtgctgtgaggtagagtctttacaaccaaggagcacattactttgctgtagctgtacttgacatcactgttcatctagtactttgatttagtgctatgcttatgccagatataaaaatgatcctagctgtgtgcagaaatagctcatgacagttggagtattgcttatttttgtatttttttgcaaattagccagctaaattcctttgaacctttttttcccctttaggtaacatataaatatatgaatttgctgtgataagtcaatatttattgtgtgtgtttacttcccggccttttggctaagatcaagtgtattatcgtgtctatgttaagcacagttttttgtttgcttgtttttgaaacagagtctcactctgtagcccaggctggagtgcagtggcacgatctgggctcactgcaacctccacttcctgggttcaagcgattcttgtgtctcagccacctgagtatcaggtgcctgctactatgcccggctaatttatttttgtatttttagtagagacggggtttttccatgttggccaggctggtctcaaactcctggcctacagtccattttggaaattaagacatgcattctcaagctagtgaacaagatgatgcaagttattcatagaatatttttgtggcattgaaaagcagagaattaaaacattattttgacatttgctgagtgcttaccatgtgctaaagcctgggttttgaaagataatgaaagtttactgttttatttatcaatgacctgagagcatactatgataagtgacattggtcataagtggtccctacaaaaaaaggtagaagtatgttgagatcacagtgggctggcagccattgggaaaatgtgaaatagtccagcatttagtgctgtatccctgatggttgtatagacacagatcgtggatctagaccatgtcatcctcatgaggattctagctgagatgtactattattcccagtgcatcattcagtctgtgtctttctagcctaagtccttttttgtcctgtccctcccttattactttatggttatgtttgatgagttcactctgtttaaatatgtgattcttgggtcttgcctccccgctctgtatggaaagccagtatgagacagactgtatgaaagtatctagtcaatatttccttatatatccctttgttctcctatgttcatgttgccctgggctcatgtgtgccaagaggactttgttgagtccatggtttgcagctccattcacaggtgctttttggtgatgttaatgacaacagtgatgacctgcaatagtccttgatctgctgtcaaaattggttacagtttttgtatccatcccatggttttcttccctgttttttttttttttttttttttgacaggggctgtatacaatcactctttattctgtgtgtcctctgtgcttcatttctttggaaaagcccttcaagctaaaagctgagacaatgaaagccctggcagcctcccttggcagccgctttttctcagctttcggcacttttctttggcagaacccatttcactttatagaggttggagcttacctggaggagaagaaagtcatttctctggagatccagagggatgaccccaccccagggggattttgttttccaagtttcaccttagtcatttgacctaaagcttaaagcaggcctaagggaaggtaacttttgttccacctttgctgacttttagaaagaaaaaatgtgttctgtttatttgttctttggcagggagctaaatcatgctttggttgagattagtgtggttgactaatatgaaatagccattttgtagtaaaaaatggtcaaatattggcaatatcatctggttcaacttaatgtatcttattcatagaatctgagctacattatagcttgtttctgttgatagtgagttgcaaaaaaagtattccagaggctgctctgagtgattttcatggaaagccagggctaagatttctgccctctttctgttgcttcctaggtcacacttcacctgaatcccatctcctcagtccacatccaccacaagtctgttgtgttcctgctcaactccccacaccccctggtgtggcatctgaagacagagagacttgccactggggtctccagactgtttttggtaagtgcttaaacctcccccaaactgatccttagcacaaggacataatggtccttaaactttgccaaacttttcataaaggcttactttcactgaaataatgccagagtccaaagagtgttaaatttggaggatgcacttagtgatatttggatgatgacatagataagcattcacagaaagcagacacacccgcccatcttctgtgggcagaggctggggtctagtgcgcacattagagcaggacctgtcgtcatactctgtgtggcctgagctttggtttcagctctgaaaccccccttgtggcatcaggagccctgtaaatattgtaactggctaccgggtgtgtggtccctgaccacaaaatgaatatgcacggacccatactatttgtatataacacaggcctaattcctgatatgaggatctgtttgttgagaaagtgacacagtgagctccaaaatgaagtcatttgtattttattaaaaaaacaagctggaactcagctcttgtcgaaagatccaaatattacctactatttgtaaatcatgtccctttgagtttgccagaacattcaagtgtgctagttgtggagaaatcgatgggttgtttggatggaatttttttggtgtgatatcatgtctgatgatgagcagcactgcaacttggtagttgtaactcacattgtctattacgagagctgcaggctaatgtcctaactgcggtgcctgaggccttaaacctctcttgcccacaagcatccaaaacaagtggagtccccagttaatagttttcctcttgcctcatgaataaactttgcccagttaatgtctctcaatccagatctgtagtttctttcccctgtgtttgaagagtacttctaaaaactcaaaggttcttgttgaataatgtaagaatccatagtcaatacaattattataataagtacataaatgaataaaagggagaaaaggaaaagctcatctttatagtaaaatgccaactagaaaatctagaaggagcaaaggagttagaaaatgatcattttgcaaccatcataataaaagttgaccaggcaagaattatcaacagatgctaaatctagcagagatggagggagttcaggaagtagtatatttagatattcttaaaatatctttcatacaaattacttattaattacacataaaaaatagtgactatataccttggggatatcccatgataccttaaccaggtgattaaaattcatatcagcaatgtggggcagatggacgctgtgtgcctataaatgagagagaacacagcatcacttttgtggtatttttgccagaaatgcatataacctgaatctaatcatgaagaaacgctgacaaaaccaaattgaacgacattctataagataactggcctataatcttcaaaagtatcagtcatgaaagacagagaaaggctggggagccattccagattagaggagacaaaaagacaagacacatgtgatcctgagctggatcctgttgggtagggagtggggcagctgctataaaagacattagggggacagtggattgtattttatataaataaattataattgagcctatagattaaaatattatatcaatgttatattccttgaatttgataattatgttgtttttatgtaagagaatatccttaggaaacatacttaatactctttaagattaagggctaaaaggtcagatcattcaggaaaaaaacatgttgtatagagaagaataaagcaaatgtggcaaggttttaaaaactgatgaatctagttaaaagggtatagtagagtcctttgtactagcaactttgctgtaaatttaaattaatttcaaaagaaaacatttaaactcaaaaggtatatttacaaggtgggcattacaataactttattgtagccttttctgggaattgcaactcttattctatattaaaaaggccaaaaatcaaaaatcagtaattatttagttgttattactagcacatttatttagcacttaggatatttcaggtcactaaatgctctaatactttaattctcacgatagccttctacagtaccatagtgtagatcctttcttatagatgaagaactaagatttagagaagttaagtagtgggccaaatcacatggctagttacttgcagagttggtactcaaacctagatgggacccattctacaagctgttatgctaaactgtctgccttcgtactcataatcactgtcagtctcctctaattaaagttacttgtgatagtaatactaatggctctgatcataaagtcatatgcacatttagccctcatactgtagagctatactgtccaatactataggaaatagctgtgcgtggctacttaaattacagttcttcagtcctgcttagccacatttcaggtgcttagtagctatgtgaggctagtggctaccacagtgggcaggttatggaggcattatgagcaaaggcagtgcatgtcctggtttagatccaagcagtgaccttgggcaaattaatttctctaagccggatttttctcaggccctgcatcatagggctgttatcttgagtaagtgagatcacatataaaatgtttatagacatcacctgctgttgctgctcttatttatttctagtcacagtaaagagcatgtgggacgggtgttgaatttgcatctgtatttatgaaatatctagtttggctggccccagatcaaaaggggttctgtttctctgggctataggtccagatgaaagtgtgggctacgtatgtcatagttgtacttatcgctgcctggattctttcttcagtctgccagttcatgggttttgacggaaagtgtcttactcttagttattaatttgctttaattttgcttaaaatctgtaaaaactgcttcttggtcatcagtttagacactaacaatgaaagaaggtggccgctttagtaaacaattgaacgtcagccccatttggatcaatcccatgtaaggagattgcagatcaagtaatgagcctaaaattaccaacacgtgggaggcagcatcaggagaagtcaaggatttaaattccaggacacctgaactctgctttgttgtccagcaggcttcctttagggaaaacggtttttttcccgtctgcacatttcttcttggcctggaagagacgatggaacatctgttgttcattcacgttctcacatcagcagacaacgagtgatgcaagtccttgcacaagctgggccactctccttgggcaggcttttcccttcctctctgtggcctgaaatgaattttagtttctcctcatctccttgatagcctttgccacagagggtctggtgatcaatagaaatccagtagtgtgttctctttatccatttgtatagttaagagttaaagtttggggataagataactaaattattttatataaagtgttcatcaaacacttcagagggcccacgggatctctggaaattcaggcttcaccgttttcatcactgtcttctccgaggttacccagggagcctaaaggagctgtggaaagcgaatgggtctcttgactctcagtccacgatgcatgtatccttgcctgtttcctgatatgctgctggatggtttgcatttctgtctcagagctgtctactgtgtacgtagagttacagaacttttaactgtttttttttaaatagggcaatgagaaaagttcaagtaatagcatctactcatttatcagggtgacctttttatttaaatggacatgtctgtgttgttatgactgcccaaattaaaaaaggaaaactttcataattagttaggagggccttatgttacccaggacatcgcagccacccttgagggtgactgaaaacatactttaatactagtaataaaggcatctgtctttttctgtcaaatcatttcagtccttctcaccccctcacagcacaggcaagaagggaacgtgtcaggcagggagaaagtgggatttggttttctctgcaggtgcagctcctttatctggttattctggttacctaggaaatatgagtgggatgaagagtgatgctttcaggctgagtttcaagtagtgaatctttgagtgtgagtcacacacacacgtgatgaagttgtaataatcttatagttttccttttgcagggtgtatgggtggcccagagaacaatcagaaataaaaatcatcttaccctctcagtgtgccatgttgaaactgcaaataatctcttagaaggatcacataagcctgtttttatttatgcattcatttctacactgaaaaaaaaagtaagataacttaactgggtgatgatgcctgaaccttcaacctgaatttgctaaaatgagagccacagtatgaagttgtctttaaggacatactacaatttaaatacacggtttctagagaaaagacacaaatggccaaaaaacacatgaaaagatgctcaatatcatgagtcattagggacatgctaatgaaaaccacagtgagatgccacttcacactaggatggctttaataaaaaaggcgataacaagggttgtgaaagctgtagggaaattggaacacgcatacattgctggtgggaatgtaaaatggttctgtggaaaactgagcaaaacacatgtccccaagaacttgtccacaaatgtccaaagcatcattattcacagtaaccaaaaagtggaaacaacccaaatgtctaccaacagatgagtggatgaaaacagtgctatatccatataatggaatattagccataaaaaggattgaagttctgatacataccacaacatagatgggtcttgaaaacattatactaagtgaaagaagccagatgctaattgtcacaagttgtatgattccaatttatataaaatgtccagaatgggcaaatctatagaaacagaaagtagattagtaattgccaggggctgatgggaggggaaaatggggaatgactactaatgatacgagatttcttttgggaggtgacaaaaatgttctataattacatagtggtgaatataccacaccttgtgaatacacacagaaacactgaattgtacagtttaaaaggctgaatattatggtatgtggactgtatttcataaaactagtaaaaacttgctgcagcacttttttttttttttttttttttttttttgaggacagagtctcactcccttactcaggctggagtgcagtggtgcaaacatgcctcactgtagcctcaaccttctgggctcaagcgatcctcctgcctcagcctcccgagtagctgggactacaggtgcatgccaacatgaccagctgattttttttggtattttttgtagagatagggttttgccatattgtccaggctaatctcaaactcctggtctcaagtgatgcacccactttggcctcccaaagtgctgggtttataggcgcgagccacagtgctgggcagggactaggtttttaaatgtatctttttactttattccatgtacctgatttttttttctttttttctttttttttttgagagagggtctggctctgtagcccaagctagagttcagtggcatgatctcggctcactgtaacctctgctgcctgggctcaaaccatcctctcacctcagcctcccgagtagctgggattacaggcatgtacccccacacccagctaatttttgacttttttttttgtaaagatggggtttcactttgttgcccaggctggtcttaaactcttgggctgaagccgtccacctgccttggcctcccaaagtactgggattacaggtgtgagccactatgcccggcctctaattttttttttttaatcttgctttatttgtattccaaacttgagcattctctcctgcaaggtctgtagacttggagccctaggacaagcagacgttttcaagatgagaccctagtgcctggcttttaataacctaaaatacctagtccagaggccttggccagcttacttatgtcaggcttagtcactttgcatgctcataaggaaaaaagggtatctaagattagaagtttcaagaaataagcagcttcttccaacctcattcactctcgatattactgtgctgtgatctatttttttctagccatttatcattaaaatcagagagcaaatgtatgtgaatgtgtgtatgtttgagtgggggatggggcatagaaggggattttggtctttgaggtacaattgctggagctggcatataaaaatagaggatgcccaattaaagttgaatttcagataaataacaaatcattttgttagtgtgcccatgtagtatatgggacataacatatactgaaaaagtattcattgtttacctgaaattcaactttaactgggtgtcctgtactttattgggcagctctactcggaggtaattcaggtttttgtttccagttaacaccctggcctgggtgttaggaggcctgagtactagtcttggctctgccactaactagttatatacatcatcgggaaaaaaaatcacttaactactcagacctcgtttcctcatttctaaaatgaggggatcgtactagctcatctctaaagttcctcccagcttttaaactctgtgattctttgatagtacgactgctagatgttatatcccaatttaatttggaacagaaactggcaaattgagcattgcctcttcagcaaatccaagtaaatatcaaggcagggcagttgcaataaatgacagaaactaaactctatgctattagctttggattaaaaacaaatcaaaacttaatcctaatgaaaaatgtaaattaataaatttaaaaccagttttgtattttcaagaagcggggagggatgggtgaagaagctggagctgccaacatctagtttattccttttacttaaactagaggcattaaaaaaaaaaaggtccaaatattttgggcctctgccaccaaaccacaggcagttctctggtctgcactggagtttggatgactgacaagactcagtgaaaaacaagtgctatttgttttcctgtgcctagtatttaactggaaatcagaaggctaaatttccaatcagttgctaaatagccccagatgtgtgctcagtgcagcactaggaagggacacgcacagcccataccaccgtgcatgtccagctgttaccttttcatgaagccaagtgatgtgtaactgagggttgtagtgtctgtccaaaaacgccctaagaataactcagacattcaagtttgcttgtggagaagggaactttttttaaaaaaaattctgtattctattgtgttacatttaaaaatctggaaataatttttttctttgctaatttccttctttcccttctttggcagttcccccacccccatgtttagaaaaaaacacagaattagcataccgggtatgatggtttatgtatgtgcttgttcattcatccaacacacagtttttagtgcctgactgtgaactgtgctagctgtggaggatctagggaaaactggggtgaattgcctgtcgtcagggagcttcccattgtgtgggagagctgattgaaaaattgggaattgcagtttagtgtgctaagtactattacgctaaataatagtgaaaattggagaagatgagaatagtagaaattggagaaaatgagaattctcttcttccaaatgcaatcaaggcagcttcctgcatgaggttggctctggagaacagcatgtggcaaatgggtcaaggttgcagacacaaacacagctcttggctcggccagaagcattacccctgtattccagggacccggatataccagtttgtgttttgcagtgaggtctttccccagataaattctctcttgaagggagattaaataactaaatgtttcaagattgctggtggttcttcttctttttttaaatgtctcttgtggaatgactcattgtgtcctgtgggatattccaagtggttgtgtaccatgcatttttattccggagtctgctcatctgttggttttgtggcttgtccttaagggccttaattatatgggtcttgatcctctcatgaactagggtcagtcaactaccctagttcaaacaagtcattcctgtttcctaggaataggagtttttggccctattgtggccattgagctcttcctaaatgtcactatggcaattagaacattggaaagagcccagtttcaactggtaaacctggtccagaaggggtttttgaaagactccctgggatttattctaacttgctaggttaaggctggtgaatgttgtgagtgagtgaatggcccgtggcccctgggagatttgcctgggtgtatttttcctgaggaagacctactgtccaggagggttcacgcaagtgtagacttttcctggctctggctggacttgcgtcatgtctgtgtgcaggcatgggttgcagccctgtgaaggctttgctttcattcaacaaattgaggtcaaataaactcactttcactgaggaggcaaggttggtgtttcttcgtgtggagtcccataacgtcttttaaggctttattgtctaaggctaatctggtaatcagatgcatctgcccttcccaagtgttgggcaattgtatcaaatgtcacatctctggtgccctttgttgacgtggtggccagcctccagagagctgttcggtagaaaaagtgactgttttgttaaggaaggttgcagaatattttatttccatgtaataggaggggaaagaaaccccaactgtctaccaggagactctgggaggctgacttgaaggctgtggctgtgccttgttccgctcataaattatagacagtgatgcctttggtaagggttctccacaggtgacctacactctccatctcagaaagcaactccaggatggtccaactccttcctggacacaggttgttgggtttatttgaggcaaattggttcttgcacctcgagtccacattatctaactctagcttggaagctacttctgatttcgcaggggaggaaggagtccctttagccttctaatttctgtgtctaggatagaatttgcttttctcaagatctgcttttgccttttgttcctaacactgtatccttagatgacccagggtctttgttgcaactgtgggtccttaatgccactgtgctagggagtcaccattggtttgcctctgccttgtcccactgaggtggtgaatgacacagtgtatacctggaagtcagggggtcatccgtctgccacctctagcaaaagtctcacagtccatttgatctctggcctttccatctttatcacagagagcctgttcttgagattctattggttctgggtgatacagatggcagagtgatgttcagagctgctgtttggagccaagcctgccccaatccattaaaacagggtttttatatccttttcttgcagtttgtataagaaggctatggtcctgccgtagtgaggaatgactcgtggcctgtcaacctcagcatctgtcagacaaatctcatggcccaatgtgaggatacatacacacatatgtgtatgtttaacaagcacttctagtgtgtgccgtgtgtgaggtactcttctgagtacttacatgtatgagcttagtcttcataataagcctgtgaagtaggtgcttttgttgtctttgttttaagatgaggaaactgagacaaagaggttaacatgtacctggtcccatagctagtaaacgggggctctaacccagggacagtgcttagtaagtactcagtaaatgttagcaataataataataataataataataatactttccagaatggtaaatggggacctcattgggaacagtcacactgctgactcgagggcatgactatgattttatctctaactctggcctccagtctggagccactcatgactgttccaagaacagggcttcagaattgaacctatagagccaaatcagggcatcgcatcaggtgagcaaacttcttgtttcagcaaagtgttttatgcatgacttatttcagtactgggatctagatcatatcagtatttcacttgaataaagattttaaaactgtttcttgacccctttcccaagagctttccctctggggtcccagttggagcgtttctggatcagctccaccaggatgccctaatatctacatctatcctgaaccctgtggggaccgtttgttaattgatgctaaatatgtgcagttcaaccttctttgctttgacctaggagaccaccttgatcatcttcagagacttcaatgtagactgcaaaatgggtgtggcctgcttaagagggctctgcctttgcttcagagctaattttaggaagctcaaggaggctccaaccacagttatttcgggctagaggcctcacctccattcttgccctccaaggaaataccctttagaactttttttcccaaactgttgttaggtctgtggttcctgggccagaatatgcagctctgtttctcctagggcttgcaccagccattcccaggagctatcagtcagcatttatctagagaaacagaaccagtcggggatatatatatgaagagatttattacaaagaattggcttatgccattgtggggacaggcagggcaatcaaagtccgcagggaggccttcaggaagggcagctcaggcatgagcggaagccgctgtccacaggtggaattttttcttcctcagggaagccttgggtgtgctcttaatggctttcaatggattgaatcaggcccacccagattatctgatacaatctcccttccttagtgccacctgattatggagtttaattgcgtctacaaaatacctcacagtaacgtgtagatgagtgtttgattgcatagctggggaagatggcctagatacgttgacatataaaactgaccatcacagaaatttttaagatccttgagcaatttgttgttgtttactctaacttgacttctagccaagtaattatttcgttgctttaactgtttcatttctatttctgtctgtcccttccattccgttcctctccactctgaccagcacagctcctgagattgctggggaagaggggacagagagggaaataacccaccaggagaatctctgcaagcagcagtgaagggtgggagccccctgctttgcctcactgcttttccttttcactctcctctaagcctggagaatgttcctctgtatttgcctacccagacttggtagaaagcttgccctaagacacccaggtctttgctgacctgtgagccagtcagttccctcaccaacgggagatgacctttccaggcagagtgtccaccttcccacagtggaaagagcatcatttttggagtccagcagacagtttgaatctgcactcatttcttgctaaaggtgtgtaatctggcactttatctaattgctcagagccccagttgtttccactatcagatatgaggattcagaatccatgtgacatgcacttaggaagtgtgcagcctgagcttttgtgattaatatcatatttcctagtgttttattaacatgaggctgagggatgtgcgtgtctaccctacactactgatttctgagcctggtagctgactcttccacagcgatggaatagaaagagctctagagtgagaaaccaggtctttggttctattgtcaaccctgttgtctgccagctgtgtgccttgggtagatcctttagcttctgtcagcttcaatttccttctctgtaaaatggagttgagattatcagccttgatgaaaaaaaaaactctataaagagaattctaggaacatgtttggagccaggcatttgtaaaaatcagtttttgctcttgaacttgacttggctgattggatgtaacttagaagaaaaaaaaagagagtcttccctcctgtggggttctccaggagcacatttggaggacaaaattagataaaggaatatggcaagtaatagtaatgataccaacattttattttttttcgtgaaaaacatcatttagattgaaatgcactttgaatttgggggtaagctcttccatcaggctaacattggcagatgaggaagggtaaagttaggagtctgaagaattttttgtaaagctggacaggattcctgtgtggcctgggactctactttggaaaactatattagaaagcagcttgtgcttcatcagtttggtaacttgtggggacttagtttgttttttagatggaaagacatcttttgcttctctttgtgtatatacacactcacatgtactgttgttctgataacgtttccatgggagatgagagtattgcttttgtactggctcatgttcaagtttgtgcatgtttgtgtttggagggcagcatctcagagctttcctcttggacgtgtgtaaacatgcagggtgttaagaacatggggcggtttcagtcatttaggttttttttatatttcagcaaaaattaagaacaggatgatcatcatgaatgttttgagaaaaagtaatagtcaaatatgttttaagtcattttattggaagaaagtaatctggtttggggtactaaataaaatcacccaagaatttttaaatggctgcatggatttgtgtttcatgaatgcatgattggcagataccatcatcacatggctcatgaatatgtagctttgcaaattatgaacctaggttcacaggcatggaagttattatttctttgaaatgaagcttttttaaaaggcattgagtcatgatatatgttaatagaaaacatgtttcggattgcatttcacatcacatggcttcagaggaaataggcaagtggggtcctcccaggaattgggtagggagaacgtgtgattttcctcttttaaaatgcagggttcagtcttcatttggaaggtaaatatttcagtgctgttccagtatgtttgtttttgctggactttgtgtgtccaaaatacataaaagcataatctttgtaatgcctttctgtgtgggggctgtgatgagttctagggccaatctgtagatcccacttaaacctcaactgagattcttgaggaatacctattctcctttaccgtgtgtcttttccccctggaactgagccagcaagttcttggcatggcaggtgtttctgaaatatcagtgtgtttttctttgctttctttgttttccttgttttgctctttctattttcctaagcaggcaactccaaaaagagatttgtttgtgcaggagtcaggaaaagggaagaggaatactgaaagctgggagtagggcaggacagaagagggggaggagtctattttcattgtgtaagtgttgaacttccaccaatgccaaagtcacggacatgtgtgcagttggatgtgcgagttagagcagccccaagggcctgtaacctgaatagcaggcactcacccagctgataactcaagttccaaatggaccacagctgagttgtaggggatgtgtgtgtgtgtgtgtacgcgtgcgtttgagattcctggaacagatttcctctgagatctcaacaggctttttcattatcattggggagctatggtttctcttatttcacaaggcccatttcttccttttgagatgtgcaaggagatgactccatccatgacttggctttacactctccctcttggctttttatcatcagtgcagaggagagattcttgctcgttcttcaaacaatctcattcgagctttataaagattattggagtttaaataatattcatatctatggcctagaacaatgttcctcaagtatgcgtcagaatcatgagtggtagagggaggattataatgtagtttcctacatttctacctcccaccaccctggagtctgcattttaacgtacttctgtctgaggatcagactttgggaagcgttgggcttgagatgttttcttgacattgatttatgttgagaccagaccaagaagcagatggatggacatgatcagttcataaacatgttcctttcttagggtcaaattggaggaggctctagagaagcactgtccaatagaaatataatgccaacaatatatgtaattttaagtcttctattggtgcatttaaaaagtaaaagaaggctgagtggctgggcatggctcctcgtgcctgtaatcccagcactttgggaggccggggtgggcagatcacctgaggtcaggagttcgagaccagcctgcccaacatggtgaaaccccatatctactaaaaatacaaaaaattaaccgggcatggtggcaggtgcctgtaatcccagctactcgggaggctgaggcaggagaatcgcttgaacctgggaggcagagactgcagtgagctgagatcgtgccactacactccagcctgggtgatgagcgaaactccgtctcaaaaaaaaaaaaaaaaagtaagtaaaattaatattaatgacactttgtttaacccagtagatccaaaataatatcacttaaacttgtaatcagtcaataaaaattaatgagatagggatttttcttgtgctaagtggtatgcattttacatttatataacacaggtcaatttaaccagcaacatttcaggttcaggtacttgatggtgccatgtggccagtggacactacattggataacagctgtagagcaatgatgccttcgctaaccccctggcagacacgtggttgctcatggcatttgttcccatttctccactgctcctgaatatgacctcagaatccttctcggcacagaaccttaggcaggcactgccagttaattggacatcaagatttgttttatttatcaaacaaatacttaacaagtatcttttttgtacccaacacttggggtatacccatggacaatgcacactaagatcccagcctctgaaggaaccttctagtggaaggagttgggcaataagcatattatatggcattttagaaggtgacaagtactgtagaaataaaatgtaaagtgagtttgggaaaatcagaattcctagagtggggctgggtggtggggttgtaaatttaaatgggcccattgagaaggtaacatttgaatagacttgaaggaggttgaggtgaaacttaagatgagacttaatatccacttttgatctagggtggcctgaagtttcctcaagacttcatctgggagcattctttttggggtaggggtcaaggaggcaggaggatggggatgtgtggcactatccacagcaagttcctctcctcaccactgaagactaaaccaacgttggggaggcccagagagaggctacaatgcaacctgccaggtggtgagtcagctgatgtgctaagtgctaaagcaaagaacctcagtgccaggaaaatggtgtctgtgctcattagctgggacttgtacacttcactcaggcttgggagatcaaccttgaggcttccgtggatccgctgaggactttaagagttaaagcttaaagacaggtgtggaaacaaagggctggttgcctctttggcttttttcatgtagttttggatgaggttgttgaacctgatccagaaaaaataataaacttggctgtggttgcctagccgtaagttcttataataaaactcccagcaattggcagatagagtaatgttctgctctttaaaaaagtctggtagcataacctgaatttcaaatacaaatgttgtgcatggttcaagtagggaggagcattcaggagagtccagggtgcacctcagcatcccaggatttgtttgactgtaaagtgcttcatggttccccttcaacaaacgtttactaggaattgggacccttggagcccagtgctctgttcattcccacaggaagacatttgtcatgtcagggaatgttagaggattgggttttaattagcaagcaggaggaaagttcattgggttgtggggaagacatggaattactaaatatgctttaataattggtttttaggtggagttattaggtgaaaaatcaaatcattagctttaaagcttggccaaaagctcatttcctgggcagtaagggaagcaatgagtttgggtaatgggaatgaatcaattatggtgtatcttttcctgtaggtaacaacattgagctttcattcaacaagcaattattgggtccttgcttcatgcccagcactatgccaggcccaagggattcagaatgaacaaggttttttcttggccctcgaggtgttgctctttgtcaaatgagggtggcaggtatgctgataaatagttgcagtccatgtgagagagggatggactaaaggtctgtacagtcacttgtgtgcagctcattgtgaggagagtagggagcctgggaggcttcacagagcaggtgatactcctgggaggacacagaacggtttgccatgggagcaaggtaggatagacgggttcaggcagggtgcagggtgtaaaaagacccaggagtgtgtggcagcatgatgtgttctacaactgtgagtagttcttgggtatgtgggagggtggcatgagatgagggcgggcagaggcacttcagtcatgcgccatgttaagatgcttaggtgccattccgctttatcatgtgtttactttttagaaggattacccaggtgacagtgtggaggaggggtagaaggaacaggaatagcggctgggagggtagaaagttactgcaacagtttggttgagattataaggacccaaaatgggacagtgttgtggcaagcctccagggataaggtggaagatggggcatggaataaatagtctcctcctctggcacacagctcctccaaccctcatcatctctgaagtgttaagtacctttttgtatgctggtgagatgactggtggctggggctcctggatagcctctggatgggggctggttgccaagggaaccaaccatgtgattagaggttagaactttcagcccacccctctgaaggaggggagaagggctggagattgacttaatcatacatgaccaatggttttatcagtcatgcctgtggaatgaaggctccctagaaatccctgatctgtggggtagggtttggagagctgctggttggtgagcatgtggaggtgccggggcgtgggggagtggcgctctccgagagggcacagaagctcctcaccccttccccgtaccttgccctgtgcatctcttccatctggctgctgttcttgagttgtatcctttatcataaatgaataaacttaaaagtatttccttgagttctgtgagccattctagaaaataattgaacctcagggtcatgggaacctatgatttatagccccactatcagaagcatctgaagaggggcagtcttgtgggactgagcccttaatctgtgcggtctgacctatctccaggtagatggtatcagaattacatcgaaatacacagcatcaattggtgttctgagttggagaattagttggtgtgggaaaaacacccagacatgcgatgtcagaagtaaactattgagagtggtgtgagcatagagaaaaataggttgtttttctcctatacactcttgcagttatcttccttgcagtgatgattgcaaccctttctcatattagacaaaattattttccctacatttcttatgtgttttgctattctctttatatcctatgttcttctacaagccagactctgataagggtgctatgccatgaaaattaatgcagtgtctggagcatggactggtagactagaggaatgacctggaaatatcttgtcttcatttcagcaaatgatatgatttgggtctatgtccctgcccaaatctcatgttaaatagtaatcctgtgaccgggcacagtggctcaggcctataatcccagcactttggaaggctgaggcaggtggatcacctgaggtcaggagttcaagaccagcctggacaacctggtgaaaccctgtctctactaaaaatacaaaaattagccgggcctgatggtggacgcctgtaatcccagctacttgggaggctgaggcaggagaatcaattgaacccgtgaggtggaggttgcaatgagccaagatcatgccattgcactccagcctgggcgacagagcgagactccatctaaaaaaaaaaaaaaattgtaatcccagctgggtgtggtggcttacacctgtaatcccagcactttgggaggccgaggtgggtggatcacctgaggtcaggagtttgagaccagccttgccaacatggtgaaacccgtctttactaataatacaaaaattagccggatgtggtggcacacgcctgtaatcccagctactcgggaggctaaggcagaataatctcttgaacctgggaggtggaggttgcagtgagccgagatcgcaccattgcacttcagcctgggtgacaagagcaagactccatctcaaaaaataataaataaaataaaataaattgtaatccccagtgttggaagtggggcctggtagtaggaggtgattagatcatggggatgggaagatttcctcttttgtgctgttctcgtcatagtgagtgatttaccacgagatctggttatttaaaagtatgtagcacctacccactccctctcttcctcctgctcctgccatataagtcacgcctgcttcctcttcaccttccaccatgattgtaagtttcctgaggcctcccagccatgcttcctgtacagcctgtggaaccatgagccaattaaacctcttttctttgtaaattacccagtcccaggtatttttttatagcagtgtgagaatggactaatgcagcagggttcttggcgggttgtagcatgatgcccttacaaagatgaggaaggttctgtgaggtcccttggtagttggctgaacaacctggaaccccagcaaggactgctaatgtgctcaggttagtgtgggagtgtacgtatgagtcacagacttcagccttgtcttggtcaacctctcagggatttagatgaaagtgcagaaggtgtgctataaaatttaattatttatagctaataaaataaggatttttacatggtctcttcagacttgaaatatgggtctgaagaataactataagactttgcatttattttgggagaattatgggtataaggataggatagaaaagcctcgaactggtgaaaagaccttggggggttaggtaccatcatctctaccatccttcctggtgtgagtgaccactgtttctcacctgaattattccggaagtctactaatgatctcctgctttttgtctccccttagactcaacatagcagccagagccatcctgcgaaaacatttggtagatgtttcaatagtccttacaacggtctacaaggtcctgttgggcctactggtctcctctgggacctgtgtcctaccaaccttgcctcagccctgtgtcctaccaacctcctctcagccctgtgtccagccacactgacctccttggtcttccttcaccatgtcagaccttacacttgctgcgtctcaactgtgaatgctccttgccctgatgtttgtgtggtttgttctttcgtctcctttaggtctttaacttctcagtgaccttattgtgctcctctggctgtcttattagactttaatctccataagggcagggaattttttctgtcatattctccactgtgtctctccactgtgtctccagcatggagaacaatggagtaggcaggcactccataaatctttgttggctctatgtttaaagcatagattagtttattaggctgttcttgcattgctaaaaagaaatacttgagactgggcaatttataagaaaagaggtttaattggctcatggttctgcaagctgtacaggaagcatagcaccaacatctgcttctggggagacctcaggatgcttttacttatggaggaagatgaagcaggtgcaggcacttacacatggcaaaagcaggagcaagagagagaacgtgtgtcgggggaggtgccacacacttttaaatgagcagatctcacgtgaactcaagacgagagttcacttattaccaaggggatggcctaagccattcatggggggatctgcccccatgatccaaacacctcccaccaggccccatgtgaaacgttgggggttaccattcaacatgagatttaggtggggacaaatatgcaaactatatcaattagtaaatatgagatcatagcagggttcagctgatgccaaagctaatgtggatgcttcatgcagtgttcacatatatagagaaagagatttattataggaattgtctcatgcaattatagaggctaagaagtccaaaatctgcagagccagtgccccagttccagttcgaaggcctgtaggctgctgtagcaccgggaagagctgatgttccagtttgaaagccatcaggtagaattcttacttgtgagagagtcagctttttgttctattcaggccttcaactgattggatgaacccatacatgtcagggagagaaatctgccctactcaatgtactaacatttaaatctcatccaaatgcatcctcaccaaaatacccagaataatgtttggccaaatatctgggcacctgtggcccagtcaagttgacacataaaatgaaccatcacagtatgcttctcagaccatacctggagaccttgaatcttgtcccgacaccgtctttcagagactatcctgttgacgctctgacaaccagggtatctggggcagaactgaagaagctaggggtgttgccctgaaaaagcaaacatgtgattgaggtcagatgacacctttaaacacctgaagtcttgtctcatggaagaaagacgaaggaattctttgttctagtaggcatggctcagactagtgtataaaaaatgaatctaacagaacagaaatctgctgtcttgggagctagtgaggtcttctttctggaagggtgcaagcagaggccagctgtgaccaggagtcagaagtcttaagttctggtctgggcctggtgcatgactctctggccttgggtaggccattagactctctgaggtttccgcttttctgctgtagaggtcaccgtagcctgcctcacagttccgcaaatcagatggaaataacatctgaacaataccttctaaaacaacaccttctaaaactcagctgtagccttgtcagggtcaggagagctggcagtcaggaggggagtgctagctcactccttgctgaagctgaaaatttccactgacctgcagtcagggacacctcactgcagctttgctttcttcttattggaatgtgcctgaggagtggcagttaactccagttccaaattcctcagccctgagtgtatgaagcttattgctgctggcccgtgaggacaacaatgcctggagggagcagagggagttgttcctcctccacgaatcagccccatcaccagcttcatcacggcatcgctctttaattacttcaggacacaattcggagttgccgttgatatcttctgtatttgtgctgtttgctttcttgcctctggaatgcaccagtgtgacatcccgctttccgctctgaaaaatgtactctgtgtataatgtatatagggttgctctagtttatggccacaacatgaatgagaaacaagaagcagaacatccagggtttctcgtctaaacattcagaactgtgctggcagtgggacaaaggcctctggactgttgtgggttttggtgacagccttgataaaaatgcctttttagtacaagtgaaaggaagattttactacagtgcaaaagtcaaaaaattagataaacattgttggaagttcagtgttgatgagtagctaagcctcagagaagttacacttaggtgggcatggttattttttggcaggaaaatgacctaggatttttttcttattcaggcgacgtcaaaacaaggttagagctacatgttcccctctggttttgtttataactggcatcaggacattcagaaatgatcgtgactacacttgacagcactgatacgtagtaagtgtgcagtcagtggtagctgttgtgagtagaaatggtttacaccgagtttattannnnnnnnnnnnnnnnnnnngtttacaccgagtttattagtgattaattcagggcttccacagagccctgtgtagttctacacagctaccactgactgcacacttactacgtatcagtgctgtcaagtgtagtcacgatcatttctgaatgtcctgatgccagttataaacaaaaccagagtggaacatgtagctctgtaccatctgtgtggcccgggcatcaggatatctagaaacttttcaggtgattctagttttcagcttgcaacattagtaggtcatggaatcaattaattgaagtacttttttttgccagcgtttttagaagatacgtttatataattgtatagaaaatattaatgcctagcacagtagctgggaaaatataattttgtgtgtgttaaaaatgctgctgtgatagaaccactaataaaatccctgccctcgacttgcttcttagtcttacttcagaaactgcatgcttttcgttatgaataaatggttcatgtgaaatttaatacaagacatttatagttctatgacctgagaatttgtgagccttcttgcccacattttgaggtttcactctgacattgaaaaaatcagttattttataaatgctagccaacaaaaatggcatgcatattttcaccagcaactaaatttgattatagcacagcaacaagatgatgattttcctcctttggatgtgttaattacacatataccatgatatgctaggtcagcagtggtctaaatacattcagcaagaatgaggtacttgcatacgtcatcctgaaagttttattagatcagtttaacagcctcttgacttcattatctatgggaatttgggggtcttacacaataaactgttacaaacattcatctcactcttatgaaatagagcaatgtgatagaaaggctggcaacctttggccatttttatctcagtgctgaggtgaacataaaccaagaggactctcgctgtttccctattgtgatgactctgttggcagatgctgcaactgtggaagacctgaaagtcgtgatcagttgctagcaggactttgggatcacttgtcttgatcctgaagctttttataagcccacgagaacattcatcaaggcttcccacttgacttgaaatacattcattgtaagattggtcttcaatttagatttcttggaaatagcagtgataattcttacgattactcaatgtgcaatgcagtccgtcctcacaaggttctttcagagttcagagggacatcctgcattggtagttttgcctttgtctgggaggactaggcttgggattattccttgaatccgctgcttaaaaacgctgatctgcttgtataacaaagggaagaggttcgatttacaagcacttcgatttgagaagtactttctctaattatgattcagctccggtgactgcaccatgttaaatacgcaattctctttcctctaggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaaggtaaattttatgtggcttcagttaatgactgatttatgacaggcaattgttttcttttctgaaaccaggtggttagggcaaggaatcacagaattacagaatgttggacctggaagggacctgaggggtcatttggccccaggcctctccaccgccccccatattccctcccttcttttttcctcctggggaagcaggcctggttatggccaagtgaaacacagggaggagcagggggagagaggagaaggttgttgtgtgggatttagaagacacccatgcacagaagtcaaaaaaagtaagtggaggtgagaagctgagggtgtgggaaggaggtgatgactgatggagtggaagagctggcagaatgaatgggtcagcaggtggcttcctcttacctgtgttctgcaaacgtttgaagcctgtgtcagtttgtggtgctgagacataggttacattttggacaatagcaaaggaaaagtatttaaatatatttttagtacaaatgactattacaaggacaaattattggagaaaagaagtgtagggtcttgataagagattgcctatttaaatttccttgcattgcaaagggatagaaatatccagaaacccagttttgaaagccttttttaaaacaaaaacaaaaacaaaaaaccttctctttctttctcattctttcattctttcattcttttcctccctccctccctccctccctctctccctcccttccttccttcaacagggtcttgctctgttgcccaggctggagtgcagtggtgcgatcagtgctcactgcagcctcaacctgcagggctcaagtgattctcctgcttcagtctcccaagaagctgggactacaggcatatgccatcatacctggctaatttttacaattttttgtagacacaggtcttgctgtgttgcccaggctggttttgaactgctggttaagagatcctcctcccttgttctctcaaagtgctgggattacaggcatgagccaccgcacctggccagacctttttttaaaagtcattattttcagttgagtatatttggaacccccataagttactaggaaataactcttgtgaatgggtccttgttatagctggctgattgtgtgaacactgcgtttaaggtcttcagcatccagctgctttctgttaaattctacagcagctgtcacctcctcatagacaagacagggaagggtgggttagtgaacacttgatcccaactcttatttggatctgggctgctttaaagtgtgtgagagacagaggcaggaaaggtggacgtggacgtcggagaggatgctacgtgcagaagccatttcaggggccttcacgtgcatcccacttaaccccacagtaaccccaggaggaagatgtcatttccaccattttacagagggcttagtggagggctaagtgaacctgctcacatccaagttactaacaagtgacaaagccagaacacaaacccaggcttcctgactcttgagtttaatgcttgttgcctgagctgtactttaagtcctagccaaataagcataactcaaaaagggaagtggtccacctggatgaacatccttgtttagttgaggcagagagaaggggacttagaggagggctgggctcaaaaagtctaagtttgtttctgtactctcatgataggtagctaataacagaggtcaaatcccattgagacaaaatgaaaaatttcttttaataaagactctaagccctggccagcgggccgcgtttctgaagcagaattctagtagcatgaaagaatgttgattaccccttggaatttgttagaataagaaaatttgttataataacatttagaatgttggactgtgttctctcggcagtgcatgagcttctttctaagcacagtagtcacttaccctgagagccacgggttgtcacttaactggttcagcctgtgcacactgggtaggggaagccaacttaaaggaccttgtgtctggtgcagtaaaaactgttaactccttggtaacaccttcggaacccctgaaacttgactccagccaccagttgagtatgagtcaccgggccatgccgtggagagaggagcagtagggaaaggaggttccttggtgaggtcagtggaccataaagtgatatgtttatcaccacggctcagactgcactgagcaagcttcatcccccacttcccagaatccgacctggctctacctttcttgtacccagcgatcgcaggccatgaggcctggttgctctaacccgagcagttctcagagtgtggtttttgccccagcagcatccgcatcacttggggacttgatggaaatgccagttctcaggcccaacccagaccaactgaatcaggaactctgggggtgggacccagcagtcagtgtttcaatcagccctttaggagatctgatgcttgctgacgtttgggaactgctctcatctatatacccagaatgaaagaatttaagagttttgctcttatcccagctggtcttgctgcgaggcttcaagcaacattgacttaccaccagagcctcagtttccacagcaggaaaatgaggtgtttgcattaccccccaggttcattcctgctctcagagtatatccttctgtgtctcaaagtcatttgtcaatctttccctaaaatacaaataagcatgtgactccccctgcccccaaacttgccaggtttctacccgggaattcccctttgtggtttcctttctacttggcactcggtataagttttgatgccaggcattcggaaagtcattggggagcgggggagaaaccacacacaacaaaagtggtcagcttattcaacttagtgacaatggcttctgggactagagcccttaataacatcaacttttgaacaattagacctttcctagtggcttcacatgagtgaatattttgttatttgtctcaaatctcacatcattgtttgttaattcaggaaacctataccatatgcccactatgtgccagatacaagccaggcacacctatgaactggatatgccggccacaatcccaggagggccctagtctcttgagttccagactgtcctgtccctggcccatagacgctctttcttaattaaatttcaaccttgccgttccaatatcattttccatcctgtgatgtgggggaggcatccgcagggctgcagctgcacggtgtgcatacctcatttgctcatctggcaaaaccctcagcagatgtggagggaggctgctctagcagcctgagtcagtggagccttgagcttttctctctgagggggaggggaattagaggagactgcagagtgcaaacccaatgctctctcgcaacgagccgacaaacagaggctttggtcccctttgttctggggtggtgctgggggtgctgtggtggccagagccatgatgccccagtgtgtgctgcggacctcagcacaagggaggttgcacaagtggggagggggagggacagtatcaacccagtcttgggaccccctggttggattccttactccaaagtgagacttccatgtggacttgaaccctggcatcctgtcctcaaaatggaaaaggcagaagtctgttttatagtagtgccaggcctctgattaattatcccttctgaaaaaagcatgctacacctagaacttccttgacactggtcccagctgtcacactgccagcagtttctttcaagttctgttgaaatatttaagcccgtggatggaaatcccatcagccgccgtgctgtgtaaatggcatgtgccgttgtgggagtgtcttcagattctggtacttgcatcactttcccgggtggaggtggtgagcaactctcagcacagtgagataatgtttgcgaaagcactttgtaaactgtaaagtgccatataaacttgagttgtctgtgttcagattgtgagaaagagtgaaagtctgccttctttatttcccccaaattcctacctttcatcttcagagtataaagtgctgtgaggaatacatatgagggaaagattaattctacatggggtgtcggaggattaattaggtggttgcttctcctgatagttgaaataacaaatatccaaggaggagtgcatttggggatagaatggattgaatgttaaatacgctgaccatgaaatacataagtattggatttttagataggagatgcttggtagacagatgacagtataagtcaactgctcagaaaaggagtcatgatctaggtacaggttgaaaccatgggagtgattgagatcacctagaaaaagaatgagatagaaaggggattgaggaaggagctgagaagttcttagccttggtttatattggaatctactacgagcttttcaaaaaagaaagctccctaggccccgcctgggtgttctgaatcagattctctgggttggggtctatacagattctgagcagaggaggaaccagtggaagagatgtgaaagataggtcagaggaaacagacgaggacaggaagtatcacagagaacatgcaaggagaagatttagccaaaagaggcccctagttgggggctagtcaataggcggtcactggtgaccataacaggatgcatttcagggcagtggttgcggacttcacagacgaagaaccatcctttgagctcgtggttccctgtgtctgccatttgctcagtttcactgtcaccctccttcctttgaatctggttaccgagtacctcagtggtttgacagattgtcctgtgcctctttcagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacaggtaagtgagtctaagtgtgtgagtgtgacaagagatgaaagtaaagatcttccttgacttgaggcagggagaggtgtagcccgtcctacaccctcccctacgcaggagggaagggagccattgatgcttcacgcaggagggaaggtagccattgatgcttcaggtgtgcttcatcagatgtgtttcacagaagctttgaagaacagagtaaaggcaccagtggtatattttatattctgcatctgtccctagatcccagatatttcagatgaattcctgaagcctgttccaaacttctgggtgttaattacaggacacagtcactcttccttcatctttatcacctctgactaaggttatccctgataggaaaattacaaaatatgccctattaatataattatcatcttagtaaccttctgtttttaataaagctctgtttgtggtgtccttagagcgcttaggcactcagagctgtttgcgttaaatctgtgtgtgtgtgtgtgtgtgtgtgtgtgtgtatgcgcatgcacgtgtgtggtggagtggctcttcatggtgccataccaaagagccattcgatagaacttgcctctcccttgtgtgcttggtgtgtgtgtgtgtgtgtgtgtgtgtgtgtgtgtgtgtgtgtgtgtatgctggagtggccctccatggtgacatacgaaagagccattcgatagcgcttgcctctcccttgtgtgcttggtgtgtgtgtgtgtgtgtgtgtgtgtgtgtgtgtgtgtatgctggagtggcccttcatggtgacataccaaaaagccattcgatagaacttgcctctcccttgtgcgcttgttctccctctcagcttcctacccctggattggaaattcgaccctccctatcaagaataattagggaattaaagaaaaaggagaaaaagtaggttcttttcccacatgagcctgcatttcaccctccttcctttgcatctggactagtgacttgaaaatttaaatgtatattgtagagggatttcgaggtgaaaatgctaatcggggtttgactttcaaagcgtgtaagctacagatcgttttgataagattccactctggccacttgaagaattttgtagaaagtgaaaagggaatgggaataggagcagtctggtgaatgtgcttcgacgtcaggcctgaggcttcattggagtataccatgcattttatgctttacaagtgtgtaaagctgagatggaaagaaagactgttcccttaaattcagaatgacagggatgttattgtttagtaaaaaattctcttttttacgaattcttagaagtttgggttgtgttcatcaattttccagtaatcacttggttgaccatctgttttctttattttaataaccttatatccagaagtttgggaaagtaaatgcagatacgattctgtagcaattgttaatgacttaagcaaaccttatataaatcaagaaattctttagccttttgtctcttattttactctgaagtttcctaatttttttttttaccaccatgcttcccttatcccaacaccccgcccccaactcaccaaactgccacctacttcagttttgaaggaatttgagcatattagccaaatgggaatcctgtacgtcgaaggtgttgaaggttgaaaaagcaacaatactgcttcaaaagtaaactcttctggttcgttcaagtccacttcaaacagtggctgcattaagtaaccacctcttttccatcaaagaagagaaaaactttagtgactaattatcagcaagcatatgtttctattgttatgtaaaacaattttgttatgtgtgcagtaacaatctgttttgcacatgtcattggcctgggatcaactccagctttttaatcaactggccagacactagaaacatgaagacttggaagaggggagatagttgcaactttctggcatgtaggtcttaactttgcctttgtcttccattcacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgtaagttggtggagcatgtcttttgttttgtttagataaatgacaacaatttaagctgtactttataagtgttatttttaaagttcctgcctctttggactctctaagctctgtcaattatttttcactttgcaaaatagcatgctcctataaaataggtgcggttgttcaaacatggccttggattaagacggacccaggtctgagtccaggtaatcccactgtgacctttggcaagtcccctaacctctctgaaccccagctccctcatttgtgaaattcctgaaatacattagtatgctttccactaatagtaagtgtaaagtaatgaacacaattaagccttcatattgagcatcccacaaggacctcagtgtcatagtaccgaatatcagcttttattttggagttaggtacttagagaaagtatggactattaggctgaccccagctcacatcattgacttttctttttgagttaaatacgaaatattggcatgtctttttgcttgcttccaactcctaagtgtgaaacactgatagaagaatcacagtaagtgcgaagtcagtgaaatgatgctggacaagtctactccagcttgttcccaaggccctctatttaatagagatgtacgcacaaggcttagcccattggcatgatgggcaaacagcagctggtttcctcaaaagttgaatgttgaaacttggtaaagtaaatcttatctcaaatatgcttaggcaataactatttgactgaattatattgaaagttaaagaaaaatcctcctccctattttttaagaagataattatctctttagtatctcttctatgggctcaaattttttttttttttttttttttttttggccaatctctcttttagttcctgcactgagtaagctgaagtgggttttatgttttcagtattttgggagagggatgcccttggttttggtattattcattcattcatggcaccttccatgtgataccacagtgagcaaagccaacagttcccttggcaacgtcatgtaaaagcactcaccagaggcagcaggcaaaaccactagcacacatattttaattttaaagtaatcgtttctggttcccgtgggttttttttttttttataactttgctaggatcccagtgagccatcatatgtaatggtgatacattaatttgttgtcaagcccaaagcctagccatgatctgaagtcagagatgttttgattgccttctctggcatggcatgaggggtgttggtgacctaggctgtctgctgcttttgctgcctggcacaccggccaaatgtttttaatttcagaataacaaaaacaggaaagggaatcatgctttgaaaggcaaaaacatacggtacattttaattccctgctggagttcttgtgtaaatattctttcagccttgacccttcgatggctctttccctgagtatgtgtgcctggtccatggcagtcctggagttcactttgaatgtccccatctctcatatgaatcagaaaggctagaaatgagattgctcatcccagtgcaagatctgtttatgttcctctccttggctgtacgcttgttccaggccaattttggacaatgcatgacaacattactaaacaattaggtaatgtttcatgatgttcttttttattctcccaaccagtttatgctttgtgattttctaattccctgtttcagatgtgaattctgactgtgctgtgagggaaaggtacctgctcccacaaaagtttaaattactatttagaaagggggcaatggtttatagaaaccttgtttctagtatttcctttagagacagcatagtgaaattgaaagaatcttgactttgtgccagacagggctagatttaaatcccatttccaattactactcctagtagatgttgtgcagtctgactgatgaacacggagtctgtttggtcacctgtgaaatgggtatgatgatagtactcaccttgagtttgtggttcattagctgagttcatttgtttgttcatttatttgccaaatacttgttaagggcctataggatatttcacctaaagcactggacacagggcctgcacatgtaagttctcagctacatgtgttgcttctgtgagtcttaggttctccttctctaacaggaatggtaatgcctatctccttatattttggaagagaaataagataatatatgcctagcagagtgcctgccataaaaagggggttcatcttccttccataaataactctttcagagtgtctataggaacaattagggcacttctctatacaaggtgaaaagaaagaaagatgtctactaagggaattgtaaggagtctgatggagtaatttaaagaagagcaccattaaatatggatgtcttatgcatgtgtgtgtcgggggtggggcatgggcagaatgtgtcctccagatggcaaaatggtcaaaagaggtgcaaagagccaggcagtgggcaagaatgggaacattggaggtgtctacattgccttgtccagctctggctcttttctcaggtcctgtgtggaccatgcataatcacttttatggtaggaagaacctctaaaacataaaaaaatagatggaggaaacctgttagaggtttcctcttatattatttcatgtggcctcaggacttcagggttgatgatgggcagcttgttcttagagaatacatttttaaaaatctcagtgggcatatgcactatgctctctggccattcccttccttagtcctccctcccctataccatcagtccagatgtaaatatgggggagtgtggaggcacttagacttaactccttatctttcatgaagatatggctgggaaagatggtggtggtttttggagacctccttgtacacctgcatttggcgtagctccactaaagctggaaaaagcctagggacttccagaagtacagtgtgagaatttgctcaaagctgggaaccaacttgtctgccattgtcccaagccttgctgctttacaaatgtgtagatagatgttgagtcttttaagttcccagacataatcaaaatgagatgtattgacagctcctagatttaatgtggaaaggtgcaaacagctcattccacattggtgcaaaaggacaggtggcagttatgatgatagtgttctggaaatacgatattttctcagctgtccaacaacatgaaagagactagggcagatgagggcaagcagtgttgtttaggccaattgttgtgattccagccaatcaaaatgacatgtagctctaaaaggctggaagaagctgtacctaagaaactactgttgactgaatgcataaaaagttctaagaataaattggatctttcatgatctcattttagctctttccttccttccttcctctttgtttctttcctccctagcccttctttaccctaaggagtttttttctgaattggagtaagagctaaaatattctgaatctattaaactgagtttacaaatggccgcagaagttggttaaagttctgtctggttcctttgcatatagaatttgtgactggtgagtctggcagtattcccacacataagcactttaggtaatagaaaaatatactgaatgagatcctttaagatttgagttgaaatatatgtggcttcagccaatatcccacaaccacataggccaagagaacttagagcctgtgaatcttttagggttttacagtgggaaaggattaatatttagtcatgttaggggcaaacagaatgggaaacaaatgaggaatttaggaaaaatgctgcatgcatgcaggagaaaatcactgggcatggaaattaaagtgatttttatacagcacgaaaatggtgtaatctgcatgctggaagggctttccagccctgttggtgcagttgttgaaaatatggtaccttccctttggggtcccctctgcagcatttagctctctcaccctctgagaagagcactgccacaggagtcagcaactgatgtataaatttaccttccatgtccttgttgaataacctggttgagtagagtccatttatatcctttcccaaaaatatttctgtcattttaattttgtaattgattatccagtgaaagctagtcttttttttttttttttttttttttttttaaggcagggtctccctctgtcacccaggctagagtgcagtggcatgactatagcttactgcaacctctaactcacgggctcaggtgatcctcccacctcagcctcctgagtagctgggactgcaggcaaatgccaccatgcctggctaattttaaaatttttgtagagatgggatcttcctgtgttacccaagctcgtctcaaactcttgggctcaagcagtccttccgcctcagcctccccaaatgctagtattataggtgtgaagtattgcacccatccctgaaagctaatcttaagacctacttgtattactggataaaacagtgatacttaaggggagagtaacctaaattaattaattaatatttagaatagaagatacaagtatattcagttagtagaattggcaaatgaatacagttatagaattactaattgatcatacattttagatgaaatataaacattggttgttttaccatgtggaatttaatagtttatatagatgggatagtctccacactgaagtacagtcttgagcatataatatggttcagtcagtgagggaccacatatacgacagtggtcttatcagattgtaataccatatttttactgtaccttttctatgtttagatgcacaaataccgaccatcatgttactactgcctacagtattcagtgcagtaacatgctgtgcaggtttgtagcctaggagcagtaggctgtaccatatagcctaggtgtgtagtaggctctaccatgtaggtttgtgtaagtgcactctatgatgctcacacaatgactaaatcacctaatgatgcatttctcaggacatatctccattgttaagtggctgtaagtgattgtgctatctttcattgaaatctaggggaataggaagtggaagcatgggaatttgagggcaatataacatgtctgtttgtatactttatatgtcattttaagtaaaaaaagggaaagtttattatacatatgtactgtgtgtgttaataatttaaacattagactaactgtacagttatagactaggcatacttagtatgtaactacttacatgtcattggatgattttttttatcagcataggcaatacaaatagtatgatcaagcagcatacgtagatgtcttttagtcggctattaaaggtttttcacatcatcgttcttagcccaaggaaaacaggggtcaaaagaataaataattccctcatatacaatatagaatctacttatttaagatatttaatttttattatctaaagtactgtttaattttagactcatgagtgatttttttgctatatcttcaggctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatggtaagttagaagttttttaagttatgtaaaaaataccccccaaatgaagcttttccagtgaggaactgtcatttcagcttatatgttgctgtttttctcttgtacattttaataatttgactactttttatcagaaggcttaaaattacctagacagagattttgaggaaactgtaatacagattttcagtgacatagagttgaatgcatattcagagaactttgttataggttatctttagtgtgattacattaggttcttctctccgagacacctaatgaccacttatggctgagaatacagaagagttaagactgcaggaaagaagttcatggtaaaaggctgtatcttttaggaaaatagtcacgaggactcatacttgagtgttcatacccagaggatggcaggagttactaccccagctgaatggggtggaaagcagagggtcaacaaattcttgaggttttctggagtcttctagctagcatgacttgaaaccctagttttctgatccctagacctgttcctcagctcatggtaccaccactgagtgaaatgccaatagaataaggattaggagtacaggttcaagccccagctctaccatttagtcactgtttggggagaagttgcttcacctctgagccacagatttttcttcagtaataaggggaaaataataggacagaccttacagggttgttgtgaaggttttcgtgaaagtacaaattaaaaaccctacaaagctatgacttattttggacccttacagctctagcgtcctttccaaagaatattattaaaggagagataatgtccaactatcatcttcacttccagcttccactgagatggatttgacctcaagtgtacatcagttggccttagatagtagatataaagaatactggggaaattattatttttttagttgttagaaatacgacaaaatattgagtattgattgtatggaaatacgtctctccctttgaaggaataaatgtatctatgcagctatttcttatctttcaagggaatatgttccaaaaggccaaggtgcccagatacctgttaaaatttagctgtcaaaaagaaggtggtgaagtaattttaacataccaatattgtttcaagacatcattagagaaattattcaaaagactctcttgattcaaggaaagtattttagtggcatttcaatggaatattattgcatcatgtaacttaaatcacagatttttctagcttggacagccttagaaactgtctattccattggttctcagtcttaggtgcacattgcagttacacatggagagactaaaacatattaatgattgggtaccaccccagagagtctgagtttaaattgtttggggtacaacctgggcgtaggaatattttttaaagctcccaagtgattttcatgtgtagccaaagttaagaaccactgatcatttccaaccacttaatttaaaaaattggaaaagcaaatttgaggcacagagaagcaagccgcttgcctaaagccactgagctagttagagagaacaccaggactagaattcaggcttctagacttctaatgacctttatgcactgcttattaaaagtcattttacacctgcccattctatgctaattcctcctgttctgcctgtaatgatgttggttgtggcctggcatcaaacactgctgatgttttgccttcttctttcaccagcagaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggtcggtgcagctgattacaggagggaagagaggctacctcctttcccatctggccctagtctgcatctgtaatttctccctatctctttcatttttgaactccggaggcttgatactgttttctcagttggatgggcctacttccccttggctgtgattctcacctggttcctgttgttctcagtgacagggggtgggggttccagatccttgtgtgtcaatattttgctattgaatttccaaggccaacagatactacccttgagctgttgagaggtgggcagctgggaagagatacttggggaaggggcacgatgcaggcctctcatcgcctgtccttggaagaccaggcaattgtcaattgtgtcaattatacaacagaactgcctgtgggcctccaaccatgtctttggtggttgttgttttaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccgtgagtgttttccagaacaaagctttgccctttgccagagcctggctgtgtgctcccttaaagttagtcttaacatttctttgaagatgaagagggttttcaccccaggcctgaagaaagccaagtgtcagttctcaacaaaatggatgtactttgaccctgagctctttggttttatttgttttattggtgagtctttgggaattggaaggcctgttttctcaccccccgtttccgtctcctgatgacaaaggctgcactgtcaaggtgattatgacttctctcagtgcccaagctcaactggcccttataaggataaaattttaaggccctgggctatatgaacgagcagcacctctgcacagccgggttaaccagatgtgtggtctctctggcctcatttgagtctcgtccagaagtaggagaacttctccctccttcatgaataaaaatccaaaaagagaatttaaaactcaaaaaggacctttaaggaattattaagtctctctccacctctaagaaagaccatacattgaagaaactctcctacttttgaagttacttggagaaagattccacagatttcccccaatgataaaccgttgcaatagctaagctgcattttccagaaatctttcttctcagttggtcaaaatcttttcagattaaacccattctcttgggtgcagagactaggcagtgaatattaaaagaatttaaaatgtgaagttccaaaagaactttaaagtgctgattttgcattttgggttttacttttaatggtaaaaataaggctcagagatccctgtgtccacctttgacacagggtgggttggggtgggagggggggtgtcttcttagtgccatatccagctttgacatggggtggctgagctgtggctgctagttcgaccccatccagagaagagaggctagcaatcaggtgctctggtcagcgtggttcctgtgggaagtgactctcccatgaacccaagcatattgttcctcagagaatattagactgttggagcagcaaataaccctaagatgagcttattcagcttcttcatttcacaggtgaggaaactgaactccaagaagttaaaaagacttgcttttttaaactccagggatgggctaatggcagagccaggacgactgaatccaacttcctgacctcttgtccactaatctttcctagacaccaggctaggccctgctaatctccttttgttactcaaataattaatttattaacctttgacctcctgataattgcagcatgaattttcgttcagttatccagtgtctacagatataatgaatgtcatatattactgaaatacttgattatggcattttaaaactggggtccaagttaacaccaaaagtggctacagtaatatgtctgttaagaaaaaataaaaaaaaaaaaaagtcagttgcttcaggagagaaaggcatgtaatgatcccttaaagttcctttttttctcacatatttttcttttctttattatgatctttgagtttagcaatatcctagatgcttcctttaattggcgtcagtactttctttggaggacctggtacagagagaaaggcagtttgttttttttttttaattttcttcccatcctactccctttggagactgttttagctgttctcaccaattataattgtttgtagtaattttcagacttactatatatttctattttgcatcatgttcagaatccaagcatgtgaagcaaaagaaattaggatttcatttatggcgtcatgacccttgggtgaattttctcatcctatttagaaataatccaggaatcataatttcaacctatgtcaagatagattccgggaatatatctgcaggtggatagcgaaaaaggtggaaaaaaaagattcctggaataaaacgtattcttttccacatccatacaccatagagaaagatttcttagggaagaaatgagcaaaagttagaggggtacaagagcggcaatgaagagatgtgctccatagtaaacattaggtccttcgctgctgactccaaccaaactttctacaactcttaaaggatatatataaccaaacattaggtccttcgctgctgactccaaccaaactttctacaactcttaaaggatatatataaccaaagcttcttgtattcgccaactgctagtagttcttagagtttataatataaagactcttaaggggaagccccttctcacggtataggcaagtctcttgacaactccattcaactccattctagtatctagtgttttcccaccatttgaaatcatttgtaattattcaatatggttacaacataaatatttatttttcacaagagaagatacaaatattagtttagcttttaacttgaacctgcattgggtttctccttattcttcatcactttgaagatataattcgaaaaagcctggatgttattttattattttgtcttaaagtcagattttcaatttgcatcagaatgattacatgagtgtttgtgtgaggcagaaccaaacacacatggtttggtgtttttataacattggctgtgctttctttgccttttagattgtgatacaggttccagcccttggggacagtagtggttggccagatggttatgaagatctggagtcaggtgataatggatttccgggagatatggatgaaggagatgcttccctgttcacccgacctgaaatcgtggtggtatgtgtttgttatcagtagggggtttgtggaaaatgctgtctattttgttggctttagttagggactatctgaaaataaaatcagatgttaaaagccaaagctcatgaagctacagggccttcatccttcatatgactgtcattaatcttcctgtgggttgttatttccagtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtgagacctgaaagttagccttgaccttttaggttagtgctgggctatagttccttagacatcagctaaaataccctgtacagacctcttcctgtcctacctcacagaccttcaacaggtctgatgagggattggctcagagaacgcttccagactgacttctgaccaaagcaggaaatttcaagatttaatacattatgctaagtgaagacagtattttgtagatgaatgttaacaaaaaaaaaaattggcaagtgtgaattctactggtaaagccctgtcctttgcttttggaacagtagttcagtagttgcagtgttagagttaaccatggaatatttcaaaaccacctcatatgttatcttttatttctttttttttccctgcacagtccccttagcccccagcagggcagccaaatccctgtgggtccatgccgccactgaaactgacttgttatcttttaaattgcactcacttttaagtgaaatgctatgtgctattataactcatgacatttttttttctagatcatgatctgagtatctgtataaacttatttaaactatttcctatatataatgttaataatcatgtgcaacctaaatctggaatctggagtgactacacaatattaggcagtggcggtaataatgaaataacaacatctaacatttgctgcagatttattatgtgccaaacagagttgtaagtattgcagcagttagttaactctttagagccatcctataagggaggctaataatatcttcattttatggatgagaaaattgaggcacaaatttgtctgaggccacacagctggtactagtggagttcagattcagtgctcataggccgtgtgactccagagctctgactgatcttcgctggatacgactatcacttatctccaaagtgccatttgaaaggggagaaaacataacgtcttatcaatgcaaacatccaggttcagagagtggattctagaaaagataaatgtccttatggcaccaggatgtctgctgtttcttgtgccctgggtacaacctttcatgtttcaaccttagtgtttcaagtgggcatatcatctgttggtcttatgggaaggtcctcatctaatgagctggttttggtgctcagctgcaagctcagcttcatagtgggaggggtgagaagcttaaagggtcaaagtggggtacttccatatgttaaaagtgactttggtgcacgtgtttctgttttggaaagacacataactctcacattcgcactgactctgggacagagcccgctggcgctagatgttgttttccttgatcatatggattctgcccctcccccattctgagagttctctttctttgagcacaccttctttctccattggggaaaatatactgccttctacatgcttttcctaagccaagatggctgtttttctcttgcttttctggctgtacagttcacatgggcagttggtcaacagcaccctattgcgctgtggatttcaggggtgctgcataattgcagattgttcttttccaaatctatgcctggctttgctgatttatgctaatcagtggtcaatcttcctcctgtaccttaccctggatattttgggttttttcccccatccttcaaatgctggcttacttgaagtgtgttattggtagttttttttttccattcttgttttcccatttataccttttcatatatcacctatatttctcatagtttatcctctattccctctacaccatacagtccctttcataatccaagttaacagtgttgccacctgttcattggtcatctccaggtgactgttggtcacataatggcagttttcttttggttcatttgtcttggggaatttacaaacccagttgttaataacccaaaattttaaatctagaatactactattactaataggtagcatttattgacactctgggaactgtgttgtttgcatgtaacttttactttgctagttttcacaattatgatatcttgtgggtattcgtgttctcattctgtaggtgagtaaactgagtctcggtgcccagcacgtgagcaggagagcatgtaatttttatgagctcgtctcactacaaagcccgtagtccttctcctactcacttctggtctaaaagtaaaatcctttttagtaaaagatttgctgataatttatatatataaactatatatacataaaatatattaaaaaataatatatattttttccctctgctacaaaggtatccctttttgggataccttagacattctgccgctacatactttcttttgagattagagaagagatttgcagtccctctgttacacattttggcatgtggtttctgagttcatgttaaacggcagtttttagtaatagcacatatgtaatttgccacctttccaagatagaatatcttgtttttcagaagtattgcaaaaatactgaagtgttagtatttacagaatgtcaccacagtgacattatcagaatcctcttcattagcattttcactgttgagtgtcctgcagttaaccaccacgtaggaatctttcacaacagtgctgcggattcaaagccccatgtgatgtcaggggtttcccctgggtatctcagcgtggaaagtctgtttctatctccatgtcttttgaaatgattctgcggctgttggtctatgggtaaggactagctgtttctacaagtgtttaagtttattttgatcctaaatttagtcaaagaatgaggcatagcagggaggggcagttcatgcagtgatccacgtgtcaccaaatggagaatctcctctggtctggggattttagctaagttcaggatagttgaggtttgaattctgtttacacttggctaaacattacttcctgtttctaaggaaaagaaccttaacaaaatttggacgtagcccatacaagtgttttcaaagggggaagtataaatgagtcggaaacgtttccagattagatttcccctaaactacccctgggcttatggagcgaagggggagtacttggcaaggctgatttggatctgtgagcagctgggacactttaccaggcccatgatggcctccaggttgcaccgtcactgacacccagcgccggagccagctctgccttctcgccgatgaagcaggactctcatcaggcttactctgactttttgcaatttagaagctcagtcttcctgcctaggttaaatagattttgccgctgaactctattttttggtcagtctttaaaaagagcttagcttataagtgttgtactattaaaacattagggactttgcctactggtgttttatttacttcggaaaatccactttaaatgcaaaatatgtttttatttttagctctcagaggactcattgggaggtggaagagacttactcatcttgtatttgaatctaatggactaatatttgaaagaaataattcactgtcatcatctatatcaaattgaagtggaaaatatctttttctttcaacgtgtgtgtgttacttttgtaattagaaagaaggctataactatgttatgaagataaagcagcgtgtcatctgaagggctgtcttggcatatggtccttgtgcctaaagtgaaagtgagatgctaactcatttcctaattcatctttctgttctttcataggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaaggtttgtgggccttcatccattcggatggttattttggcatttttaggtgaggcagaaaagtttaatcccaaggtcttgcaggttgaggttttttgttttggaactgcccaactgaaatattaaagtcactattagcagggaactgtgagttttatggagtcttagataataaatcctgacagcatgattttcttttttccatgcgtgctacttagtagtaccttacgagtgataaatcaagacgcttttccatggagggagatttctggctttatctttgcttttcagatagtttgcaggccaaaaatacagcaagccgaaaggacaagttcattgtgagaattaatttttccaggtcctgctgggactggcattgtcattgttttttaaccttttctgtgtgaaatataaggttgacttgtctcagggagacttctaggggaaactaacaaatattttagcttttctcagtttcatatcagttcatcatatttgcctcctgtcactctccagattgaatgttctattgccataacaaaaagcagaaccatttgaccttggtggaatgcatttgataggggagatctgcaaggttaactatgatacccactaggttggtcttgtatatgaaaggtatcttctgccatagttttgtttctgtgatctgccataattatgtataatttcatatgtgcatttattctgtggctatctcacacagagtaaactgatttccagtcctttcgcagtcatatatcaatgtctaaaaggctaagaatcaagcagtattattaataatgtatgtatggaattttctcatttaactcacagattttaagtcttaggtatggaggtaggaggaaaaaccaccatttccaaatagattacaattgatctgaattccttgcatcattatagtcccctgggcatccttttctctgataacacccaagagaattttgtttgcatacgaaaatagagcagatatgatcataatcattggggagcacatatacagtgatttagactatattcctaggtttgcttttgcggcggtgatgccttagccttgtaggcattcaccatcagggttggggcttagtggacagtggtagagagccatgaggagcttcatgtgtggctgtgggaccagctgcttcctgtgggcagaagggtaacgtttaagggttagaggtcttggaggggagacctagcagttaccagggatctttgctgtggctttggctgttacttctctctgacctggcctggaacagcccagcttcatgtgtgttaatctgggaaaattaatcgtaaagagagttctaagcctcaggggatgacatgatgggatataaccctaaacctcaagtcgccctttacccccaaggtaagataacatggaaagagcctgggactgagaaggaagctctgctgccaccaatgggactttaagccagtctctggaccccttagagcctgtatttcctcataaactgttataatcatacctggcttccctcctgggtagaggagcaaataggacagtatgtacaatgacagccctttatctggcagaggcttggatgagctgttaccactgtctttctgtttgctgcttataggtaatattttcacatttctattattttctgagtgctttctgtgacaatagagagcgccaaagaatcttctaggaagagatctcagagattgttgagaccaaccctgccctttgctgatgaaaccgagacccggagagcagagtgtcttgcccagggtcacactccactgagttaaatgcggaatcatagactcttgcttaactgaagagctcaataggaaagtaacagtaaactaaaacaggaaagcaaaatgcaactcttttcagtcatcatgcctctccacagaaaatttgttgtttttctttacaagagggctcttgttaaaggcttttctctttttgagggggtaagagtagggcagtgagggttgtcttataagaagtgtctgactggcatgttgctcagagcagcaatgacagcaaggcctaaagtctttgctcttttgtgtttggaaaagatggaacttgattagctttttgggatgcctgctatagacttaaaatgatggctgtattaatatgtcttcttaccatagaagctgtcatttactttagagttatacctattaggctgggcgtgggctcatgcctgtcatcctagcactttgggaggctgagcttggcagcttgctgggagttcgagaccagcctggtcagcatagtgagacccctgtcactactatatatatattagctgggtgtagtggtgcacacctgtagtcccagctactggggaggctgaggcaggagtatgacttgagcccatgaggccaaggctgcagtgagccatgattgtaccactgtactccagcctgggtaacacagcaagaccctgtctcaagaaaaataaaaaagaactatacctattgataaatatagacaagaaaacaaagttattttaaagaaaaagtgcggagtgtgatcatattttttcaaaacagatgtagtgggcctgagcatgctcattaataggtttgaagcggctaatctcatggcctccacaacctgggcacagcccccaggatctgcattttgaaacattaaaagcagatgaccctggaaagtttagttttacatgagcctataccaggattaaaaatgaaacaaactcagcaacatgattatcttattggagaaaaatgtaaaatctgtcaccttcataatgcagtatagacagtccccatacaaccattctgtttttcaatctaagtattcaataaattatgtgagctattcaacactttgttatgaaataagctttgtgttacatgatttttccagctgtaggttaacgtaagtgttctgagcatgtttaaagtaggctggactaagctgtgttgttcggtactttaggtgtattaaacacattttcaacttagtgatattttcagtttacagtgggtttgtcaagatgtaacctcatcataagttgaggagcgtctttatgggaaatttcccacaatcaccaatcacaaacatgaaccgtgtatatgaagcccagcttggtgaggaccaacactaggcatatagtttttctgtttttcaaactaacactaaaatgtttagttttgtgagaagaaggggagggggaggacaatattgagaagctatccagtgatatttgcatcttcaggtacaaccaaaaatccactgggcctgctgtcatatctcccaggttatttggtgttctctgaaaaacacccaccttcttgcttttctgtagtgaacagctgtgtgctgtctgataaaaggccacaggacagctgtgcaggtagagctggtgaaggcacttttgagtggcccctgattctgtgctttgttctgcctgtctgcagtgtgtgcctcctgacgaagcctgcacctcgctggacgcctcgataatctgggccatgatgcagaataagaagacgttcaccaagccccttgctgtgatccaccatgaagcagaatctaaaggtgtgctttgggaggcacgatcagagcatggggcctgagctctgcttgttaagaagacccaatagtgtaaatcaaagtccagctttattcacaagataactaaagggccagttagttactttagaagaccattttttgcccgaagagtcttttctttagctggttctcttacagccattatggcttagttgtaagtaatctatttgaaaatgatttcctctgtaaaaagaatcaggtctaggttgttcctgtcataaggtcactctcccttgcattcaaatatgcttccttgagtatgcaaaaaagggttctagttagtcccatgtcccgggaattgcacacaatccacagttcatctttctgtgatctactgctaaagtttatgctggctataacctattgtattgctttatcaaaattgcagatgcctttgagaatatgtgaacattattcatcttaggtgtaacagatgagaaccactgcccaaatgcatcttaaaattcagttttcagaattttgcacaatcacatttgttgcttggagccaagcatgcctctttctccacaagcaggaacattcagcaagctgtatcttctgtgagaaaaggaaggctgtgccctaaggggtgtggcatcagtacctgagaggacaggcagggcagagccagacctggcatgggtctggccagccagagcagtagagaggcagaactgggccctaacaaatgttaggagtggatatgaggccctgtgggcggtgagaagagcatctgacaaggacccgcatcacagctccaagggttataaacaagcaaggacacaccaggcagctgtcagcatctgaggggtggaaccaaatgtcacatgggatatctaggcaattacagttgtcaccatctagtaacattgatatctaagggtgtcaaactgagagaaggctgggagagtgaaagtggattccaagcggggttagatatttcaggattagagctacaggctgcctctcgccactctgaggggcacagaggagcctgggcaccaagggccttgacaaaagccagcacactgtctggctccagtttcagggtattagctggaaggcctgctgggtggtgctgacaccagatctagggtttggtgtggccctgggatggcattcctgatctgagcatgttggattgggatttggcaagactaggcagcaggggtgacccctggacagtgggcagaacctaccagaacagaggcatgcaggtactgtctagtgtcttattggttgactaacctctgtgaaaacagctgtgccattccaattgtgtatctggtggtggcatctgcccccttcctatgaatgaatgtgctccctcaaaatggcagaagagtataggtggcaggcacactggattggagctgggagcctaaggcactgcttttagctttctctgctaactggctgtgggacattggagaacccccctaccaccagctctttgggtttcattttctctatctggaaaggagaggtttggactgggtgacttccaaaaggtcctttcagttgtaatactcaactatgctgtttgaagaagcaaaataatctttaattcatttttctggccgtcctaaagttgttgtgaagtgtacatgagatgttctcggcaacatttttgttgttgtttgttttacttttattgattggttttcaaccatttgaaagttataatagacccagtctttatataaatggatggtccaaatagttcctttttattgggttcaggagaaagaaataagaatataaattgtgttgcagagtaatcacaattgggcagcagctggctccattttgtactatgaaagtgattttgttaccagaaaggagtcccaattcagaccccaatagagggttcttagatttcacccaagaaagaatttggggatgagtccacagagtaaagtgaaagcaagtttattagagacgtaaagaaacaaaagaatggctactccatagacagagcagccccagaggctgctggttgctatttttatggttatttgttgatcatatgctaaacaaggggtgggtaattcatgagctgtcctagaaaggggcaggcaattcccggaactagggttcctcccctttttagaccatatagggtaacctctaggctttgctatgacatttgtcaactgtcatggtgctggtgagagtgtcttttagcatgctaatgtattatacttagtgtataatgagcagtgaggacaaccagaggtcactgtcattgccatcttggttttggtggtttttggccagtttcggctggcttctttactgcatcctgctttatcagcggggtctttatgacctgtatcttgtgaccttctctcccatcctgtgactgagaatgcctaaactcctgggaatgcagcacaataggcctcggcctcattttacccagccctattcaaggtagagttgctctggttcaaatgtctctgataatttaacaataagagcagctacctcggattccatctgttactcgtaactattttgagagaggtaattctgctagtaattgaaggcagcggcttgctttttcccatgccagacaataattaggcattaatattgccgcagtataacttccagcaattcatccattcttcttttgagcctggtgacatttttctaagtaatttctcttgcaaattaggtaattacttttatttaaacttagtataattgtactgaaagttcaatgttttcttgtataaaagttcaagaggaaagttttaccaaatatcaaagcaattttatgagatttgctaattgagactagattttagttgagaagcatgtgggtgaagaaagtttattacttaggtttgttaaataaattgaggcggttaaactgtaggccagcttcccaggggctgtatgcaaatttgctttctaactttgcgcttactggggtaagttttctggcaggtttcagctgtgtgtgactcctctcaccttttaagtttattttcttttgactctaaatcatttatcctcaatgcagaccactggagtctgtgctttctgcctcaaggtgaattggaatagtcatttgaaaagagactgtgggctgggcgcagtggctcacgcctgtaatcccagcactttgggaggccgaggcgagtggatcacaaggtcaggagttcaagaccagcctggccaacatggtgaaaccctgtctctacctaaaaaaaaaaccaaaaaaattagccaggcgtcatggcacacgcctgtaatcccagctactctttaggctgaggcagagaattgcctaaacctgggaagcagaggttgcagtgagccaagatcgcgccactgtactccagcctgggggacagagcaaaactctgtctcaaaaaaaaaaaaaaaaagaaaagagactgtgaccatttgcctaattgcattggtttatttgaataataacaggtcacgaatgtccttcctgccagacagctttatgtctctttattgtagaatctgtgactttttgggtaaaaatttcctaaccaatgggacgcttcactgtgcttttactacacaggtgctctttgaaggccatgccaaaactccagctctctctggtcatttggttcatcttatttttcaacacttggattttctgggacagcagataaaggctctggttggcaacttcacagctgggcagagagctgctctgtggccaccactgccaatagcattgacatactttagtgtttcttctgtggacaggaaagtaggcaatcaagactataaaaatgtttctggattcctcctctgggccactgtttttaatggaaccttcctgagcacatctttgccacttttgatctctaagtcccttgggaatcagtgttgggttagcgttcttttaccatttaaatttttaacaatagatgaaagtttaaagctgatggtgatgatagtgatggagatgaggatgatgatctaacatttgttgagcatttactttgtgcaaggctctgtgctaaatgctttatgtggattattatattttatcctcatagcacctctgtatagtgataacttggccaagggcacacaacatataaatggtggatctgggattcaaattcaggcactgtgattccagagcctgtgctcttaaaccctatgccttattccagatggaggttgattctagtttttactgaaaactagaatcatgtgcatctatgtcttcacacccctcttcctgccccacttctcccttttctttctttctttctttctttttttttttttttgagacaaagtctcactctgtcacccagactggagtgcagtggcgcaatctcggctcactgcaacctccacctcctgggttcaagcgcttctcctgcctcagcctcccgagtagctaggattacaggcacctgccaccacacccagctaattcttgtatttttagtagagatggggtttcaccatgttgcacaggctggtcttgaactcctgacctgagatgatccatccacctcggcctcccaaagtgctgggattataggcatgagccactgcacctggccctcttctcccttttcataccatatcacattagtattcaaggtaacaccccaaataccctaatgattatgaactaaaaggaagatgaaggattttaggaaaaatgtctgttcacccaaaggattaagatgttgggaaatgtgtaacctgtttagcagagtattaaagttcaggagaagttctgtgattttcagtagtaactcagaaagcccagagaacataaatagtttatgcatattatggtttatgacaaaacatttaaaatagttgaggtggtgccatcctaccctattttctgaaattttgaagtataggcatattagtgctgtttgccttggattctgtgaccgctttttacagcatttgagaacacttgggcttatacagtaaaaatgattacaccacgtcggtgatgattttttttaaattgtgaaagagaggagtaaccatttctctgaaacagtgcacatacacagaagagcatggatgtggatgtcatcaggagcaataaatatcattccaaaatttgccgtgatttacatacctatagatgtgtttaattcttagcaagttaaatgtttgagatactgaattttctccgtattttcaccacctaactttaaaaaataaaaatgcctgcatatcttggatactcagtaaatgttaatttcctccccttcctctcaacctctcagcaaactagaggttttttgggaagggagggttgaggaagggaaagttgtgaacgtcagttggaagttgatccaagagaggcattactttttggaacacatttgatctttccagaataaaaatactctaaaggaccagccaggttttgtcctcgagctgaggtcgaggtgaggggaaactgagtggaaagatggtagaaatgcttaattgacagaccagggcattcattctctatccaagaagggaaggagggatatcatatttttttttttaacatcgtgtattttacattatttatttatttaattttgagaaggagtttcattctgtcacccaggctggagtgcagtggcgcaatctcggctcactgcaacctccgcctcctgggttcaagtgattctcctgcctcagcctcctaagtagctgggattataggtgcctgccaccacgcccagctaatttttgtatttttaatagatacagggtttcaccatgttggccaggcttgtctcaaactcctgacctcaggtgatctgcctgcatcggcctcccaaagtgctgggattacaggcctgagccaccgctcccggccagtattttacattttaaaacctttttattttgaaaaatttcaaatatatacaaaaatagaataagtctcaacaattgccaatttatggtgaatcttgttttatcactttctgtcatccactggattgttttgaaggaaacccagacatttaatttaatttcatccatacatattccagtatgtacctctaaaagttaagaaccatcagaagatctcaagcaggaaactgatgattaggtcatttatttttattttattttattttattttttgtatttttagtagagacggggtttcacagtgttagccaggatggtcttgatctcctgaccttgtgatccgcccgtctcggcctcccaaagtgctgggattacaggtgtgagccaccgcgcccggcgattaggtcatttaggaaggctactctgaaaatggtgtgaaggttgcattgctggggaaagtactcaagaataaaatatacgtgatatttgtggttatttattcaaaaaaatatggtaggtgtatagtggacaaattatcttgtctttaaggcctttacagcctagtgcaaagtttctcaatctcagtacaatcagtgtttgggctggaataccctttgtagttggggggctgcctgtgtgttacaggatgttaagcagtgtccctggtctctacccactacatgctagtagcaacaccctcccaccaccagcccagttgtaaccattcaaaatgtctctagacgtttccaaatgtcccctggaataaaaatcacccaccacgtgagacacactggtctagtggcaggatacagataagtgaacaagtaattgcaatgaatatcataaatattgaaagaatccagaaaaagggttcagttacagtgacgttaagttagtaaaaactctgtcttaaatggggcctgcacaaagacctcctgagtctccaggaggaatcttcctctccccattcttctctttgccaaatgccaatagatgtgggtaccagttggacgtcttgtttcactgtgggcccactccgtcctatggtgcctagtaccaaattgagcactaaaggccaaaagctgtggtcagttactcatgcataaccccagaaatatcccgtttatgaaaaccatgctgaacaatctgaagaggggaattttggttctagaggtagaccaaaatttgctcagcgtatatgaaaagatttaattcagaacattgattatagtttgtcctttctgtaaagaaatctttattgttacagttctctttacagcaatagctaagattcctttcttataatcttaatcttatccttaaaccaaaagtaaatattgttgagtccactcttttcctctcagcatgccaactcgatgatagggttccggtggagatcaagccattttagttatactcaggggttcttagggattcgggaagagaaaagttcgaggatagaattctttaacctcagttctgcagcttctgcttgttattgtttgtgctcagaaatcacgaagagacttcacccaggggaaatgaacaacaactgtttctgtttagctctgtgagaaggctcctatttggggtgggggtaaaggattagatcataacagaaatccattaagaattttaaaacaatgccatccatcacacaggccttactataaaacttaaactcttacatgggaggtctccttaggagagagtcataatttttcaaccgcttggggattctgagtgagaaagtttaaccatgggtggttgattggatggaattattcccagaagtgtgtatatttcttacatgatgcatcttgtagcaacctttaaatgcctttgaacttagttcagggaatcaaatactacgtcttgaaaggagaagtttgtgggtagatactcttccttcatagagttcttgggagtttaaaatgagacaatataagtgaaggccgaaggctttttgtctattgcaaaacaccatacaaatgtacaaatgtaaggcatcattgttgttattggtgccaatgaggctgatgggacccagctcccagggtagtgcattctgtagttagcgtaattagtgtgtgttctgcatactgaattagattttcttaaaaacatacaatcatttttattttcttagtaattgtatttaagtatacttttgcatatatcctcattccagggccactatgttgcacaactccagggggcaccattcaattgtggtggctctgattcatccagtagcattccttcccctagagccagacattgataactcatgtggccagaatgttgacccacccatcggagatggttaatcctgagaatttacaattctgttttcttttatcctgtctagcttctttatttttatagacatcaattcagatgctgcttgtttgggtcacattttcccaagttctttttgcttccctgtgaattcagacataaggtgtgtgttccttctgtggtgaatgaaaatggagatgaaaagagaggtgctaaacatgtatcacttttaaactccaaagagtagggtcaaggtctgtagcaggactcagcacactttttctgtaagggaccagatagtgattattttttatttgtggctcatacaatccctgtctcaacaactcaacgctgctgttacagcatgaaagcagccatagacagtatgtaaatgagcatagctgcatccatataaaacttcatttatggagtcaatttgaatttcatataattttcacgtcatgaaatatccttttttgatttttaaaaaatcatttcaaaatataaaattcattcttagctcatgggccatacaaaaataggtggtggaccataatatctcaaccgctggtctcagcctcactgctgaggataatgagtagctgtgcacaaatagttacttcatcagtgcttccccagctagggacagagctacgctcaccagtcatttagcctgctaggcagaactctggaattctgattcaacttctgccctgatgctttccagctgtgaccttgggctctagtcacacgatatcagagtctcaggctgctcatttccaaaacagtgatacaaaatttttttctgccttcttcatggcactggtgcaaactgcatatgaacgtcttcatagtctgattgctggtttcctctgtggcctccatttgcaaaaagtacattaacattttaatcatccttcaccaaacatttctggaagacctattctatgccagtctgagcccttggggatatacagatgactgagaactagaccttgccctcacagcaaaaaaaaaaaaaaaaaaaaaaaaagcaaaagaaagagaaaaagagagagagaactaggaggtattgtggcccaagtgtaacagaggagggatggaatgagcaagggtgggagagactagctctgctgggatggagatggaacagtgggagactcagcaaaggtcccccagagaaaatgccaacaaagcaggtctggggaggagggtgtcttgggatggcttgcaaagcatgatgacaaagagcagcatagagaatttgggaagcttaaattactaagtatggggagcccaccatgggtgaaggactccatcaggaaaggaggctggagagagaggatagagaagggagggagaactttgtgtgccatgttaaagagtgtggatttttttccctataaaggaaggagagtcatcaaggggtttagtcagggttataacatgatcagctctgggctctagaatattcactctgggggcaaatgtggaggaggaaataattggggggagggtagtggtggagataagggggcctctgtgataatcctgatgagcaatgaaggggagttaaactataggataatagcactaaggctaggagaacaaagatacttttagaaaatgtgtatattaaattaaaagaatattttgaaggctgggcgcagtggctcgcgcctatagtccctcggcctttgggaggtcgaggcagatggatggattgcttgagcccatgagttagagaccagccagggcaatgtggtgaaatcctgtctttacaagaaatataaaaattagctggtgtggtggcacatgcttgtagttccagctactcgggaggctaaaatggaaggattgcctgggaggcggaggctgcagtgagctgagggcgccactgccctccagcctgagcaacaaagtgagaccctcaaaaaaaaaaaaaaaaaaagaatattttgaaagcagaataatattagactacactggaaaagcatggtacttaaaggtattgaatttttttgtaagtaaataaaaagatatacacaaacacacacacaaattgtcggacccaaattccctaagtttaggtgtttgccttcaaattttcttcaaattggagagcctatgcaactgattgtcaacaaaatgcaatgcttaaaatttctgggtaactcattatagttttgatatctaaagaggatcattgacagagctttctcacagtatttattaccaaatggaaaagtgtcagtttctgctgagactttgatgaccctttgcttaaatcttggttctccatagaatacattgtgatttatgtttttgtttcagaaaaaggtccaagcatgaaggaaccaaatccaatttctccacgtaagtctttatgcaactatttcgaaataaaacctcctgggctttcctaagaatgagttggttagtgaacatttgccaaactttgagttttgataaggagacttctgctctcattcccccttcccccttcccctttcccctttttgctcatattttttcctttcctctgtcctttgtttatccctgctttctttttccctttcacctttaccactttaaaatattaatttgttgatccattggcatgtatggcttgaatgggaaggtagtaacttatttagagagacaagttaatgacttgcgtgcttatgtctgttctaacctgcaagaattcacatacagccatggaagtggtttgctttaagtcttatcaacaatatttatctgctcagaggcgtaatgctaagggaactcattgctatactttcaagacaatccgtagtgcaagggctgggggccccaggaagagcatgtaagaatgaaagagaaagcaacaccaattgctgcagaataaggacttggaaattgtctaggccaatttcattattttatgcagaagaaaatgctgacccagaaatattcctgcctcattggcattgaggcaggacttcaacctggacttcccagctgtccacccagagctcttctagataatgttgtcttgtgaggagaatttgtgaatctgtgctttttttcctttcctaagattcccaggattagtctccatggctgattcactacatttaacaatcagtctggaaagttcctttcacaaagcacttcataaaccattgtcttaagtggattattttttttaaattatggaacaatatgaactcaaacagaggcacatatggacacatatctatctttggagatttagaatagtttcattaaaaacttgtaatcatgttcaatttttgcatctgtgggtataaaaaggcaaatcatcttctaatatcagttttaaggactagattaaataggttgatggctcggttcaacttcacctccagggagctcttcccacctcttcctccacctgacttcagcaggtgactaaagctatccgcatttttcagaaggtaaatgaacacaccaaagagcacaggtctagaagagtggggaccagaacttgggagttcggatccttccagacttgttccaccacagcatactttccccgagcctttggagtgctgggctgcccaaaggtcacaggagtgtatggcagtcttcaatgtaaaaaaaaaatagctttctttacactgaagtgagttgaaaggcagggatttaatttatacagagatcactggagttgcttctgactggagcagaaagtagaaataatatgataatagtggggagatcctgtatttcccacttatattcaaaacccagagaccttagaaattgtattctacctaaaactcctcccccttggaaaccaattttaactttttataagtgactcaaagaaggtagttctcttaaatgaaaggaaatgttctatttctggggcctggaattaatttcaaatataaaaacctttgccaaatggagaaacaattggttctatttatatgttttgctgaccataaaactgacatcactccccactgggaagtatttccgttccccttatagaaagatcatggttggaaaagtgttaaaaagtaggttgttttaaatgatacaatatgaagctgttaagattaagagtttaatatgaggagatcggtgaaatgttataatccacaggaatagtttatttttattctatattctcctttctttctgttatctttcatacttgtaaatgttcacaaaaatatgtgtataaagtattctaaggtgtgtgttttctgtgcagtgtgtcatttttggagatgttcagtgaataagcagcagtaagccagattttgatcatggaagttcactttattttccaaagcatcttaacctgtgaattttcaagctaccctccattcaaatagtaggtccttagagtgagacaatgagatgacagacaagattttactgagtttgcaaatctgattttttagttagtttgttgatcaaaataaattgcaaactgagaatactttggaaacctgataatttcatttaacctttgaaaaaaatttgcaagttacaaaatacagtgtattttattggaatcttcattgcattctccgattttattagtgctcaacctttatgacagtgcttgtgaaacaaatataaaattgcaatgcatgatgcagactaaccaaaaagttgtgtgtatcggtttctctcctttatagcaattttccatggtctggacaccctaaccgtgatgggcattgcgtttgcagcctttgtgatcggagcactcctgacgggggccttgtggtacatctattctcacacaggttagtgtgactgttgagtaagagttggtgaacagcttgtgttcctgccacacaatagacactcagtgttttgttggatgaaataacgaatgaaagagaaagttcattcctactatttttacatttacatatttggtataaattgggtttcacaaaagtataatttgccataaacagtggaaagaaaaggaaggtttaaactgtgctaattgcgattgtgatgttggtgaaatttagccgctaataaagctactttgttgttagagtttaaagttaatgcagacaacgtacagaaatacaaaccattccgtcaaaaccaaagacttaaggataggcatatacatgagaggaagtgaaaaagaaagccaagattttattaccacacctgccaaggtattgagcactgtccatcagagtccttaatcaatgacttaaaccagattttctcaacctttttttaacccatgctatgtcttctttgataaaacataaaattttcatgtttttctataaagttaaattttctaaatagatttccatgaactgaaaaaaaaaaaaaaagtgatgaaacagagcacttcattttcaagctattatccctcaatcttcaaaattcagatgtgctcctccctaccaatcccaaggttgaaacatactagcctgatgagagaacctgttctgaccccaatacagaatgcaggccagcaaagggagtctttagtgcaatggagaaagaacaaatggattgtcctgctattgattctttcttagtttcctttcaactatgggcaggagtgacatgcattttgcggcattctggagaactagaatgtataaaatcggtcttgttcttgtttgttcttggatccttgtagttttatactgtgaacctagataaactgtgctagattgatccgtcagaggcaagtggcaggcccagcttctctgtttataatttcattaattgtccattaaaccaatgaatgccatgatctttggcttccccttgggccaagctgaaaggatggctgatttaaagaggaaggaagtactgaaggatattttggagagtcatatctttaccctcttgattgctagacaaaacgtcaagctgttgagaataaaagcatgacacagtgatcctctgatagttaaaagtgtcagattcaaatcagaattttcactttaaatactacatctcctgcctgaggtattttagattacgccagaaggagaggaatggactctttcatgcctagcatgggacattcacccaaaaggcaacctcttggcaaaaatgtagaagacttgaatagagagactttgagtcctcaaatgcttgttcctagtcaggatactttgagtaaagtatgtttacgtgaaagattaaaaaatgacttctcataatcctagcattttgggaggcaggggcgggaggatcacttgagcccaggagttcaagaccagcctgggcaacatagtgaaaccatgtctctacaaaaaaacacaaaaactagcatggcgtggtggtgtgcatctcttgtcccagctggctgaggtggggatcgcttgaacctgggaggttgaggctgaagtgagctgtgatggtgccactgcactccagcctgggcgacagagagagaagttgtctcaaaataaataagactccagtgtcatgattctggagtattatataaccatctgtgaatcagtttaggaggattctccctcatgaacagtttataaaaggaccagaaagacagaatttagcagagcagcattttaaagtaagtaattttgtcgcaggaataccgacatgttcagatctcaagctaacagttctttgcaacttttccaacctcctgcctggctgagaggttctagggctgttggcagcctgtgttggctgttgggagtgagtttgaaagtcctccaagaagactgggtcacccacagatgtttaccatgtgcctgctcagccactgactggccttggtcacacagctgcactctcatagctaatcttgggccaggaagccaggtccaggcagaatatagggcaaccagataatactcactactggaacatgccccactgaaatccccccaataatccagactgttacccacagccaagcacacaaacctgataaaaagcaaaacttggtggtatggcatgtattcatcctcattgaatttggaagtctgttgttactgatcctttttcccccaagccagagacttcaggagggcctttcaagtactgttaatgtagaaataggtttgtaagtaaatttaagaaaaatgaaaccaaagacctccctcctgtgatgctttccagcaaaatgaattacactgattcagaaggtaaaaggtttatagacactgtcatttgggcttaaaatccattggcatgacttatgagacagcttcaaaattactttttattaaaaactgtagcctctggttcattttatagattgctcttgaggaataccagcatcatacaagcatgaagaagactcacttcaggaccacatgatagttcttttccagaaccccttcagtttgttacctgggtcagctagcagcaatttagattaataaggaagattataatgcagtgggcaatggggagagccaggatacaaatactggctcagtccgttcaatttcaacagtgattgaagctgtggaactcacagatcgtatatgctgtatttgggggttcagatagcatctgcctctgtgtgaaaaacaatccttaatttgaataacttttcctttgtttacgctttccattccatgtgcagcacggagcacaaaaccaagtcacaaatttggattgtggatatctacttacatacctggaatgtgtgttactctacaaagactgggttcccactttatcatatgacaactctgggcacaataagagatattcccttaaggctggattaattctgtttggaaaactccattcctaaaacttacattctctcctaagatgctgtagagaggaggggtgcttgggggctgaaatggtgctggaaccatagaatgttcatgctcctaggaaccctacctagttcaggggtccctaacttctagtccatgaaggtccctaaagtcacatgcaaaatcttatctgtttttttcttgaagggaggaacaaatgcttttatttttattttctagtaaaactttttagcttcatcaaagtagtacatgcaaatagtttaaaggttgaaataatcctacaagactcattatgaaaaaaaaatcacacccctactgtccttaccttcttttctcactccccagagcattatttttggcgcttagctcatccttttggatgttaatccatacttctaaataacctgagtatattgctgctttttgactttgcaggtttacacctttgctctagacctcctgttatggaaaatgtccccttcccccaccatcctcttaatagaaatatactgacattttggttagagcagcatttactgtttacattattatgactacctaaatgctaatcacagttaactcatgtagtataatatcctgcatgacttttaattttccctagaattaattattatctttccccaccctaccccattagcttaattttcttttcttttttttcttttttttgttttgagacggagtctcgctctgtcacccgggctggagtgcaatggcgcaatcttggctcactgcaagctccgcctctcaggttcctgccattctccttcctcagtcatcagcttaattttctatgtatttatcattaattcttctgctgaccctgccagctgtctcaatctccttttaatacattgagacatatggaatgttctactgattccttttcttcagctctttcctggagcctctgacctgctcctgtctgaaccggttccctccatttctggacactgctgtcttcctatgatcttcttcgctaccattctgtgcattcccttcacttctcttttgagttgtggatgtcctgtgtcatgtatctcctgcctttcttcttcctggtttaaagcgtacagaggacgcaaatgtttttcacaccttgcatgtctgaaaatatcctcatttaacagaaacacctggtagacagtttggcaaggtacagaatgttagattatagacactttttccttcggacttttgaaagccctcctcattgtcttctagctctgaggattgctgttgagaagttcagagctgtgcagattcctgatcccttttgtatataacctgttttttctttctggaagaaattttacaatgatatctcttgagttaggtgtatgtttatacattatgctggtcactaattgggccctttcagtttagaaactcatatctttcagtactgagatttttaagaatgatttatttttttctcacccccttttttctgttttctctcattttagaaatcattttatttgaaagttgaacctcttgtcctttaattttcctttctttcctgttttccatgtgtctgctttctttattttctgggagattgtctcatctttatctttcagttttttactgagtttttaatactggcttcaaattttttaattccaataacttttttaattctaataacttttttcctgtgaatttcttttcttttaaaaaaagttctattcttgtttcatgggtgcagtatcatctgagaatattaatataggattatttaagaatgaggaaaaaaaaagaatgaggaaattctaagctgtgggtgggatgtattgattgtgaacttctttaagatgatctgactgggccattttattgatgaatccctgatacctcatcattggatctttcctctttagctcttcaggcttccataaaatatgtttttttgcctcctgcttgaaaggtataggactggctgttgaaagaccattataatgggcactgataaaaataaactgacatggcaacaaattatatttggcaaatagacaccggaaagcaaatatccagacttcccggccagggtataatcctggcgcttttcccgaatgcaaatagtgaagcgcatggcaaattctgcaggagacaaatttgttacaaagtaggactggaaccctactttcttgattcagagtttcactgttgctagatgaggcaaggccatctggctttatctccttttaggctgagcaaaagaagcccaggtgagccaaaatacgtattaatatatgtttgccgaatcccccccttttgaatgtggtactcttgccctcaaatgtgcctggtgttgatcatttctggaaccttcagtttcctcctcttaagagagtaaaattcccgtcttcttcctggattaggaagggcagatctcagcccagtggagcgagggaggaaatgtagagaactattctgcttctcatatagttcagccaacccctcttgcttatagccatatgttcaagggaggtttccagaggtgcctgatgccaccattccctgagttttttaagggttcggcgacataaattgcttgtttctcagtttttcccactgttggcttaggtttcggctctcttgagtctgccaagtcagttgctactcacccatttcctcaccagcttccaatatattttattgctgttatctttacttttgttatctttgttttcatgtgtttatgcctttaaaagtccatttactgtcattctggtaagatttgggaaaggaatgcaagtcaatgcctttaaatgcactatctctatgcaaagtcgtacccttgcttttttttttttttttttttttttaatcagtttcttaaagggagtccttggaaaattactagtctgcatcagcatttcctttttacgtagcgagaaaactgagcccagagaactgatgtgacaagctcaaagttacccaggcacagcggccaggactgaaggcttgctttcttgattcagagttcactcttttcttcctgttctgttattacaaattcaaaggtcacgtagccataatctttttatcctccttctgcttatcagataataaacattaattaacatgtgttttggtttttctttttgcctctgtttagtgtcagctaaatttttttggtttgttcactcatgtattcgttctttcactcaacttattcaatggattttttaagctattgttaaatgccaacgctattctaggcactggtaaaatagccatgagcaacagaaagtccttgctgtcgtggagttcccatatattcagaggaagagaataaccaaacagactgattataagcagattggctcaggcagaaacccagctacaggcacacatgccaacctttaggaaagcaatgacctgatgaactgtgtcagaaaaatggagaactgacaagggaagtctcactggagaaagaagaagtgtttctaatctgaagaattaagttttctattaaccttttatggaaactgaggggagggtgagaagaagggggaagggtatgaatggccagatgctccgggaggtgctttgttttttgagagaaaaagacacaccaatagacaccaggaaagccgaaggcattcatcttaacctctgtgtttaatggttttataaaataatgatatgggcatttgagtgaaaagagagtggagcctgccttctttacagtcacattggggtttccgtctgttccagctgcatctgtctgatccctgggacttggtctcttgcctcctaccttatcacaccttagtctgtctgcttgctgtttctcttttcatcgggctacacttgggaacctggagaaacctcaggcctctgaacacattggcacctcccgagctacttctaatgaaaacctcttacctgacttgggtggacttttgggtatgcgcttgacttttgctttaagaacacatggtgtgttccatggagggttgttgaaaactgcctgatgagttgggacgggcacacctaattcaaaacttcagcattttattatgctctgtgaaacagtgttccttacacgcttagattttttttctgcttacacatcagagcagccttaaagttgaaaaagcttttattacgcatttcttgttttaagtacgctcaccctaataaccctgtgaagtagtgattatctctgtgttgactaaagggaaacacaactaatacacctactaaggtagcaagtctagccattgaacaaaccagagcttcaagtccagtttctgactcagggttgtagcgatagctgtggaggacagccttcctcctccacctgatttctctttccctcttgcttttcttcttcttcttagttattatcagattttgcatcctattcaggggccacaaaggcagggaagataccacagaaaaccaaagtccatatacaaacaggttggccacactgcaggaatatagaaagaaagtagtaggcaggacattgtgaaaaactttaattcttgatatagtcttttccccgtgacttctaacaacatctaactcacccctcctggagaattttgctgcaaaagaagagtcttttgtgtggaggctggggaggaatgaaatttgaaaatgataaaaagtgattgaagacttctctaaattaaaggtagtatcgttcactctgcttaaagagtgagcttgtgaattaattacagttaggagatcaagaaactgagacattaattgatagaaaatcgcatccaacacgtagatctagaagaaaatatctttattttctttctagcatcaaggaatattaaatctaaagtgtccccaggtatatggttttcaatcctgtgcttaaatatctcctgagaaggagattccataaattccctctataactaaccaatcctcataatcagcaagttcttttctatctgatctaaatccctagtcctgccatttaaactcatttcctcatgttctgccctccagggagataaagaacagctgtctgctcctatttgtaataatcctcatggagagtatttgcaatagtctcctttggcctaaataccaagcttgccctcacctttctttttaactcttctcttgtttccccacagagtcctcccatgctattcacatctttcttgaatagtttcttccccaggacctgccatggtgaaagacttagaaataagaatacagttgtaatatagacgccaaagaggtagcaggaagtcagatctgggcaactccatgccatgctaaagaaataaaacattctccattaagaaatgttttttgtttgtttgtttttgcttctttttttcttcttccccctggtagagacagggtctctctctgttgcccaggttggagtgcagaggctcttcacaggtgagatcatagctcactgcagtctctaactcctggcctcaggagatcctcccccttcagcctcctaagctggcactgtaagtgactgcacctggctttgtttttctatttcttgaggcatctctggcagtatctaggcccagccataggctaactgtgagatgggtggaattaatccttagtgtccttatcctcagtgtactctcctcctccagagtatgtcaggcaccaaattcctctctcccctactcactctccctcctctcaaatctctgttccctcaatgtggtttgatattttaggaggaaagcaggaagactgagtacatttcctctgctggccaagtctgatatttatttacaagcaaggcgccctccttgaatttcttagatgtgttaattgggcctagtctgcttagccacgaggtcctccctgcccatctcctttaggagcagccttgttatacttgtcacccaagggatgttttagagaaagttggtgctccacgaaatcagagaccactgcagtggagagcagacagccaaagacccatctcagaaaacccaggggtctctgttggcccattaagtagaagcatctgtacattcaactttcttcctcatggtgaatttttctgtagcatcacttccatttgacagtgaaaaaactttttcttaatctgtcaaaaggtaagagttatttttaaaacatggttatattgagaaaccttgcatcttacatgtgaaaatagccacagaactggaaaggatggtctgaagaggggactttcaatatttcccagcagattctcagacagagactcaccttggcccattattggatcaaagtcaatataatattaggttaacttgacttatccagctggtgagatgcatcctgcagtcttgagtgcggaggcttctttgttttgtttggggttttgttttgaagtgttttgcattaccagaacaagagttcccaaaactcgggaagttgaaaggtctctttaatgggcacggatgaaaataaactgacatggcaacaaattatatttggcaaatagacatcggaaagcagatattcaggcttcctgggcagggcatagtcctggcacttttcctgaatgtgaataatcaagcacagggcagatcctggaggagcacacttgctccctattgcttgatgaagcaaggccttctcttttacctgctgttgggctgagcaaacaaagcccaggtgagccaaaaaagaaaaagatggagttggcctcctgcttttcagatgtatccttattaaaataggaaaaaatatttttaaaatgtggttcatgcatagccacattagtccttctgattgattatgtgaggatccagctgggtatggaccaacatgtggtttgtaagggagtcaaattcttaaagtatatctagagttgtttgggtctctggaggttgtttttgttttgacctcagaatagttaagagatttgattcccttctagaaataaagctcctactctggggaaagtgaatttttggcagaaagttattgccatggaggctaatttccccagccttaattatacacacacatgaagagtagagggcagtgctggggagggtccaaaacataggtttccaaaaaagtcaaaagcagtgtttcagccgggcgtggtggctcacgcctgtaatcccagcactatggaaggccaaggtgggccgatcacgaggtcaggagatcgataccatcctggctaacacagtgaaatcgtgtctctactaaaaatacaaaaaattagccaggcatggtggcacatgcctgtagtcccaggtactcgggaggctgagacaggagaattgcttgaacccggggggtggaggttgcagtgagccaagatcatgccactgcagtccatcctaggggacagagcgagactccgtctcacaaaaaaaaaaaaaaaaaaaaaaaggcagtgcttctccgcttctcaggaatattgaccccagtcccctatccatcccgccaatcccagaagaaaagataattagaggaagtacaacaagggccaaacttacaacaagcacataaatactttgaggttgatgcaaaagtgtgtatagctgtgtggttcatgaaaggggtgacaggaaaagctgtaaccagacccagggacatgagccagttctacattttgcagaactgcttttttcacagaggcttttgaggggccccagaaagagaatggaagtaatggggccaagttcctgcactggagggcagggcctttcctcgagtgttttgttttaatgaagcagctggaagggttgcttatctccggctgatagatgtgtatttcagcatgacaggaaagaggaggctcattcataaacaggcctggccctctggggtttcccacattgaaggaggggatgctgcttacaagaagtttatgaagtttatgctctgacttttcaaagtaaatgcagtgttttttattggagagccctgatcgcttttccctacctagagccattttttgagggttgcactgaggccggttttgccgaagagaagactaactctagggccttttgcactgttaaatgcaaaccatgtgtgtgacttgaggtttccttcctctccaaagcactgcacatttggcacgatgaatggctttagctaaaatgcagtggggtgtgtaatgaaaagtgggatgcttaaagtgttaggagatactcacactgcaccccacagggaacctcagtggggaagagaggccattcgctggcaactgcagtccccatgtgcaaacagctaaaccccttccccaaaaggtttttccaatagcagctatcccccaccccggtttctcaggtaatttatctgtttggcacacaaggctctctctactgtagctaggacaaagtctatatttcactcctgtttttaacaagtgcattcagaacaaggctcccaaacttccagggttctcttaactacaattgaaaggtcacaccctccaaatcctacagtgtctttatgagagaagatggacagtgtttcctgaatacaggtgctggtcagttgccagctcacacagaccaagtggtggtgatttcatcaaaggttgtggaccctgaaatccagggactttgtcatcaactctcaggggtcttagccactagagctgcctgtcagtcagctgtcttctttttcccattcatgatgctttaaaaataaaacaacaaatagcaaaaccttattttagaaggtattccagccatctaggacctagtctagttgcttctgccctggttgagaaaaatatcagttaaaatggcaaatgcggaataaatgatcttttcaggaatgcacatacataatatgcgtctttctctgactctgccttttctttattaactgcaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttttaccaaatcgttgagtaataatatgacttacctgatagatatacacattcaataaggaacatttttttttttcaataaggaacattttaactaaaacattactttagggctgagatttccaggctatctacattgatctactgaaaaatttctagatttccatatacaaacgaagaagacatgagtttagagaatttttttcctttaatttttttttaacagaagggtatcagagtggaggacctagattacgctacctgtgtttgaaaatattgcgctttgcctaaccttcggtggaatgtattgtttcagcatattctatgtataaaaaagtttaaagatgtcttcaaagaagactagagtctttaagtcacttatagctatattttactacaaaatttgtgtataaagatatatttaagtgttttagataaatttaagttactccatatgaaatgtttaatttcagctactgtgaattctttcgatcagtcctttgcttttttaaaaaatcttttccatcgtgttaaaaagaaaattagctattaggagatattaaaagattgatgtcttagaaggacagggttaaaaccttctgtaatatatttaaatatatatttttaagagagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaacaaaaaaaatggtttttttctttgccttgtaataagattgtaaatccatttcctgcttgtgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaa

SEQ ID NO: 13366 - DNA, 21536 bp, Human
tttgagactgaaaggggacaagatctgtaaacctagattaccctagagaggtgacgttgcttgctttaatactttggttgccttattaatttttcaaaaattgcatcctatttttttggttttcaaaataagaaagacatacttgaataaagttatttcctcttcaaagtctttctagattccacttttccccatgctgagttaaatgcctttctctttggttctggggcagtggttctcaatgctagggggtggggtaaagctggaattttggtcctttctcccctaagggacatttggcaatgtttagagacattttgggatgcctaggtcagaaggaatgccaccggcatctagtgcgtagaggcctgggatacagctaaacatcctacattgcataggaaagcctacacagcaaagaatgatcaggccccaaaacttaatggcgccaaagttgagaacccctgctgtatggtatgtttgtcatagcacttcataaagacagctgtaggccgggcacggtgattcacacctgtaatcccagcattttgagaggccaaggtgggtggatcacctgaggtcgggagttcgagaccagcctgaccaacatggagaaaccacgtctctactaaaaatacaaaattagccgggtatagtggtgcatgcctgtaatcccagctactcgggaggctgaggcaggagaatcgcttgaacccgggaggcacaggttgcagtgagccaagatagcaccattgcactccagcctgagccacaagagcgaaactccgtctaaaacaaaaacaaaaacaaaaaaaggccaggagcggtggctcactcttgtaatcccaacactttggaaagccaaggcgggcagatcacctgaggttaggagttcaagaccagcctgaccaatatggagaaaccctgtctctactaaaaatactaaattagctgggcgtggtggcacatgcctgtaatcctagctactcgggaggctgaggcaggaggatggcttcaatccgggaggctgaggttgccgtgagccgatatcgcgccattgcactctagccggggcaacaaaagcaacactccgtatcaaaaaaaaaaaaaaaaaaaaaaaatctgtaattgtcaactgattgacctacccagctagactgcaactttcataaagacaagtgatacatgcatgttgtagagtgtttggcttgcagttgaaacttaataaggattggaggaaagtgagaagacacatccagattcaaatttagggacctgtgggatcatgctgtttgggttttttttgagccatttcccacctccctttgggtactaatcagtcaactgataagcatttcattcattcaactatctatcttatctatcgatcattatcatctatttatttgtttttgagacagggtctctctttgtcgcccaggctggagtgcagtggcacagtcacggctcactgcagccttgaccttccgggcccaagtgattctcctgcctcagcctccagagtagctcggaccacaggcgctcgccaccatccccggctaatgcttttgtcttttgtaaaggcggggtcttgccatgttgcccaggctggtcttgaattcctgggctcaagcgatcctcccgccttggccttccaaagtgctgggattacaggagtaacccaccgggcccggctggaagcctaatttatacttttttaaagatcatgctggcttctctgggagaatatgtaaaacatctattatacacagaatctaaaatacttgccataaagtagttacactctcggatacctattgtcaaaagggaagtctcccagaaaatatgggggcgctgtagccgccgggtcagccgagtccactctctggtacttttagagacgtcggtcgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggtaagcagggcggtcggggaggaggtttgggagcaggagttccgggctgtagggaatgggctttcctgccctccgtgcctcgtccgccgccctggcgcccccgtctcgcccccgtgacttctgagagaaagaggagctctcgaaggggcgtccgccctcccgccgctctaggccgctccgcaccggccgcggccccctccgttcttggccggacttgtgccatctcctgcggtgtgggaccctcaccctcgcaactggcattctttttttgaaaaaaagaacctcaggtgcacaaaattgagttgatccttctcagttcttgacaccctgtgggccaatgcaaggctccttgtttattttatcacttcctctcttcgttcctattcccagacccctttcactccccttttcagacagccactctggtgtgttatataagtggctttacggtccaccttgggtaaatttgtgcaagtgttactttgaaatctatatagcggtttcgaattcttcaatataatatgctgtgatttttctttaaacctttttcctcaacattgtgtttttgagtccatccatgctagtcatcttgttttcacttctgagtgcttgcatgaggggtgctgtgtgcatagacttattcccctagtggtggatagatttttttctagtattaacacccccacaagccacactgtaacgaatattctggcagttgtctccttgtgcatattgttgcatttctctgggtatccaccccagagttgggtcctggtcatatctaattttgctggattgttctttggaatggtcacactagtttatacttcccgacgggcagtgcataaagcttcctgtttcccggtatccctccatcgttcagtggcggctggttttgtaatgtttatcagtctggggggtgtaaggtggtatcccatcgtgtacattttctttctttctttctttctttcttttgagacggagttttgctcttgttgctcgggcaggaatgcagtggcatgatctcggctcactgcaacctccgcctcgggttcaagcgattcttctgcctcagcctcctgagtagctgggattacagacgcgcgccaccacacccagctaattttttgtatttttagcaaagatgggggggttggccagtctggtcttgaactcctgacctcaggtgatccacccgcctcggcctcccgaagtgcagggattacacttcccgacgggcagtgcataaaggaattacagacgtgagccactgctcccggcctacattttcatgtgtttattaaacgtgggttttcccttttttgaattgcctgtttatatcccttcccacttctctgtggatttcctatgttcctggcttgcaggaattcttgtaggctctagattttagatcctggccatgcccggtggctcacacctgtcatcctatcactttgggaggctgaggtaggtggaccactggagtccaggagttcaagatcagcctgggcaacatggtgaaaccccatctctaccaaaaatacaaaaattagctgagcgtgttgacgcacgcccgtactcccagccactaaaaaggctgaggtgggacagtcgcttgaacccgggaggcagaggttgccctgagctgagatcgcaccactgcattccagcctgggcaacagagcaagaccttgtctcaaaaaaaaaaaaaaaaagattttaggccaggcgcggtggctcacgcctgtaatcccagcactttgggaggccgaggcaggtggatcaccggaggtcaggagttcgagaccagcctgaccaatatgatgaaaccccgtctcctactaaaaatacaaaaattagccgggcgtggtggcatgcacctgtaattgcagcttgtcaggaggctgacacaggagaatcacttgaaccagggaggcggaggttgcagtgatccgagattgcgccgttgcattccagcctgggcaacgagcaaaactccgtctcaaaaaaataaagatttcaagtccttgttggttttgcactctgcagataccacctccaagtcttctaacttaatctatggcactgtgttgaataaaaacatttaactctaatgaagttaaattcatcagttttcccctgtataggtttttaaggtatcttcattaagacatttttctacatttccttctattaacatgatagtgttacttttcacgtttagatttttaatccatttgtaattttttaagttttttgtttttggttttttttttttttttgagacggagttttgctcttgttgcccaggctcttgttgcaatggcgcaatctcagctcactgcaacctctgcctcccaggtccaagcaattctcctgactcagcctcccgagtagctgggattacaggcatgagccaccacgcttggccaaagaatttcctttgtatctgtggtctgttcccagcctaccatcttcagcatttgaaaaccattctttctgcatggcctggaccctctacagaacaatgtggatgagcttaataactactccctaaggcttaattattgtcttgggcttttctctgcctccccaccttctcttcaggcccaggttagatctgcaatttctccagcggttcctgcagatactgaaggttttgtttccttcttggtcatcacaaaatgccttgatgttcctgacccttttgtgcctgaccctactgggtgagtgagtgagcccagactagaggagggaggggagctctggtttggggtccctttccatcttttttttttttttttttttttttgagacagagtttctctcttgttgcccaggctggagtgcagtgacataatctcagctcactgcaacctctgcctccctggttcaagtgattctcctgccttcgcctcctgagtagctgggattacaagcacccaccaccacgcccgactaaactttgtatttttcagtaaagacagggtttcaccatcttggccaggctgatctcgaactcatgacctcaggtgatacacccgcctcagcctcccaaagtgctgggattacaggcgtgagccaccgcgcccggccccttttcatctctttggggtgctgatgaggcagggactcaggaagaagcctcccttctttttaacccctcatcactgatttcttactcctctccctcctttcagagcaatttgtgatctaccaggttggcctgatccccagtcagtactatggggtcctgggaaacaaagacttggaagggtttaagactctgacattcctggctgtcatgctcattgttctgaactccacggtaagatctttccctctctctgtgtctctcgtcctctccagtccagtgtgaccgtaatgcctagtggaacttagcctccaggaagcaggaagcaagctgtgggggtgtgtttcctcccttttctgggaactaaagggatagttgcctttattaagcacgttgatcttgctattggcccacgtgggactgattcctcagatgtttccactcctgggcccaggccacaggttctggtttaattcagcatttagcagaactgatcattgcccctttccttcctagaactcttatttccggcagctcattaaaacggctcagcagccagagctgctgctcctcctctgcgggaccgaggctgtgactcaccctggcaccatgtcacacctcccagcctttgaacagtgctttcttgcagaatggcctcctcccctacccctcattcagtaggggggctaccacctgctcactcttcgtcatccctccgttgtcacctctttcaagtctttctcagctttctcctttgtgtctcctccaccaaactctgccctttttctgtacttaacgaattccttgagtttacctcgctgtaacactcctcacacgcttgtaattgttttctggctaaactgtgagctcataatgtccctagtgcttagcacataggtgccctggaaatggtaaatgatgagactcagggctgtaccagaactcaagcctaatgctgtctgccaggctgtgccacctgttttcttggggaagccactgctcatcgtaccatggccacttttgttgggtcttcggtcagtaagcacctatgcatacaaatctctgtcccaagcttgggggacaaaggagtaagaacataaatggaatcgacaatatggtctccaatcttcagaagctcatctactctcaaaataagacagtgtagaaagagggtcttgcctctggtaagccctttaatatttggtgaaggaggctgggtacagtggctcacgcctgtaatcccagcactttgagaggccgaggcgggcggatcacctgaggtcgggagttccagaccagcctgaccaagatggagaaaccccgtctctactaaaaatacaaaattagctgggcgtggtggtgcatgcctgtaatcccagctactcgggaggctgaggcaggagaatcgcttgaaactgggaggcggaggttgtggtgagccaagatcgcgccattgcactccagcctgggcaacaagagtaaaactccatctcagagaaaaaaaatttggtgaaggaatgaacacgtgagtgagtgaggaagggaaagtcccatgactcgatgatttaaaaaagaaaagtgctgagtggacggagtaatcagagtcagagtgggctgggatgggtcagcggaggctcttgcgagccttgagctttgagctgagattttcaggaagccatctctcccttccccttgcttcccccactgcacagctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccgtaggcgccccaactcagtcctttctacactctgtgtggtcctttccttctggcctagccctggagactgctggtggcagacaccaaggagatcatctgcagtcgttttcaaatgctgctgcccagagtcatgggggagggtgccctgcagaggactcctggagaagctgcagggctgtgaataggcagctaaaaagaagaagcctgccaggtgcagtggcatgcacctgtagtcccaacaactcaggaggctgaggcaggaggatcacttgagcccaggagtagtgcaccgtgagcacacttgggaatagccactgtactctagcctgggcaacatagcagaaacccccatctcttaaaaaaaagaaaaatgttaggagcagctttcttttgtccttttcatactttatatcttagtcttccagtaagaagactaaggggtttctttagagggttctaaagaaaatgtccttgctagaaaaaccagctcttagattttcatcagtaaaaaaaattaccactatccaggactcagtctaggattcacatctccattctatcaccactcaggttataactcttaaagtcaccaagccccaggttccccttctgtaaaatgaggacaataatagttcctatctcaaagggtgtagtgaggatgaaatatcattcatgtaatgcacatgtacagtgcttgacacatagcaagtgtttcagtgtaagttagctattgttattttacagatgaggaagctgaagcccagagattgcaagtgacttgcccaaggtcacgtcactcattgggaataggaatcagtatggccctagtggtgagatgagacatagggggtctccttcacacccatcccctcactcaccaccttcctagcaagcactttgttggttggggtacctctcagctcaagcttagctttggtgcaaagatgcgtgggaggctgctgctgctgcctaacttctaggcctctttctgatggctatggcttccatcctgcctctgccccctgagtagctgggactacaggtgtgcctcacagcctggagctttcacagccagataactaaaggggccaggctagggcttatataagagaaatttgggaggattgagataaaggggatagtcttcttgatcatccaaaacagctcatctaccttcaagtttttctttggctctgctcagagctggctcaggcccctgggtactggacctttcagttcccactttttcaggggattaactgaggcaccgtaagatgcaactctctagaaccctgtttaaaggccctgggatttagttgcccctaggaaaccagccttgtctggttccctcttcccatagggtcagtgttcacagcactgtgaggcaaggtcaagagcagaggtgatgtgaaagtttcttgttctctctacctttgggcccatctccctgggtccagctactctgtgtcattggctccagggaccagcgcatcagccaggacgtggagcgattctgccggcagctcagcagcatggccagcaagctcatcatctccccgttcaccctcgtctactacacttaccagtgcttccaaaggtgaagcctccctcctccccagcctggtgtttccccagagggccctcagtcagctctcccaggtcaaggtccaagagaagcttatttcccctctctcccaccgtaccttaccacgtgctcacccatcccacgtgctcaggcccctgcccttcctttggccctgtgttgcagtgtcacagatatcctggctctgagagctcataccagatgcccccacataggagcagagggcccattgggccactcagattggacaggggctacctgagagggaacaggagtcagggctgaggcatgtggggataggtggcaccccacaccctctcccttctctccctctctctctatttcagcacaggctggctcgggcctgtgagcatcttcgggtatttcatcctggggaccgtggtgaacaaaactttgatgggccccattgtgatgaagctggtgcatcaggagaagctggagggagattttaggtgtgtctccctcacttgaggtttctgggctggggcataatagttaaggaaggggatctggagtaaaactgcctaagttcaaatcctagctgtgccagttactagctgtgtgatcttggagaggtctttaacctctccaagcttcaatgttcttgtctctaaagtggaaatggtaccgttgcctactgagaggattaggaggattaatgaaatcatacctgagaaggtctgagaaccgtgtctgcctggccatcaccatcgtcattgtcatctcttggccttctcactgccctggcataaccgccctgtcttggatcagttgggtgtggcagccaatggatccagtgcctgccctgtgcttcttgtccccctcctttgggccaggccctgggaggaggagatgctgtgagcaggaatacccctgtcctctctgcagaaagctgaggggcagccctgtctctgcagagctcctgccacaccacctagccctggggttttctaccccataacagtccaggaaagggtcagactgaggcagccacggttttgaggcagagccgggctccgcttgggcggtctttgtgatccaggactccaacaagagtgaggccagtactccctgttgtcagcacacatttccctttggtccgcccaggttcaagcacatgcagattcgggtgaatgcggagcctgctgctttctacaggtgagtctggagagatggttccccttctgccttgccagagctgagagtggagaaggaaagatgaatcctcaaccctcccaccaccaccgagctcaggggctgagtgttgtcacacttggctgtgaccctctccctctacctccccctgcccttgcctgcctcatccttaggtccaggggtttgcttctgaagctggtggttccttactgtggccagctttagtcttagtggcctagcgtggggcctgaaattgtcaaatgaatgaatgcctcatcctcttgctggtgactgtaagacatccgtctgcctctgctcttctgtctgttaagaagctttcttgccagtgcctgaggttcaagcctgatcctttgtctccgtagcgtgggatggaatgggagcttctcagaaaaccaggagacctgctccccacaatgctgtctaatggagccaagcgtctggtctcctgacggcagcagcaggagcagcagcagcggcatgaaatcccatcccttccctccagggccagaaccggtccctgtgctctgccttatgtgaggcctctgaaatcagcgttaggattgatagtgcaggcagaggtttgcgtttaagaagtggaagctactccttggctctgtacttggggtggatgtgatagccctgggacctttgctcctcagtctctgctgcagtttgcaacctccaccacttgagggcaccaagaatactgggaatctgcgctggggtggggttgtgaggtgggcagggctgggtgtgtaaaaaagttgcttttggaggccgggcatggtggctcatgcctgtaatcccagcactttgggaggccgaggcgggtggattgcctgaggtcaagagttcgagaccagccatggccaacatggtgaaaccctgtctctactaaaaatacaaaaaattagctgagcatggtggcgggcacctgtaatcccagctactggggaggctgaggcaggagaatcacttgaatccgggaggcagaggttgcagtaaggcaagatcctgccattgcactccagcctgggtgacagagcaagactccgtctcaaaaaaaaaaaaagaaaaaagttgcttttggattctgcagcctctgctcatgaagctctggggaaggcaggttagtttgtagagtttcagatgagttcttctgtggcctctgtgcaaaatctgaaatctccctccaccttttctgcctagcgaatttcttcccatccttgaaaccccagatcacctcctctggagagccttcccagactcccttaatggctaagcctatctgctgccatggccctgagggcacacttagtactcctgattccaagtgaagaatgcagtgtgcctgcctgccctctggactgagagctcctcaaagacagagataattttctcatttctttattgcactagctaactagtgcaatgcctggtacacctagtgaccgctctgtgtatgtttatttaacaatagtttttatttattgagggctccttatgtgcttggcactttatatttagaaacttttaattctaactctaacctattacataggtattattggctccattttatagattaaaaaaactgaggcttggaggcttaagtagcctgcctgtgtcacgcagctagtaactggccagagccaggatttgaactaggtctgcccaactctagagtttatgttcttcacacagacaataccattaaggcatgactgaagccgtgaatgggcgctaccagtagacagatcctgagaccaagatcatttgaatggccttggtttctaaaggagggtgtgatatgggacaggcggccccccaacctggctgaacctctccagccctgtggacatcccagcctttccttgtcagagctgggcatgtggagcacatgaggacagaccgcaggctgcagagactccttcagacccagagggagctgatgtccaaggagctctggctgtacagtaggcgagggggcccagggaagtgggaaccatggggttggactggtctgcttcccttcccacacctctctacctcctgtctgcaaggataaatgtgccatgatgaaggaattaaccggggatgaggagggggggctgttgcctttctgtgagtatcctcaggagaatgaggatccagagagtccacgtggccctacttggcgtcctgctccctgtcttagggttgtgtccgctgtagggcatgtggatggttcctgggtgtctcacagatgtgttttctacagtcggcatcaacacctttgactatctgggcagcatcctgagttacgttgtcatcgcaatccccattttcagcggggtctatggagacctgagtcccgcagagcttagcaccctggtcagcaaggtgagactccctcttggtcaccccacatgctgtccctctctgtccttggcccagtgtctgtgggctcgagtcgagacctgcttgacctcttcccatcctgtccagaatgcctttgtgtgcatctacctcatcagctgcttcacccagctcatcgacctgtccacgacgctctcagatgtggctggctacacgcacaggtgaggccgtgtcccacccctctggctcctgagcaaagtgtgtgctgctggcagaagtggctgagtgaaaaaaggaacagagacataccatgtactcgtgggtgtgagataggaaaaggagttcaccttcacctggctcccagaccctgcctcagattttcttttcttgttcagaattgggcagcttcgggagacgcttctggacatgtccctgaagtcacaggactgcgagatcctgggcgagagcgagtggggcttggacacgtgagtagcgggctggcagagcagtagttgaggctgcaggctgtggcatcacctggcttgggttaccctggagtcctgccctttcccagctgggcagcagagttgtaaggagtaaatggaaatggaatgccaggcacatgtaagttcacagtcgatgttgctgttccggcatctgttgtgttaatttacaccattccccggccagtggaagcaaagtacacacaccttctgcctgagataacaggaatctgcagtgtcctccccttcctgtgcttcctcctcccgctgattcctctccctgcccctttccttggggcatgtctgtctttgttcccccacctcactcagccccagagatgtctgtatccgtgtgtctgcgtggatctgtaatatttctgtgcattcaggatttgcttgatctccacactttccttgggcagattacctaactgttctgtttcttcatgtctgaaaaggaggtcataatgaacttccttcacttgttgtagggattagatatcatcatccatggaaagtgcttggacagtggccacatcataagctttcaaaaatcagtctgaattccagggcctacactcaacttgcttttcttaggagctaataccttaactgttgcttctgttccaaatgaaagcttcatgcaaccatgagtgcagaggctgggcatgaaggagggtctgtaggaaactggaattgctgttctgtggggagccaggcatccatgcagaggcagaaactccagaaccatttagctttaaccactcccattcttgttattagtactctggtcacactgtgatgccatgaagacccaccagcattagaatttgttgaataccgctctgcaacctgggcagttacttagccacctgattcttagtgtcctcatctgtgatgatatttgagactcatgggcattagactgagtaagatcagtcccataaggggctttgtccagccaggcagagagtagaagttccacccctacccctgtattaatgtgctcaggctgccatgacagaaaaccacaaaccggctggcttaaacaatagaaattaatttcctcacaattctggatgcttatggtccacgatcaagttgtcagcagggttggtttcttaggccactccttggcttgtagatggccaccttgttgctgtgtcctcacgtggcctttcctttatatgtgcgtgcccctgccacctctatcttaagaggacaccagtcatattggattagggtcccaccccaacaacttcatgttaacatcatctctttaaagaccctgcctccagctgggcacggaagctcacgtctataatcccaccactttgggaggctgaggtgggcagatcacctgaggtcacaagttcgagaccagactggccaacatagtgaaaccctgtctctactaaaaatatgggcacggtggtgggcacctgtaatccagctactcaggaggctgggacaggaaaatcgcttgaacccaggaggcggaggttgcagtgagctgagatagctccactgcactcaagcctgggtgacagcaagactttctctcaaaaaaaaaaaaaaaaaaaaagaccctgcctccgaatgcagttacattctgagtcactagggggctggacttcagcatgtgattttgggaggatgcaagtcagcccataataatccacaggtggtggctcccgggagcagtgcctcccccacagcaatactgaccctgcccatcttcctcacgccccctctcttctctgacacagacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggtgagagccaggccctccctgcctctgacccagcctgggccctaggggtggggtgaaggcggggacggtgtggtagaatccattcttttctgttggggaacaaggaagagaggagacaggcagttgcctcttctgggagatctcacaatggaggtttctgtgggctctgcaggctcagtgcagatgctgacggactttgggccccatggggtgctattcctgccacaaaagccattcttcactgacgggacccttcgggagcaggtcagtctagttcagggggctcactcctccctcctcaaccccgcccacccacagctgggacctctggcactgtgacaagtctcaggtcctagagtcagggcaaaaggtgaggtggtgaagtggcccgggcctgggaactgctggctctaagaaccttctattcacatccatggattgggcccactactcatagcagctcctgaggcaggtaaatggggcaaggactcacgccaaataccacacgcgtatgtcaaacacccaaggtcggattctggggcccctgccctcaggaggctgtcagactgttccccctaaacacacttctgaaggttgtagggaccttgccctgctgtctgccggccagagcctctcccatctgacccaggccaggcgttcccacctctcctccttgggaggttccagtgggttctggagggagggtgggctgtgtgcagctccgtcttttgctcgccctcctaggttggtgtggtttttttcttttctcaggtgatatatcccctgaaggaggtctaccccgactcaggtgagctggtcctccttaggtcatgtcctctccttctgtcatggttgtccctgctctacctgactgtggcctcatctgtgcccttggggagaggctccagccaggccgctgattcaaggaagaggggctcctctcctcttcctttgactgttttggggtctgtacccagatctcacctcattctttctgtccttaaggagagatgcccactgggacaaggaaagtgatgccttccttcacccaccccttcccttatgaagatctgcaacctgtggtttcaaagccttcgcccagcattctgaggcccccacccctgcatcatccatgatgtgccctgtctattctttttttttttttttttttttttgagatggagtttcactctgtcacccagactggagtgcagtggtgtgatctcggctcactgcaacctccacctcccgggttcaagcaattcccctgcctcagcctcttccgtagctggggctacaggtgcacgccaccttgcctgcctaatttttgtatatttagtagagacagcgtttcaccatgttggccagggtggtctccatctcctgaccttgtgatccacctgcctcggcctcccaaagtgttgggattacaggcgtgagccactgtgcacagccttgccctgtctattttgaccagccaggaggctctggctttttgcagaaggcttctttgttgtgcaggttctgccgatgatgagaggatcttgaggttcttggaattggcaggcctggtaagtggggagagggaccctcaggacccgagcccacctgggagcaccagctacaggtaggcaggtgctggccctgctatgcttgggcccaggactggaagtctgaacctggggtggagaatgggagtatcagttgacagtgtgtgctgttggccaggtttaggcacgaagggggtagtgctctcattggagaattttaaaacaagaataggattgatgaaggcggtttgctttttactgtcatcatgctccagcaagtctaaacagtgtcattggtagaatattcctctctgcctggggcagactgtcccacagtcccccgccttggtatgccactggggcatatatttgtcttagaggtgtgtgtgtatgctggggagtgagggaggttccccatgatggcaggtagcagggctggccatttcatggacatcctgccctctgggtctgttacagtccaacttggtggcaaggacagagggcctggaccagcaggtggactggaactggtaagaaaagagcttgggtgctccagagatagccccaccataaagacagtgggtttcagggtccctgtcaaggaatggaacggctcctgaccccaaagtccagatgtttggctggtcagtcgggtgcaagtttatgcccttgggaacagagttttgcctcactctgtgagggctgtaggcctatggtcgaaagggaaggggcttctgtctcctggggctcacctctgtgcagagaaacctcttcctacccagaccattctaggtaaaagccaagctatattcttcctcctctagcagtcctctctcctacctttcctcaggtatgatgttctgtccccgggggagatgcaacggctctcctttgcccgactcttctacctgcagccgaagtacgcaggtgaggtctcgccttgtggctgcacatgccatgcgctgtctgcactcacgggtgtagcagcatgtgttcacaggcacccaggcacacctgtgaatggctgggcttctccgcattccctgctggagaggacagcaggccctgcccgtgtaaacagtgcctggcatcgtcagagttaacactgaatatgcggtactgccagctcataagcttgcttttcttctgttttcttttttcttttctttttttttttttttttgagacagtctcactctgtcacccaggctggggtacaggggcacagtcatggctcagtgcagcctggaactcccaggcttaagtgatcctcccacctcagcctcctgagtagctgggactacaagcatgtgccaccacaccctgctaatttttttatttttatttttgtagagacagggtcatgctatgttgcccaggctggtctggagttcctggactcaggccatcctcccacgttggcctcccaaagtgctgggattacaggcatgaaccactatgcctagctcataagctttttgcctggcagcagctggagccaggagccaacattgaagggttataattttatgctcctctggctccaccatcaaatgaatgggcacccatcctcctctcccaccaagctgtgcctggcaggtggatgggtgtggacttttccaaagactgacattcttgcgggggactgggattccctggattgagtggtcccagggagtggctggtgcttatctatagaagctgagagatttcatgcagctgctcacaggctattcccttggagagtctggccctctgctcctctggcccatccttctccctgaggcagggcttctggaagccagagcagctttcagcctcccctgggtcccagctggggttgagtatgggtgggaggagaagcagcggcggcagagggcagggctttgatctcttcctctgtgctctgccccctcagtgcttgatgaagccaccagtgccctgacagaggaagtggagagcgagctctatcgcatcggccagcagctggggatgacgttcatcagtgtgggacatcggcagagccttgagaaggtacccgtgctcacaaggatggcctgaggaggagaaagaacccaaaggctcagcctggccagggccagaggcccctcaaaacggggagtagcagtagcagagagaaccgagtggcctcctctgccggcggccagggcagcctgatctccatgtggtggtggtctcttgtagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgatgacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgatcttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttccaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatttttgccaggcttctgtacttctagtacttgagttacttaatatttttaaaaacaaaccttttaagtttaaatggatttttaagtgaaattttacacttaacatagatggaaagtaactaaaaataaatacaagaaaaaccatcggtgttattaacttacggctagatgctgttgcctgcatagactctgggcctgaggcttgttcattttgtaaaaaagagaggtgaggagttagacggactggcactcaactgagatttttctccttaataaaatcagaaagatggagtgagaattgtattttctcactgtaaaatataagattatttaacgctttcttggtaccacttaaaaatgacttactctatccttactgacttcttcagctcctaagcctttttcacagacgctgctgccgctgccaagttattttgtttatttttattttttatttacttatttatttttgagacagtgtctcacacctcactctgtagcccaggctgtaatctagtggcacaatcacagcttattgcagccttgacttcccgggctcaagtgatcctcccaccacagcctctcaagtagctgggaccacaggcaggagctcctatgcccagcatccagattattttggagaccaattcattcctatctcagggtctttgcatttgctgcttcctctgcctctaactggttcccagtgctgttctgttcttaacacttagccttctccctcacagaaactgcccaagaaagctactcctaggggcacactctgcacctctatccctccctcatgtcagagatggagactactcttagatgagtcgacataaacatgcgtggaggaaaatcaggtcttgtgtccttcatagtacattatggacaaaatgtttgttttaaatgcatcgtacatcagccaggcaaatagtttcccaaacttaagacccattttggccacccaggaatctacagtgacccatgtggatgagacataaagatagccataggtttcccatcactcttctggagggttctgggctgcaggacaggcagaaaagccatcttttgtcatctctatccacgttggcttaacatgtcaatgtgtgtctagtaaaggcagctcaaacccaacatgtcccaaactgaacaagaagagctttccctggccgggcatagtggctcatgcctgtaatcccagcactttgggaggctgaggtgggtggattgcaaggtcaggagatcgaaaccatcctggccaacatggtgaaaccccgtctctactaaaaataaaaaaattagctgggtgtggtggcacatgcctgtaatcccagctactcgggaggctgaggctggagaatcgcttgaacccaggaggcgggggttgcagtgagccgagatcgtgccactgcactccagcctggtgccaaagcaagactctgtctcaaaaaaaaagaaagctttcccactcacgcctgtaatcccagcactttgggaggccgaggtgggcagatcacaaggtcaggagttcaggaccagcctggccaatatggtaaaaccccatctctactaaaaatacaaaagttagccgggtgtggtggcaggcgcctgtagtcccagctactcgggaggctgaggcaggagaatcatttgaacccaggaggcggaggttgcagtgagcagagattgtgccacggcactccagcctgggcgacagagcgagactccgtctcaaaaaaaagctttccccagagccttttctagcatctcctctgatggcaagtggcgttactgtccatctagcacatcaccaggtgctgttgctctgaccccataagtaaatcttccagccattcacttctctcacctgcttgaatcctagctagaagcagctcagagggagccagaaaaatgagaaaaaccacaaggagaatcgaggaacaggagcctggacggcagctggactctgaaaaaaagaagtgtcaggaggcagcctgagcctgccacgtaggggaatgttagtaaccagtggcacggcattctgtgggctatggggcagttcttgaaagtgagggcactttggtttgccgcacaccagccatgtctgaggcaccattctcagttccagggttacagt

SEQ ID NO: 13367 - DNA, 21536 bp, Human; identical to SEQ ID NO: 13366

SEQ ID NO: 13368 - DNA, 21536 bp, Human; identical to SEQ ID NO: 13366

SEQ ID NO: 13369 - DNA, 21536 bp, Human; identical to SEQ ID NO: 13366

SEQ ID NO: 13370 - DNA, 53453 bp, Human
gagattacaggcgtgggccaccgccccggctgtaaaccttttttttgagacaagagttttgctcttgttgcctaggctggagtgcaatggcgcaatctcggctcaccacaacctctgcctcccgggttcaagcaattctcctgcctcagcctccccagtaacagactataggtgcgtgccaccatgccaggctaatttttgtatttttggtagagacagagtttcaccatgctagccaggctggtcttgaactcctggcctcaggtgatccacccgccttggtctcccaaagtgttgagatttacaggcatgagccaccgcccccggctgtaaaattttttttttttttttttgagacagagttttgctcttgttgcccaggctggagtgcaatggcacgatctcggctcaccgcaacctccacctcccagttcaagcgattctcctgcctcagcctcccgagtagctgggattacaggcacacaccaccatccctggctaattttgtatttttagtagagacagggtttctccatgttggtcaggctggcgtaaaccttattatacataccatctgccagcatgatcatggctttttcttttctttttttttgagatggagtttcgctcttgtttcccaggctggagtgcaatagcacgatctcggcccaccgcagcctccacctcccaggttcaagcaattctcctgcctcagcctcccgagtagctgggaatccaggcatgcgccaccatgcccggctacttttgtaattttagtagacacggggtttctccattttggtcaggctagtctcgaacttccaacctcaggtgatccgcccgcctcggcctaccaaagtactgggattacaggcgtgagccaccacgcctggccgatcatagctttttctgagtgtatttctggtatactttcacactcccgtgagtccataggcggaatcgccatatattgaagagtttatctctgatgtaaaatctataaagttaccattaattttgtatgtgtaaggttctgaaaaagcacactgttgataagctgcagaaaagagagtagggcatcttctgtcacaggctgtatatttggaatttattctagaaattggtaactttataatatgaaagtcagtccaagactcctcatttgaacataggcttacagattaatgtatgaacataaaaatttgactataacaagattattaatgtatgcgtagtaccttagttatagtactttatagtttcttttattggtttttgggttttttgatggtttttttgagatagggtcttactcttaaccatgctggagtacagtggcaggatcatggctcattacagcttcgacctcctggacttaagtgatcctcccacctcagcctctggcatagctgggactgtaggcatgcaccaccatgcctggctaattttgtattttttgtagagacagggttttgccatgttgcctaggctggtcttgaactcctgagctcaggtgatcctcctgccttggcctcccaaagtgctgggattacaggcatgagtcgccacacttggcctagtttattttattgtattatatatattttttattgactaagtttgattttgtagataaagctgttgtgacatgaatatggctcagggaaatgccaagatttcatactctggtagaggtggatatagagtctacattcttctgaatcccctcattttctaccaaagaactggatgttgttactgtcatctgctggtgagcaacaactgatagtacagatagtagagtaggaagttgctatttagtagtttatctggtagcatttccttccacagttactggtaggtgcctttactatgaagttccaggaattattactaaataaattttccttgtttcattgtttagaacactaatgcttttaaacttggaataagccacttcatgttttgttgacttggttttgtaattctttttctgtccagttttccttgttcctggtcaacaaagaaatgtggagtgtcttggctgaatcctcatacagacaagatcattatggtgctgttaggtaggacttgtatccagatgtaaggtaatatctccactagcttaaatttataaatgtatttcaaatgttcctgaatggtggttttctttttttcctgaatttaattctctgttttttgccaagtgatgttaattttgtccaacaagccatatataaaatttagaactattatgtatcaaaatagatagaatttctggctggtcatggtggttcatgcctgtaatcctaacactttgggaggccaaggcagacggattgcttaagcccaggagttcaagaccagtctggacaacatggcaaaaccctgtctttacaaaaaatacaaaaattagctgggtgtggtggccatgtacctgtagttccagctactcaggaggctgagttcagaggatcacctgagcccagggagatcatggctgcagtgagccgtgccactgtattccagcctgagcaatggtgtgactgtttctcaaaaaaaaaagggggggcggggggtgggtagtacttctgcttttttcttctagtaggtccaaaactgggtttactttataaattcatctataactttattcgggtttaccttagaggccatgtttcccttcataaatcattcttgagatcaccttatagcagatggtactttataggtggatcagtctaagtgaacaactttagattttgtttctacatagcctttagaatcctgaataaatatattattatccaaactgtttcttatgggagttactttctttttttttttttttgagaggtagtcttgctctgtcgcccaggctggagtgcagtggcacaatcttgtctcacttcaactctgcctcccaggttcaagcaattctcctgcctcagcctcccgagtagctgggattacagatgcctgccaccatgcccggctaatttttgtattttagtagagacagggtttcacccccatgttggccaggccggtcttgaactcctcacttcaagtgatctgcctgcctcggcttcccaaagtgctgagattacaggcttgagccaccacacctggccaggagttactttcatcctgcttttttattgcatgtgctgcaaatatagaattctactaaattgacattttctcgtgatattaagactagttcacatctctgcaggggcattttaagaaatcctggcggtcaaggatttaatcttatcacttttagataaatttttaaaaatttaaaacattcaatgttttacttatatacaagatatgttaccacagataattatttgtttatttatttgttaatgaatgacagggtctcactatgtcacccaggctggagtgcagtggtgcaatcatgactcactgcagccttaaccttctggggtcaagcaattctcccatgtcagtctcctgagtagctaggagcacaggcttgtgccaccatgcccagctaacttttttttgtggggggggggagtaaagactggatctcactctgttgctactgggctcaaatggttctcctacctcaggcccccaaagtgctggaattatagttgtgagccactatgcttggccatatatttttgaaatggggttttgttatgttgtccaggctgaacttaagctcctgagctcaagagatcctcctacttcagcttcccaagtagttgggactacaggcgtgcaccactatgcctacaaataatcattaactactgttcctttatttgcaaaatatcccatttttattagttgtccatcccaacagagccacagactaaaagttctctaagaaaacttacctggactgggcacagtgactcacatctataatcctagcattttgggaggccgaggtaggaggattgcttgagcctaggattttgagaccggcctggacaacataacaagaccctgtctctattttttaaaaaaagcaatgaaaaattacctaagttttaggcccacttgtctgcatttttatgtcatggatctgtcaaatgttcattcatttaagaaacatttaatgaataccaactgtataacagcctgtctgataacttcatgggtacagtaaggaacaagagaaggcccttgccctcaaattgtttacagtcagatgtataaagctctgacctggatgttgatctctgagaatatacaaccttattgtcacccatacacaaacacttaacagtaaacagtaccaagcagggattgataaaggagagatggtgtagaccaggggtgttcaatcttttggcttccttgggctacattggaagaagaagaattgtcttgggtcacacataaaatatactaacactaatgatggctgatgagcttaaaaaaaaatcacaaaaaaagatctcataatattttaagaaagtttacaaatttgtgttgggctgcattcaaaaccatcctgggctacatgcggcccatgggctgtgggttttgactaagcttggcccaaaccctaggtgctatagaatttggaggcatttaagactgtcgtagtcagggaaagtttatagaaggagatggactgaaaggagagggaagttcctctgggaagttagaacaatgtgagcacaattcagagtatgcttaaaatagggagtagtttaactctagcattggttcctaaagtgtggtccacagaccggtaacatcagcttcacctggtaacttattagaactacagtttcacaggccccacctgagacctactgattcagaaatactggcaatgaggcccagcagtctatgccctccaggtggttctgatgcgtgctaaagtttcagaaccactagactagagcagagggttattgtatggaacaagtaggcaaaacactctaaaaaggtaggctgggaactcattgtgaatgacttagaatgtcagacagggagtttgtcttttatcctgcagactagaggccccagcttgtgacttgagggctggacttggctcatagaatgtgtttcgtttggcctgaatggtaggtttttgggggtttttaaatggaattagttgtcatcatttaaaaatcagcagattttacaaagaaatctgtgctttcagcttaccttgaaaaatcagaagacctggcagtatggagcctacattccattatggtagcagttggtgggaatagcaagaagctgcccctttagatgggacacatgctctccagtttactgcaatccccaccggttccttttgtcttacacacacctttactcatttatatttcctgcctggtgcctgtaggtgtttgagtttgtaacttctgttgtggacagtgggacattaatgaaaattttgagaagcagagtgatgagatttatgtatttgttaatttatttaacaaacattaattaaacatatatgccagattgtactctgttaagtaatcagtgttcaaagatgaatgagtcccagctgggaccggtggctcatgcctataatcccagcactttaggaggcgaagtctggtggatcacttgaggtcaggagttcaagaccagcctggccaacataatgaaacccccccctctctactaaaaataaaaaattagccggggatggtggtgggcacgtgtaatcccagctacttgggaggctgaggtgggagaattgcttgaacccaggaggcggaggttgcagtgagccgagatcatgccattgcactccagcctggatgacagagtgagactccatctcaaaaaaataaaaataaataaaatacatgtttactttggagaccttatagttagaatttataacatgggttgcgtgagtcaaatccataattcaaatcctgtcttgaatgtgtaatcttcagatttatgttgcataggtaagtttaacttttttgttcctgagggaatagaaaataatatataaactcaaattcttaagtgattctttcacctcagcctcccaaagtgctgggagtataggcatgagccaccaagcccccatctgcttggtcccttttaaccacatactcgtgcatgtaatagtaagtagccactcattgatcatactgtggaacatatggctgacattttaacagcaaaaaaagacctcacatctcggctcactgcaacctcgacttcccatattcaagcaatcctcctgtctcagcctcccaagtagctgggactacaggcacatgccaccacacctggctaattttttttatattttgtagagatggagtttcgccacattgcccaggttggtcacaaactcctgagctcaagctgtctgcctgccttgacttcccaaaatgctaggattataggcgtgagttgctgcgcccagtctgtgtactttacttatgaattagctccttggtcattgccttctccacctttacacacacatatacaccagcttctagagggagtgtgacttgcttctcttgctgttggtgactttttaaatgagctggatgtgtggtaaagtggctgaggttgtagtttgagtgagaagaaagtgtaggggagcagaaagagctgaagggcattagactacaactcaggagatgagcttggtgatctgggttccaaagcctgaaaagattagaaatgaaaatgtggaagagataactgagtcaaaagtaggcatactgacagcagagaaaaagaggaaactgttcttataattattcatgtccatcttacacaggttgaaaaagtgatataataaaggaaccaaggagaaaattcagaaggaaagaaaaaattggtaagtaacatatataagtaatacttcactttttcataggtcagatttctgcaaattctgctttgttgttcctagctgagagctcacagtagatggaaaagggtccataaggcactgaaagagctgtcacaaagtgcagtacccttattctgttggagaggtcttcatttgcttatgttgacatgaaattctaataattatggcttcctgatttacatcctacaacagatttaaaaagaaaattaggaggtaatggtggtttattgaaggagctgggcacatgacagtactgatcagtgaaaatatatagcatgatgtcagaaaaaactagctcaaaaaggatagcaatctgggaccatttggtgacagaagggcaaacagtcctgtagacctactgtagcccttggaggcatctcaggtttacaggaaaatataactgataatcataatcatgactttgaactataaataaaagtggttttccctgtaggaaattatataattcacaatggaaacactttttattttttttttttgagatagagtttcgctcttgttgcccaggctggagtgcaatggcttgatcacggcttactgcaacctctgcctcctgggttcaagcgattctcctgcctcagcctcccgagtagttgggattacaagcatggggcaccatgcctgactaattttgtatttttagtagagacagggtttctccatgttggtcaggctggtctcaaactcccgacctcaggtgatctgcccaccttggcctcccaaagtgctgggattacaggcgtgagccactgcgcctggccgaaaacacttttaccaaacactaagtgttatagtggagccaggtgcagtggctcacacttgtaatcccttgagaggtttgggacttgggaggctgaggctggtggatcatttgaggccaggagtttgagactgtcctgggcaacatagcgagactcctttctctataaaaaaattgaaaacacggctgggtgcggtggcttacgcctgtaatcccagcactttgagaggccgaggcaggcggatcacgagatcaggagatcgagaccatcctggctaacacggtgaaaccctgtctccctaaaaatacaaaaaattagctgggcgtggtggcgggcacctgtagtccctgctactcaggaggctgtggcaggagaatggcttgaacccaggaggtggagcttgcaatgagccgagatcatgccactgcactccatccagcctgagcgacagagcgagactccgtctcaaaaaaaaaaaatcgaaaacatgcaaaaattatctgggtgcagtggttcatgcctgaagtcccagccctctgggaggttgaggcaggaggattgcaggagtttaaggccgcagtgagctgtgattgctccactgcagcctgggtgacagagcaagaccttgtcaataaaattaaatttttttaaaaaccccaagtttttttggtatttagaaggaaagcattttaaagccacatttggtgggggaaagacaaatttgggaaaatgtaattatggggaacccctattccttcctttatacatgaaactatcattgtaatatttttatctttggcatgtttttcattttgatttaacatgtttgaagcagtagctatttttcagttgataacaagaaagggaaaatgtttttattctcttcccacagttaaaatccaatataaacggtgcccagtggcactgatcctagtggcagttactcttctgtaaatagtgcctcccacaatggatatgggtttggaggcagacagagcttatcacctcagattttcattctgatttttcattggggcaatatgaaccccctcctgaatgacagtatcttcttatctaaaggactttgattcttaatgaatgggcaagaaaagaccttctggtttgtgaagaaaaagaggcaacaatagcaacagctttcctccaagtgattattgtagcgaagtcaagcctgaaacaatggagaatgaagttatgcctgactcattttgttattacacccaaatgagttcattgtacagaatgggcctttttgacacgtgtctaatgatattttgatgcaaatgaaataatacacataaaaaatgacctgtttacaggaaagactgatgtatttgttgataactaccagtgacatcaattctcatttctttattggcagttacagtatttgaatttagggttagaccttaaaggatatatccagccaggcatggtggtataagcctataattccagctactcagaaggctgaggcaggaggatcactagaactcaggagtttgagaccagtctgggcacaagaagaccctgtcttaagaaagaaaaaataaaagtctaggccaggcgcagtggctcatgcctgtaatcccagcactttgggaggccgaggcgggtggatcatgaggtcaggagatcgagaccctcctggctaacactgtgaaaccccgtctctactaaaaatacacaaaaagttagccgggcatggtggcaggcacccatcgtcctagctacttgggaggctgaggcaggagaatggtggcgtgaacctgcgggaggcggaggttgcagtgagccaagatcgtgccactgcactccagcctgggcgacagagcgagactccgtctcaaaaaaaaaaaaagaaaaaagaaaaaataaataataaaaaataaaaggctatatcatttgacaagccgtctgatcagtgaatctgttctggaaacatgatcagatttggagcaaagacccttccctccctaccagtttgagacagctcatattgttggaacttaattctgttcaatccctcccccaggaggttccatgctcactggtcttattatatgtaagtctttgacaatgatctaagaaaagctgagttaaaaaattttttttttctttgtctgggggtggtggcttatgcttgtaatcccagcactttggaaggctaaggtggacgcatcacttgaggtcaggagttcaaaaccagtgtggccaacatagtgaaaccccatctttactaaaaaatacaaaaaaattagctgagcatggtggcgggtgcctataatcccagcttctggagaggctgaggcaggataatcacttgaacctgggaggtgcaggttgcagtgagccaagatcacaccagtgcactccagcctcagtgacagagtgagactccatctcaaaaaaaaaaaaaaaatttttttttttcaacacaaggtctcactctgtcaccgaggctggagtacagtggtgcaatcacagctcacggcagcttcaaactcctgggctcaagcgatcctcctgcctcaccctcccgagtagctgagactacaggtatgtgtcaccatgctcagctcaaaagctgacttttaaataaacctttttattagttttattgacttgaaaaatattgctataaaatttttctatggttttcaaatctgttccagttgtcagtcttgtcccttttcaccaaatacctcttcagtacctaatttttttttttccaaggtggagtcttgctctgtcacctagactggagtgcagtggcgtgatctcagctcactgcaacctctgcctcttgggttcaagcaatttcttctgccacggcctcctgagtagctgagactacaggcatgcgccagcatgcccagctaattttttatatttttagtagagacggggtttcaccgtgttagccaggatggtcttgatttcctgacctcgtgatccgccctccttgacctcccaaagtgctgggattacaggcgtgagccaccgcgcccggccatacctaatttttttctaagagacaggatcttgctatgttagcttggctggccttgaacttctaggctcaagtgatcctcctgagtagctgggactacaggtgtgtgccaccatgcccagctagtacctaattgttaatgctacctgatatgattggaagtttttttctgtatgtagcataaagtttctattctgccaatacaagtattttctttcattctgtatctttgttgatttagtgtttaatttcagatttattatttaattcttaactgatatgtatcttcaaaacaaatacagtgactcatttattttcttcctactctttcttaactatatctgacttttagttgaataataggtggggtagctcaggcctgtaatcctaatgctttgggagactgaggtgggaggatctcatgaagccaggggtttgagaccagcctgggcaacatagcaagactccatctctataaaaaatttgaaaattcactgggcatggtggctcattcctgtagtctagctagtcaggaggctaaggcaagaggatcatttgagctcaggaggtgaaggttgcagtgagctgtgtctgcaccactgcacttgagcctaggtgataaagcaagacatcttctcatttaaaaaaaaaaaaaaaagggccgggtgtggtggctcacacctgtaatatcagcactttgggaggccgaggcgggcggatcacgaggtcaggagatcgagaccatcctggctaacacagtgaaaccccgtctctgctaaaaatacaaaaaattagccgggcgtggcggcgggcacctgtagtcccagctactcgggaggctgaggcaggagaatggtgtgaacccgggaagcggagcttgcagtgagccgagattgtgccactgcactcctgcctgggcagcagagcgagactccgtctcaaaaaaaaaaaaaaaaaggcttggcgaggtggctaatgcctgtaatcccagcactttgggagtccaaggtaggtggatcacctgagatgatcaccagcctgactaacatggagaaaccccgctttgtctctactaaaaatacaaaatttgctgggcttggtggtgtatgcctgtaatcccagctactttggaggctgaggcaggagaatctcttgaacctgggaggcagaggttgtggtgagccaagatcatgccattgcactccagcctggggaacaagagtaaaactccatctcaaaaaaaacaaaaaggtatttaaatttcttttcacctttagaaacaagaagtacattgtgtgagttgtagtttttctgactttaattcttttccttaagtaaaatattaggactataacagaagatggaagttaaaagtcaagtcagcattgttgttcattttgtttgtttatttgttttgttttttatttatttttttgaaatggagtcctgctctgtctcccaggctggagtgcagtggcatgatctcagcttaccgcaacctctgcctcctgggttctagcgatcctcctacctcagcctcccaagtagctgggattacaggcgtgcaccacacacccagctaatttttgtatttttagtagagatggggattcaccatgttggccagactggtcttgaactcctgacctcaggtgatccactcccctcagcctcccgaagtgctgggattacaggcgtgagccaccgcacctggccagttgttcatttttaagagttaatagcagccgatgtgatggctcacacctgtaatcctagcatgttgagaggccaaggtggaggattgcttgaggccaggagtttgagagcaatctgacaaacatagtgaaaccctgcctatatttcttttctttttttttgagaccgagtcttgctctctcacccaggcaggcatgagccaccacgcctggtttatttctttttttctttttttctttttttcttttttttttttttttgagactgagtctcaccctatcgcccaggctggagtgcaatggtgcgatctcagctcactgcaacctccatctcccgggttcaagcaattctcctgcctcagcctcccgagtagctgggattacaggcatgtcccatcatgcccagctaacctggcttatttctatatattatttttttctaagaataaacaaatgaacaaaaacagttaatatcattggaataacatgcaggtcctaaaataagaagtatgtaagatgtgtttattgaaatatatatatggtatactggaaaaaaaaccccacaaaatattacacaaatactggttacagcttacagtagccagcctccaagatgccccccagtgatgctcacctcctaatattcatgcctttgtgtagtccccttttacagttcgtcagggttggtctgtatgagcattagaatatagggatatgatagtgtatgacttccaaaacaaagtcataaaagacattactgcttctgccctgctcttcttggattgactgctctggaggaagccagccactgggttataaagacattcaagcagccctatggaggatctacacggggagctactgagacttcctgcccacagctggcatcaacttgccaaccattgagtgagccatcttggaggtgggtcttccaggcctagtcaagccttcagattgactgcagccccagcctacatcttgactgcaatctcatgagagcctcagagccaaaactgtctaattaaaccactctcagagtcccaaaccacagaaataatgagataggccgggcgcaatggctcacacctgtaatctcagcactttgggaggccaacgcaggtggatcacctgaggtcaggagtttgagcctggccaatatggcgaaaccccgtctctactagaaatacaaaaattagccgggtgtggtggggggtgcctgtagtcccagctacttcggaggctgtgacaggagaatcacttgaacccaggaggcagaggttgcagtgagccaagatcacgccactgcactgcaacctgggcaacagagggagactctgtctcaaaaaaataaaaaagggatgagataataaatatttttattgcttaatacatgtatttatttacttaattaatttattttttgagacagggtcttgctctgtcacccatgctggagtgcagtggcatgattctagctcactgcagcttcgaactcctgggcttaagtgatccttctgcctcagcctcccaagtagctgggactgcaagtgtgcactgccatgcctggctaattttttcattaaaaaaaaattttttttaatagggttttgctgtgttgcccaggctggtctcaaactcctgggctccagtgatcctcctgccttagcctcccaagtgttgggatttacaggcatgaggcaccatgcccagccaattttttttttctttttttctttttctttttttttgattcttcagctaagacagcagaagagatgatttatcgtatggttgttatactcggccacaagtaaacacagaaatagtccagaatgtcccaggtccagggcagaggaccaacatgggcagttttggttatgagcaaggtgggtctcagaggtgatcagcgatcagagggcggtgaagttctggatccattgagacaagctctacacaatagcatgcagtcccacaacttgtaccagcatccccagcatctggcattccatgtttctgctcctgtgtggcctccacggtgcaacaagctagcggtttacttggacctctgcctcatctttcttcttttgtgcttcagactgcacattcgctttttcctccacttagctctcatgatgcagaggtttccaagaaaatggcgctaaggccgagagaaaccctagcccatttctattgtcagtttttattgaattccaccttggacgctcttctaggttcttgggttacaccagtaaacaaaaagatttctgctcttgaggagcttatattctatcagaggaacacagacaataaatatcagtaagctttccagtatgttagaatgtgataagtggtgtggaaaaaagaaaagtggatcagagtaaggggagttgagaaagcaggtagaggtgggagcatgtgaaggtgagaggttatagtattaagtagatctcaataagaaagtgatttttaaacaagtatttgaaggagttgcaggaattcatcaagtggatatataggaaaagaatttctaggcagtggggacagcttagagcgaaggccctaaggcaggggcatgagtgaataagcgcagaggtcagtgttgggggagagtaaggtgaaaactattagtagatggggtcagagatgtagtggggatggaagcagaaggctattttcaggaccttgtttctctgaaatggggagccagtgctggattttgcataaaacagagacatactctaatttatattaaaggatgactttggttgtttgttaaaaggagacaaactccaggggagtgaggataaaagcaggaagatctgttaggacaatattagcaaatcacatgaaagatgatagtggcttgggcgaaggtggtagcaatggaagtggtcagaaatggtcggattctggaaatgtattcaacagcaggaaattaagatcttcaaaatctcttgattagctgggcacagtggctcaaccctgttatcccagctattcaggaggctgaggctagaggattgcatgaggccaggagttcaagaccagcctgggtaacatagtgagactccatctctacataaataaataaataagctcttgattttatgtaagaaggtcagactgctgtaagactttcacatcctgatggaagtctcactttccagcctcatctcagaccattctctgctctacactcgcctccccactcccatatctgtcttttccaagagccctgttagataatccttcttgggtggcctactagttaagactgtggctctggaattaaaccatctgggtttgatttctggctcatttcatttaactacgatgtggtcttaagatacttagtttctctaagctcagttttctcatttataaaatgggaatcttaataatagcacctaactcacagagcagtaatgtgagattaaatgagctaatctatgtagaatacttaacatcatgcttggcatctactaagatctccgtaaatattggttactatttttttaaaatctcagattatgtttctttgaccacaatctttatcctctgcattaaatgctaaccctcttcttctatatcctctttcactagttttctactttttatttctcaaattcatataaaaaattcttgaggacattggcttttaattattattatttgagacagggtctcactctgtcgcctaggctggagtacagtggtgccgtgcaatcacagttcacctcagcctccacttctcaggctcaaatgatcctcatacctcagcctcctgaatagttgagactacaggtgtgtaccaccatgcctggctttttttttttttttttttttttttgagatgaggtcttgctctctcgccaggctggagtgtagtggcatgatctcggctcactgcaacctccgcctcccaggttcaagcgattctcctgcctcagcctcccgagtagctcggactacaggtgcccgccaccatgcctggctaatttttttctttttttttgggatggagtcttgctctgttgcccaggctggagtgcagtggtgcaatctcggctcactgcaagctcggcctcccaggttcacgtcattctcctgcctaaccctcccgagtagctgggactataggcacccgccatcacacccagctaattttttgtatttttagtagagacgggatttcaccgtgttaaccaggatggtctcgatctcttgacctcgtgatccgcttgccttggcctcccaaagtgctgggattacaggcatgagccactgcgcccagacacaccctgctaattttttaatattttgtagagatagcatttcactatgttgcccaggctagtctcaaactcttggggtcaagcaatcctcccactttggcctcccaaagtgctaggattacaggcatgagtcatcatacctggcctcgctatttttaatttttatacggatagggtctcactgtgttgtccaagctggacttgcactccttggctgaagtgaccctctttcctcagcctcctgagtacctgggactatggtcacgtgccactccatatggctcttgaggaaatttttaaatgaaatcaaacgatacttttcctatcatctttttctaatctctctggtctttatacacatctggtctctattatttctgtagttatttctgtccatttttcatgattgcttacatgtcatttcattttttttgttgttgttttgagacaggttcttgctctgttgcccaggctggagtgcagtggcatgatctcggctccctgcagcctcgcctcccaggttcaagcaattctcccacctcagcctcctgagtagctgggattacaggcacaccaccacgcctggacaatttttgtatttttagtagagatggggtttcaccatattggccaggctggtcctgaactcttgacctcaggtgatccaccctcctcggcctcccaaagtgttgggattacaggcgtgagccactgtgcccagccatttcttttatatatgcttatatatatattttttaaattgagacggggttcagtcttgtcacccaggctggagtacagtggtgcgatctcaactcacagcaacctccacctcccagggggctcaagcaatcctcccacctcagcctcccaaatagctgggactacaggtgcattccaccatgcctgactagtttttgtatttttggtggagatgaggtttcatcatgttgcccaggctggtctcgaactcctgagctcaagcaatctgcctgccttggcctcccaaagtgctaggattacagacgtgagccactgtgcctggtctcaaatgtcttttcttgatgcgtttccaaatcctctagggagttagtcctgtgtttttgttcctttaccttttttttttttttttttgagatggagtctcgctctgtcgcccaggctggagtgcagtgacgcgacctcggctaactgcaacctccgccccctgggttcaagtgattctcctgcctcagacccctgaatagctgggattacaggtgcatgccaccatgcctggctaatttttaaatttttggtagagatggggtttcatcatgttggtcaggctggtctggaactcctgacctcatgatccgcccgccttggcctccccaagtgctgggattacaggtgtaagctactgcgcccggccctttacctttttttttgagacggagtctcgccctgttgcccagtctagagtgcagtggcttgatcttggctcactgcaacctccgcctgccaggttcaagcaattctcctgcctcaccctcctgagtagctgggattacaggcacgcgccactgcgcctggctaatttttgtatatttagtagagacggttttaccatgttggtcagtctggtctcaaactcctgacctcatgatccgcccaccttggcctcccaaagtgctgggattacaggagtgagccaccgtgcccggcctacctttgttttttttgggggggtggggggcagagtcttactctgtcacccaggctggggtgcaatcctgtgatcttggctcactgcaacctctgcgtcctgagttcaagcaattctcgttcctcagtctcctgagtagttgggattacaggcgcatgccaccacacctggctaatttttgtatttttagtagatatggggtttcaccacgttggccaggctggtcacgaactcctaacttgaggtaatccacccactttggcctcccaaagtgctgggattacaggcgtgagctactgcgcctagcttctttaccatttttatgcttagtttaaaaagttacggttatttttatatatgtctgccacctctgccagactcagcatcttgaataaaaagatctgttttcctcacctttacttttctggcacctagcagttagtaggcatcagtaagcattagtagaattaagcaattgagtggtcctgacaaggctcctgactgcagtccttacatgtaactaccagattcgtatttggatactccctagttcaatatcttcagtggcttcctatcacctgcagagtaaagtccaaactccttagctgagtatttggtgtcctctactatgtgacctcaatctatctcttcaactttattttctactatagttggtcaaactgatccattcactgttcctcaggggcccccatcccttttccacatccgtgtcttgattcatggttttattcctgaaaagcactccttgcctgtcctaattcatttccctcctcaggaccctcctcagatacgacctttttcacagagccttctccatcatcccagctttgaagtttcagagcatagtaactgtgctgcttgacacattttcactttatagaggtaatttatggacatgtattttttttttccaacttagtatagtttcttagggtttcttaaagtttctaagatgatttatctttgtgtgctgtacttgtaagcagcagtaagaaattgctaatttctggaatggctgtcactgtcggttactacaggttgaatgaaggggacaaacgcagaaatgaagacaaagacaaaaggatctgtttcgaaagaaggggtcagggagctccttgcttctagtgagcaaaggcagccctgagcttctaccgcccttcgtatttattagatagaaagagcagggagggagaggtaacagttggtcagctgctagatttatcacaggtacacataattgctttctttgtacaacaggcttcagatgctcctatagataattgcaaggaacactgcgctgggggtgtgactgccctcagcaccccttctggtggcagacgcagtttgtcagttttccaacatcctgctttcatgagaacagttttctgtttgctcatataacctccaatggcatactgagttggtcacgaccctcattctttctgcctgtaacacatggccaaatgaatgaatgaatataggaacaaataggcttcacatgccctatccatggtctagtttggaggggaattgggagttggacatgtaatacctaggccgtagtggaacactgggaaagggggtactccttgccctattgcttctgcctgcatattccattagcctaattgtaccaagtccatttgggattcaattactggtgtccagcatgttccaggcctaatattaatacctgtctttggtaatacaaaagataccatgcaccacccaccttagacatccttcagatagcaaggtgtgtcagggctgtggccctttgtattataagttatatcctcaaataaggcattgctcactttgctgcagcctgtcctgaacttagcttattagacctaccttggttttgcttggcttggcttacttatgcactgggtggtttaactatattggttccatagttcagcttactgtttaaaaatttcattctagttacattttaaacttgccttatgtttaatttttaacttgttaaggctagctttgctgtggagctcagatgaattgtcagtgggagcttttacatttcactctttttggaccttttggtggacctttctaatcacctatccaattttccactgttgtgagatactgtattattttatccaagtcaatcaataatgatatttgcttagggagtcaacagaaagacataactaacaatcaatctcactatgggaaaggaaaacaagtccactccttttgaaatctgattctctgcttccagagccattttccctcactctggctgtctttattctggtacacctctatattccagctgtaccaagctgttaatacttgaagttctcagaatcctccttgtgtcattttcccaggataattcctacctctcatccctcaagaagcttcccagtcccatcccaccttcacctttccccttccaagccaagtttcttgtcccttatgtctgttcctagagcactttgtgtgcatttctgtcagagaacttatcacagtacattacagtcgttggtttgcttgtctgggttttgttagtttgttttttgagacaggttcttgctctgtagcccaggctggaatgcagtgatataatcatggttcatgcagccttgacctcttaggctcaagcgatcctcccaccttagccttctgagtagctgggactacaggtgcatgccaccatgcccagataatttttttatttttgtagagacagagcttcactgtgttgcccaaggtggtcttgaaatcctgacctcaagtaatcctcctgcctcgaccttccaaagtgctaagattacagacaagagccactgtgcccagccctgttttctccagtaagctgaaatttcttctatatcggattcctctgtatatatcaagaatctagcacagtgcctggtatatattagatactcagtacatgcttattaactagacaggtgaatgcccaggtttctaaagttttttttttttttttttaagagaccaagttatgttccatccaggtttctaaattctgtgtcagggatggaaggtattgagaagtgctattaacttttctatttggctaacaaaaacacagaaatgagttgctgagcagcttccgccctatgagcgataatcctactagttggaagttaactatgataaaagtagatgaacgaattgtgtactcagagaaaaagagagtaagggaggagggaaggatagagaagggagtgagttagcaaaatgccacactgttagttgcaaactggcacaaaggtgaatgcggttcatgaggctcgcttgattaagaagagctgaaacaggagcaaagagcaaaaggcaacctgcagcgaaagcaaggactcagggaaccggcagacacaagcaggtgagcacatgaatggggcccaggtcctctgggattgtggtctctcaggcttccggggacatggaagaagggaagccagagtgtgacgttctgggaaagctgagtggggaggattcatgtgtactccaggtataaagagacacaaaagaccatagaaggagatggagatagtgacaaacactggctggcaccagagtctcaacaaaaagaattggaaacagggctttgttggggggtgaataagagatagtgagcaagagaaaatgagaagaccaactgtgaaaggagtagatttaaatgtactgacgtatacatacctccctagtctacaaaaagtacgcctatctgcactattttgagtagcatataaaacttgacacatttggataaatgtcacctttatataacaaatgtggggaaaaccttcactgaagcttggaattgtgatttttttcaggggctgggtaattttttggaaagcagtcagctattattattattattattattattattattatttgagatagagtctctctctatcactgaggctggagtgcagtggcacacttaacaggcgtgagccactgtgcccgatcagctgttacatttttattaaatgggtgagatctagtgcctgagttactgtattattgtttatccctttggagtattcattcaacatctactgtgtgctcacaccaccattccagcaccaggaacacataaaaaacaaaacagataaaaattcctgcttacgggccagccaaggtggctcatgcctataatcctagcattttgggaggctgaggcgggtggatcacttgagaccagaagtttgagaacagcctggccaacatggcaaaaccctgtctctattaaaaatacaaaattagccaggcgcggcggcacatgcttgtaatcctggctgcttgggaggctgaggcatgagaatcgcttgaacccgggaggcggaggttgcagtgaggtgagattgcacaactgcactccagcctgggtgatagagcaagactctgtatttaaaaaaaaaaaaaaaaattctgcctggctatgtatagttcacatagtgggtaaaggtggcaggaaacaggaaatatgaaaataaacaaaagtaaattatataatgtgttagatggtaaaaagtcctgtggagaaaaataaacagaaaaggaagataggaaaacatgatgtggtcagatgggttataattttaaataaggtagacaaggaaggtctcactgagaagctgacatatttgagcaaagattttaacatagtgaacgagcaagctgtgcagactcgggttctgtaaaataggatgtcattctataaatgtaagactttttttttttttttgagatggagtctcgctctgtcgcccaggctggagtgctggtgcaatcttatctcattgcaacctccgcctcccgggttcaagcgattctcctgactcagcctcccaagtagttgggattacaggtgcctgccaccacgcctggctaatttttgtgtttttagtagagatggggtgtcaccatgttgaccagtctggtttcgaactcctgacctcatgatccacccacctcggcctcccaaagtgctggattacaggcgtgagccactgcacctggcacattagttattttaaaatggcttacattgctcggtgcggaggcttgtgcctgttatcccaggactttgggaggctgaggcgagtggatcacctgaggtcaggagttcgaaaccagcctggccaacatggtgaaaccccatctttactaaaaatacaaaaaattagccaggtgtggtggtatgcgcctgtaatcctagcttctagggaggctgaggcaagagactttcttgattccaggaggcagaggttgcagtgagccaagattgcaccattgcactccagcctgggcaacagagtgaaactccatctcaaaataaataaataaagtttaaaaaaataagacaatgcctaatgccattttaaaataactaatcttaaaagtgcgattgcaagtggtttagaatgtagttactgagagctgaaaggggcattctatttgttcatcctttgctttctctaaaatctattgtttggttttacactgaacaactagtatgactctgcagggttttttgtttgtttttttttttttgttttttcgtgaaaacagatacctaggatgttttttttcacctttgaaatctctggaagaaaaacaaatatttacttaatagaaatagaagctggagaagtttttcaaaaactacaatgatatattaatacaaaatttgggtgacccctgaagaaactgcagtcacacagaggaaggaaagctgctgcctagaatgccattaattcactttctgagggaaaagagggacccagagttggacaaagcaaggatctgttaacactcagagactctgaagagttgtttctgtttcgagttatttagtttgatctacatgtctagctcatttgctgtaaaagaatcagccagagtgtgaacctggccaggcagctatcctgtatcagtggttgatttcctgggatgaagtttcctttgtttgggattgtaaaaggtcaaacaattttgtctgttcctctcctaaccaatagctcttattcttaactacaggatagaagttcaaccttgaatagtgttctaacggatggttccagctctgctttggtagtacctaagaccaaatctagttattttaaatattttatttattgagacagggtctcactctgtacctaggctgaagtgcagtagtgcagtcacagctcactgaacctcaacttcccgggatccagagatcctcccacctccagcttcccaagtagctaggaccacaggtgcatgccaccacgtccaactaatttttgtacttttggtagagatggggtttcatcatgttgcccaagctggtctcgaactcctgacctcaaacaatccactcaccttggcctgtcgaactgccgggattacaggcatgagccactttacccagcctaaatattttaaaattccaaatatagttaactttgttttatgtatttattttgagatagaatctcactctatctctcatgctggagtgcagtgacacagtctcagctcactgcaacctccgcctcccaggttcaagcaattctcgtacttcagcctcccaagtagctaggactacaggcctgtaccaccatgcccggctaatttttgtatttttagcagagacggggtttcgccttgttacccaggctggtctcgtactcctgacctcaagtgatccgcccgcctcggcctcccaaaatgctgagatgataggcgtgcgccaccacacccagctgcaattaactttaatttgcttttttttttttttttttgagacggagtcttgttccgtcgcctaggctggagttcagtggcacaatctccgcttgctgcagcctttgcctcccaggttcaagcaattctcctgcctcagcctccctagtaactggagcgacaggcatgcgccaccacgcctaatttttttttgtattttaatagagacagagtttcaccatgttggccaggctggtctcaaactcctgacctcaggtgatctactcacctcagcctcccaaagtgctgggattataggcgtgagccaccacgcctggcctaatttgctttattttgtgtaatatgtcacctgtggggagggagacattttgataaaccctagatactcaacaaagttgagatgattgagaatccttaatctgtactccaaatatacgaagtattttgttagagctgaagggcctgggaaatgggaactttagaatcagatcttgtcacttaaccagtaaactatgacttacataagagatccagagatgaaagctggatcagaagacccaaaactgtttggtgcaaagtacataaagtgcaagtcaggaagctttaccttagaggatagatacggcattattcattaataccggaagaaaatggcagagaaaacgtttatatacatacatatatatgaaaatattttatatatatatatactttttttttgtgagacggagtttcgctcttgttgcccacgctggagtgcaatggtgcaatctcagctcactgcacccttcacctcccgggttcaagtgattctcctgcctcaggctcccgagtagctgggattacaggctatttaaaaaaaaatttttaaataaacataaaattaaaatacatagaatatattttatatgtaaatatacagagcaggaaaattagccagcagacagctggcaatgtctggagacgtttttggttatcacaactggttgtgggtggaggggcgggatgtgctattgacctctagtggatagaggctggggatactgctaaacatcctaccttacacaggacagcgcccacatcaagccctaattgttttttttttttttttttggttattgtttttttttttttaagacagattcttgctctgtcctccaggctggagcacagtggtgcgatcttgactcactgcagcctccgcctcccgggttcaagtgatgttcctgcctcagcctcctgagtagctgggattacaagcatgcaccaccacaactaactaatttttgtattttagtagagacgggggtttcaccacgttggccaggctgatctcaaactcctaacctcaagtgatccgccagcattggcctcccaaagtgctgggattacaggtgtgaggcactgctcctggcccctaaatgtaaacagtgctaagattaagaaaccctgaccttgaggaactccagttttcctttacggatgagatcataggacacagtctgagctttgcaggaggccagatacaaatcaccaaaacaaaaagcacttaattgtttttgttggtttctcatttaatgtccatccagaaaaaaagagggggaaaaaagttgctagtaaagcaactgtgaagtatggatgccattattccattcaacactaccaagtgattttttgtttttgtttttgttttgagacacagtctcactctgtcgcccaggctggagtgcagtggcatggtttcggctcactgcaacctctgcttcccggtttcaagcaattctcctgtctcaacctcctgagtagctgggactactggcgcatgccaccatgcctggctcatttttgtatttttagtagagatggggttttaccatattggtcatgctggtctcgaactcctgaccttacatgatccacctgcctcggcctcccaaagtgctgagattacaggcatgagccactgcacccagccacaaatgttttttatcacaggtttcaataatattcaaactcatgataatggctttgttgcagaatgatggaaaaaaaccctatacatttaaaaaattattttccagtaaaacaaatccggctgggtgaagtggctcatgcctggaatcccagcactttgggaggctgaggcaggtggatctcaggctgagttcaagaccagccagggcaatatggcagaaccccatctctaccaaaataaaaaaaatagccaggtatggaggcacacacgtgtaatcccaactactcgggaggctaaggaggaaggatcacttgagcccgggaggtgatgattgcagtgaaccgtgattgtgccactgcactccagccggggtgacagagtgagaccctgtctcaaaaaaagatggggagtcagaaaagagggagggagaaacggatatttatgttctaaagggaaaatcatcaaaatggaaagaagaaattagactcaacaataggagcagagtggcagagagcctttgagtatgtgagagccaccctacaattattattttttatttttagagacagggtcttgctttgtcacccaggctggagtgcaatggcatgatcatagctcactgtaaccttgagctcctggactcaagtggtcttcctacctcagcctcccaagtacctgggactataggcatgtgccaccatacctggctaatttatttattatatttatttattttttttgagacgaagtcttgctctgttgcccaagctggaatgtagtggggcgatgtctgctcactggaaccttagcttcccaggttcaagtggttctcctgcctcagcctcctgagtagctgggattacaggcacctgccaccaagcccggctaatttttttttttttttttttttttttgagactgagtcttgctgtgtcgcccaggctggagtgcagtggcacgatctcggctcgctacaacctctgcctcccgggttcaagagattctcctgccttagcctccccagtagctgggattataggcacccgccatcatgcccagctaatttttgtatttttgtagaggcggggtttcaccatgttggccaggctggtcttgaactcctgacctcaggtgatccgcctgcctcggcctcccaaagtgctgggattacaggcatgagccaccgcgcctggcctaatttttgtatttttagtagatacagggtttcaccatgttggccaggctggtctcaaactcctgacctcaggtgatccgcccgcctcggcctcccaaagtactgggattacaggcatgagccaccgcgcccggcctaatttttgtatttttagtagatacagggtttcaccatgttggccaggctggtctcgaactcctgacctcacgtgatccacctgccttggcctcccaaagtgctgggattagaggcatgagccactgcgcctggcctgtgtatttttttgtagagacagggctctcgctatgttgccaaagctggtcgtgaactcctaggctcaagcaatcctcccacctgagcctcccaaagtgctggaattataggctggagccactgttcctggcccccaccctataattaaaagcaaagtggctgggcgtggtggcttatgcctgtaatcccagcactttgggaggccgaggcgggtggatcacgaggtcaggagttcgagaccagcctgaccaacatggtgaaaccccgtctgtactaaaaatacaaaaattagctgggcatggtggtgggtccctgtaatcccagctactcaggaggctgaggcaggagaatcacatgaacccgggaggcagaggtttcagtgagctgagattgcgccactgcattccagcctgggcgacagagtgagagtccgtctcaaaaaaaataaaataaaaaaaagcaaaggtcattatgttaagtgaaacacgccaggctcagaaagatatatactgcatgttctcactcatatatgggagctaaaaaagttgatttcatggaagtagaatagaatgacagttaccagaggggctgggaaggctagtggggtgtggagagattaggagaacttggttaatgggtacaaacttacaattaaatagaaggaataagttatagtgtttgatagttcagtagggtgactatagttaacaatattttattgtgtatttcaaagtagctagaagatttgaaatgtttccaacacaaacaatgataaatgttgtaatagatatcctagattctctgatttgatctttacacatcgtctgcatatatcaaaatatcacatgtattccataaatatgtacaattactctgtatttttaaaaaccaaagcatgggaaaatatatcttcaattccaatttccttttggaactagatacccttcggaaaaggtgctaagagcccacatcaccctggtttagcttgttgtacaggttattagaatagggaaggaacaccttgggcccaggagtgagtgtttcttcttttacaggtgtaactaaaaaagctagttggtctaacttgtgtgtctttgtcctataagcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggtaagtgcaactgggacccttagtagagtctgtaaatccacactttagcatctcctcccagaaacaaatatgctgagagtttattatgtgaattacagaatctcacacctagtggatgtctttcttcagagaactttggactacaattgaacatgtggtttatttatttatttttatttatttgttttgtttttattttttaactttttttttgagacaaggtcttgctttgttgcccggtctgtagtgcagtggcatgatgacacatcactgcaaccttgacctcctgggctcaagcagtccttccacctcagccccctgagttgttgagactacaggcttgtgccaccatgcccagctcatttttaaatttttttatagagacctgctcaggctggcctcaaactcctaggctcaattgatcctcccacctcagcctcccaaagtactgggattataggtgtaagtcaccatgcttggccagaacacatggtttaattcaatgtgaaattagaagagagctgggctgtctgtagtctgaaacccatgtgttcaaaaagaatagttataatttgttcttcctctttaaacatgggatactccagggatccataatattcagaatatggggagtggttttgggagaaggatcacatgagaatttcactgccatccttggacatgaggctaggaatccctgaagattaactttttctgaattgtcagtgttttttcctcaggtcacttatggagcctggggaaaggtggaggagttaggtgtccaccagagaaatggtagcagaaatggaccctcagaggttgctctagtccttctttccagtactcctgcaagacattcctcacaactaggatcatttgggataacttcagggaagtcataggaaaacttacagagacagagcccagcatctgaagcagcctaacttttggtaaccagctctctcttctgttttgttccatggacaaaataggacagcttccaattctagaaggggaagtttttgattctgtgaagccaggactttctgcttttgtagatcaacctaagcaggtgagtttcttatgatttgatgtttagattctcaatgccttgataacttgaccacaccactgctgttaaatatttcatgctattcactaatgagattgagatcatgtgtgagatcagctttctctcctcagctaatctcctggataaaattaattacatttcccacgctcatgagggctgggtggaagaaggctagaaaattggttgtggtaatgcaaggatgacactagcttttaagagattactccctatgtacttactgtttaaaattttgagttgaagccatcagttgtatttgttcatgtaagcgcagaagataaacatgaagttctgtagggtatgatgtataaacatggcagttgaaggcatggtgagcagtgaattccatttcagagtgccttgatgcaggatggaaccatatctatacttgagaaattaggcaacaacccatgatgacaaaaatctttggtggtagaagatgaatagagagtttgtggcgactatatttcacatttgagcatctacaacatactacatcctatgtgtctgaggccatgttgaaataaaatagaataatgcagaatgttaaacttggggagcaaatgtaaaggtatttattgttcattgtcacaagaataatcattacccaaatgcttgatgttaaaaatgatttgagtttggagaactgagaggatatatggatatatatacattttcttctttttcttttttttttttttttttgacggagtatcactctgttacccaggctggagtgcagtggcctgatctcggcttactacaacctctgcctcgcgggttcaagcaattcttctgcctcagcctcccgagtagctgggactacaggcatgtgccaccatgcccggctaatttttgtatttttagtagagacggggtttcactatgatggccaggctggtcttgaactcctgaccttgtgatccgcccatgtcagcctctcaaagtgctgggattacaggtgtgagccactgcacctggccccgagaggatatattttcttagttcagtagcacatggatagcaaatctactagaaaaatttggagctgttcaaaagaaactaccatcagagtaaacaggcaacctacagaacgggagaaaatttttacaatctacccacctgacaaagggctaatatccagaatctgcaaagaacttaacaaatttacaagaaaaaatcaaacaaccccatcaaaaagtgggcaaaggatatgaacagacacttctcaaaagaagacatttatgcagccaacggacacatgaaaaaatgctcatcatcactggccatcagagaaatgcaaatcaaaaccacaatgagacaccatctcacaccagttagaatggcggtcattaaaaagtcaggaaacaacaagtgctggagaggatgtggagaaataggaacactcttacactgttggtgggactgtaaactagttcaaccattgtggaagacagcgtggtgattcctcaaggatctaggaatagaaataccatttgacccagccatcccattactcggtatatacccaaaggattataaatcatgctgctataaagacacatgcacacatatgtttattgaggcatcattcacaatatcaaagacttggaacgaacccaaatgtccatcaatgatagactagattaagaaaatgtggcacatatacaccatggaatactatgtagccataaaaaaaggatgagttcatgtcctttgtaaggacatgtatgaagctggaaaccatcattctgagcaaactgtcgcaagaacagaaaaccaaacaccgcatgttctcactcataggtgggaattgaacaatgaggacacagggtggggaacatcacacaccggggcctgtcgtggggtggcgggagcagggagggaaagcattaggagatatacctaatgtaaatgatgagttaatgggtgcagcccaccaacgtggcacatgtatgcatatgtaacaaacaaacctgcacattgtgcacatgtaccctagaacttaaagtattaaaaaaaaataccagggtcaggggtatatttgaatagtaaataaataaattaattaattaaaaataaataattaaaaaagaaaaattaggagctgttgaaagcaactatattattagaaactgacttggcatttagaaaaggtgatcgtgttgtagttgctaacaataatgatcaaagggcagtcagatatcagaatagaagttcattcagggaaatagtggatttaaaataatggttttcatttattacaaattgagcatctactgtgtgccatatgatgatacaggaatgagcctgacatgttctttaggagatcatcaaaagtatggcatcattactgccacagcttgtgtggtaaccacatgcactatgcctcatgcacacaacagtttagtggtggtaggcagcgtatctaccatcccacacttgaggaaaccaagtcccaacaaggccaagtgacctaagttaggccacagggctagcaagcaagtcttctgactctaactcctgttttcttcactctaccatcctaaagctgatttatatataagaaacatgaaataatcagccaggtgctgtggcgcatgcctgtaatcccagctactcaggaggctgaggcaggagaatcgcttgaacccgggaggcagaggttgcagtgagccgagattgtgccgttgcactccagcctgggtaacaagagcaaaattccgtcttaaaaaaaagaaaaagataatcaactaaaatgatcacaatataaaagaataatttggccaggcacggtggctcatgcttgtaatcccagcactttgggaggggtgaggtgggtggatcacttgaggtcaggtattcgagaccagcctggccaagatggtgacaccctgtctctactaaaaatacaaaaattatctgggtgtggtggcatatgcctgtaatcccagctacttgggtgactgaggcacaagcatcgcttgaacctgggaggtggaggttgcagtgagccaagatcacaagatcatgccactgcactccagcctgggtgacagagcaagaatgtcccaaaaaaaataataataataataataattttttattaggactgtcaaaatgaaatggattctccttttttttttttttttgagatggagtgtcactctgttgcgcaggctgtagtgcagtggcataggcttgactcactgcaacctctgcctcccaggttcaagcaatgctcttgcctcagcctcccgagtagctgagactacaggtgtgtgccaccatgcctggcttatttttgtattttttagtggagatggggtttcaccatgttggtcaggctgatctcaaactcctgacctcaaatgatccacccaccttggcctcccaaagttctgggattacaggtgtgagacaccactgcgcctggcctggattctccttcaaagcggcccacttctctaggtttctcctgctacagagcagagagaggttggagccctatgccacctccctcttcttgctcccacaaagtatgttgacagaatagaccagtgccagccactaaatggatcgttcatcagatgaacgggttatctcttttgaagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaagttttaaaactgcatcttggatcattctgcccttttccctatatgaatactttatgagtttttagccttttggaatgtgaccactaccttcagtattccaccactgccaaagcattgtgatgactctgaccacttgttatagctagttgtttacatttttaactatcactcttaaatgtatagagcttttcctaaaaaatttaaagtactttctatctaggatattcttcattctttttatttttatttttattttttgagatggagtctcactctgtcacccaggctggagtgcagtggcgccatcttggctcactgcaagctccacctcccaggttaatgccattctcctgcctcagcctccggagtagctgggactacaggcacctgccaccacacccgactaattttttgtatttttagtagagacggggtttcactgcgttagccaggatggtctcgatctcctgacctcgtgatctgcccgcctcagcctcccaaagtgctggaattacaggcatgagctgctgcacctggctgatattcttcattcttttagatttttaaagcagaatcagaagtcgtttctaatcaactttattaagataaacttacatacaataaaatatatctattttaggctgggcacggtggctcacacctgtaatcccagcactttgggaggctgaggcaggtggattgcctgaggtcaggagtttgagaccagcctggctaacatggtgaaacctcatctctactaaaaatacaaaaattagctgggcattgtggcgcacgcctgtagtcccagctactcaggaggctgaggcaggagaatcgcttcaacccaggaagcagaggttccactaagctgagatcacaccactgcactccagcctgcgcaacagagcgagactgcatctcaaaaaacaaacaaacaaaaaattatatattttaggtgtacagttaaatgagttttgacaagaaatagaaatttcctcatgctcttttatagtgagtttccctcacccctgaaaccaaccaatcactaatttgcttcctgtcactataagttttgcttattcttttcatataaatggaattatacagtttttatttttatttttgtatatctggcttttttcctctcagcataaagtttttgagaagaataatggaactttaaagtttgattttttttttttttttggaaacagagtctcactctgtcttccaagcttgagtgcagtggcacgatcttggctcactgcaacctccacctcccaggttcaagcaatcctcctgccttagcctcccagttaactgagattacagttatgtgccaccacacccggctaatttttataaatttttttgtagacatagggtttcaccatgttgcccaggcttggtttcaaactcctgagctcaggcagtccaccttccttggcctcccaaagtgctaggattataggaacaggcatgagccaccacgcctggtgaagtcatatatatatatatacattttttttttctgttacccagactggagtgcagtggcacaatgttggctcactgcaacctccgcctcccaggttcaagcaattcttctgccacagcctccagagtagttgggattataggcatgcaccaccacgcctggctaatttttgtatttttaatggagacagggtttcaccatgttggccaggctggtctcaaactcctggcctcaaactccacccaccccggcttcccaaagtgctgggattacagacgtgagccactgcacccggccctaagtcatatatttcaactcccttcttattcagatcaaaaatttaagtatagagagttttgttaaattcagtatttttatttttattcttatttatttatttatttatttattttttgagaggcggagacttgctctgtcgcccaggctggagtgcagtagtgcgacctcaggtcactacaacctctgcctcccagattcaagcgattctcctgcctcagcttcccgagtagctgggactacaggcgtgcgccaccactcccagctaatttttgtatattttagtagagatggggtttcgccatgttggtcaggctggtctcaaactcctgacctaaggtgatctgcccgcctcagcctcccaaagtactgggattacaggcatgagccattgtgcccagccaaactcagtatttttaaattttattgtatatatttgttatgcaataaacatgtaagttaataaaatttaaatttcatgttgtgaagaatataagcagaatctcattataacaaaaaatcaggctcggtgcagtggctcatgcctgtaatctcaacattttgggaggccaaagcaggaggattgcttgaggccaggaatttgagaccagtccagacaacaaagcaagacccctatttctacaaaaaaaattaagtcccggtgtggtagctcatgcccaaaatcccagctctatgggaggccaaggcgggcagatcacctgaggtcaggagtttgagaccagcctggccaacatggtgaaaccccgtctctactgaaaatacaaaaattagctgggcatggtggctcacgcctgttggtcaactactcaggaggctaaggcaggagaattgcttgaacttgggaggcggagcttgcagtgagccgagatcacgccactgcactccagcctgggcaacagagcgagactctgtctcaaaaaaaaaaaaagattgaaactgaaaatcatagtaggccaggcgcggtggctcatgcctgtaatcccaacactttgggaggccgaggcgggcggatcacctgaggtcaggagttcaagaccagcctggccaacatggtgaaaccctgtctctaataaaaatacaaaaattagctgggcatggtggcaggcatctgtaatcccagctactggggaggctgaggcaggagaattacttgaacctgggaggcagaggttgcagtgaaccaagatcgtgccattgcactccagcctgggtgacaagagtgaaactctgtctcaaaaaaaaaaaaaaaaaaaatcatggcaaaaaaggactctgtattacaggccctaaatccattttcctttgactgtcagtacagaggacttaagtcacttatccaaggatgagcagcctaatatgtctctgtgagaacctgaatcctgattcctgatttattcctcatttattcaacataagagtgcttactgggccaggtgcagtggcttacgcctgtaatcccagcactttgggaggccaaggcgggtggatcacgaggttaggagatcgagaccatcctggctaacacggtgaaaccccgtctctactaaaaatacacaaaattagccaggcgtggtggtaggcacctgtagtcccagctactcgggaggctgaggcaggagaatggtgtgaacccgggaggcagaggctgcagtgagctgagatggcgccactgcactccagcctgggtgacagagcaagattctgtctcaaaaaaaaaaaaaaaaagtgcttactatgtactgggtactggtgaagttactggaatacattcagcagggaaccaaaaatacaaaaatggtctttgcactcctgtagcttacattctacttcaggaagacagaaaataaacatctgaacaagtcaaaagaaagttatgttaggttctgcaggtgctatggagggaaaaaaaaaaagcagggaaaggcaggtagggaatctgttgatagtgtgggggaaatgctattttaaataggacagtcagggaagaagtctttgataaaattcagttgatcagagatcttagggggatgaagaagcaagttacacaagacatttgtgggaagaatattccaggctaaagaaacagcaggtgcaaaggccagaggcaggtatgtgcttggtatgttaggaacagcatccaggaggtcagcatagctggagaggaaagagcgatatgagaggtaaggaggcggtaacctcagagaggcagggttaaggggtgtttatcatgtaggatctcaaatgccagtgtaatcactttggctttttctttttcttttttctttttgagactgaattttgctcttgttgcccaggacggagtgcaatggcgctatctctgttcactgcaacctccacctcctgggttcaagtgattcttctgcctcagccacccaagtagctaggattacaggcatgcgccatcatgcccggctaatattctatttttagtatagatgggttttcaccatgttggtcaggctggtctcaaactcctgacttcaggtgatccgcccgcactttggctttttctataagaaggaagccactggaaggttttttgttttttggcgttttgttttgttttgttttgtttgagacagagtctcactcttgttacccaggctagagtgcaatggcgcgatctcggctcactgcaacctccacctcctgggttcaagcgattctcctacctcagcctcccaggtagctgggattacaggtgcccaccaccatgctaatttttttgtatttttagtagagatggggtttcatcatgttggccaggccggtctcgaactcctgacctcaggtgatccacctgcctcggcctccaaaagtgctgggatgagaggtatgagccaccatgcccggctgccactggaaggttttgagccaaggaaacacatgatttgacgtccatttttaaagcaccgttctggctgctgttttgagaacaaactgtaggatgggggagaaaagtggagaaggcaagagcagaagctctcttgctgtgcttcatcctgttcacttatctgtctttaaaagtttgtttatatataacttaactggtttttcctggttgaaacaggatccagaggtcattatgtggtatgtttcatccatcagaaatgagaacagcaaacagactagcgttcttcctatcctatttggagaattcttttttctttcccttgataattatataaacataagacattaacacccatatcaatggtctgtattatggagaggcaagatgtttttgcaagatcgtcattcccatctcctgaaacaggattccttaagtctagatctggagtctccccatgctctagagaccctagccatgtgccagaatctgacaggagctggtagcagagtacctcagcccttaggtgtgaacttcaccacagcaggttcatgtcagctcatctaaggaatggagtgggaaggctcctcctagtttccagtgtatgtccaggtagagtttatcaggtttaaaaagttacaggatcctgatttgagctggcagggttaaatatatgcctttccataggtccagttcacctatacatttagatggtttggtttagctttacttaaagtcaaaggaatctctgtgtttgtgtttttgcaagaaactggtaatggcttgcctagtttcttctctagtttcttagggcaaaggaatgagttttgccaaaattttatctaggaaaaatggagtagttttctaagtcttacaggacactgtcaaaatatggaaatctattttattgccttagggaattctttttttttttttttcctttttctctaggtaaaggagatcttcaggaagtcacctttcctggtaccaaagggcagtgttagcatcatggatggatccgacgaaggtgggagaggtgttgatatgcgttccagggggagaggggcaggatcagtgaaagatctaactaaaggaactggggccaggaataaacagaaggaatgagatagcaggaaatagaagacagggagaagggaacatgtgctctagacatggaatttagagaggaaaaaaaaaaaacaaggttggggccaggaaagagaaaaaatgctctgggatctaatccttgtctttctttctttttaggcatattagcttgggttactgtgaattttctgacaggtaatacatcctcaagtttatctttagagcttaactagcttttacatgcatagtcagaggagtaaaagccttttctttcattctgtattgtttcttcttctttaaaaaaggaaaagaggctgggtgtggcagttcatgcctgttaattccagcgctttgggaggctgagttgggcagatcacttgaggccaggagttcaagaccagcctggccaacatggcgaaactccgtctctaccaaaaatacaaaaatagctgggcatggtggtgtgtacctgtagtcccagctactcaggaggctggagaatcacttgaacccaggaggcagaggttgcagtgagctgagagccgagattgcgccactgcactccaggctggatgatagagcaagactctgtctccaaaaaggccttccaaaaaaaaaaaaaacacctgccttgaaggcctctgctgcaacaagagtccttccgagttgacattcacctgcagccttggggctggggagcagtggagtatgtatggaataccttcagtgtatgataagagcaagagagacaagtgttgggctgcccaggatgtcgaggctatttagagctggctctcatttgacaggtcagctgcatggccacagacaggagactgtggggaccttggacctagggggagcctccacccaaatcacgttcctgccccagtttgaggtgagtcatttaatgaagatctggttagaagtgcacttggcaggcgtatcatggtgccaagaaagaggcgccccattttcagccagcagctctaccacgcttaggcagagtcaagtcaattaataactaggtgaatgttcccttgccatctcactgttcagaatcccttcgtttcctcaagcctagtgagattagccccttaatctgtcttcatctctgattttttgctgggagggacgggtggtggtgtgaacatcttcaggtaattacagatcctgaatagtctttttgctttttctgatttgcagaaaactctggaacaaactcctaggggctacctcacttcctttgagatgtttaacagcacttataagctctatacacataggtgaggacggggacagggaagaagaatatttcatgttgtatgattctcctaactttccaaagcattctcaaatctgttattgtatctgattagcaaaaacaaagtctgtgccaattccctaaggcctatcaactgaaacccggtccacttacaaagccggaggagcctaagaggcttctccattcttggcctcaaaagcattaatatatgacttaagagtcaaaagttttcggctgggtgcagtggcttcatgcctgtaatccctgcactttgggaggccgaggtgggtgggtcacctgaggtcaggcgtttgagaccagcctggcaaacatggtgaaaccccgtctctactaaaatacaaaaattagctggatatgacagcgcacacctgtaatcctagctattcaggaggctgaggcaggagaatcatttgaaccctggaggcggagattgcagtgagccgagatcacaccactgcacttcagccggagcgacagagcaagactcagtctcaaaaaaaaaaaaaaaaaaagaatcaaaagctttctgtagggagaggacacttcaagaaggctcaggcaaagctccttgccagctcctttgagctggccttcagaggttcagaatccagcctggaatgtgatcccagttggggctaggagctaagctaaagagagcttttctgggaatggttcctagtgtgggaccctaggaattgtcactgtctctggcctttgaatgataactgtggggaattcttactgcatagccttgatccaaactgtgcagaaattaccccttgttgaccacaggagatgaatatgtcacagacagaacaaggttttcatctttccagagggacacaggaacaatgttacttttgaaggaggtagctttaggctagagaacttcaggaccagcatgaaattagtcaatcctgtattttacagttacctgggatttggattgaaagctgcaagactagcaaccctgggagccctggagacagaaggtttgtctgggtacctgtgctggggggggatggtgagggtgacacagatactccgcttgcttcttcccttccttgatagccattctatgaaggaaaagattatgttgaattgggaggcaaatgttgtataatggacctaataatggcaaactccttttctagtttataagttcagaagttttgatgtatattattagccatttttagaatgaggtctacttgttcaggggtaacagcctatgtctaggcagctgaagtgtctgcagaaatcccaggctttacgaatacattcagcaggagcttgctcaagccctgagctttacattggaggcacaggaagcagagtctgttctacatgcaggtggaacaacagagtaactccattgatctcttcacaggtcaggcagaactgggttcagtcccagtgttgtgatatgaggcaagtaacctatctgtgcccctttcctcacattaaatgagaatttgcatttaaggcactttgtacagtaatctgttattgggatgacatctattttgcatttcagagtatacaaaacatcttcaagtatatttaattgaagcctctcagcaaccagtgaggaaggtagcatagcatttctttcctgtttttataaaggtggaaagttgctgtattgaaggttttggatctctttgagatgtgatgaaagccatggacccctctgacaaaagcacatatgcatgaaaatttgcttctggtttcagggggttcaccaaccccacaaagcctatctttgaaccctgagttaaggattcctgtcacaggatgttgtcatggaattaatttcataggattttaaggcccagcccccatggtgattcttttccacctcactggcttcttgcttgccttcctccctctctctcacttacttacctcttaccttgtgccctggattctttcagggactgatgggcacactttccggagtgcctgtttaccgagatggttggaagcagagtggatctttgggggtgtgaaataccagtatggtggcaaccaagaaggcaagtgatgttttttcactggttaaagttacgtttacaatggaagctctggaaaagtcccatgggaaactttttccagaactcaagagaagcttatcttgttgcagggacttattccaaagatcttggcatgcctccaaggactaatgtgaagtgacagtgaacaaagcagctgtcattctgcatcagccaagtgtcatggacccattagatacctgcccttagccaagtgctgtggtgcacatctattgtcctagctactccaaaggttgaggcaagaggatcacttgagcccatgagttcaaggctatagtgcgcaatgccactgcactccagcctgggcaacagggagaccctacctcttacaaattaattaagaagcatattctaagcctaggtctaatgcagcagtgtgaaagcctgtttagttaatggttagctatttaaattatagtaaaacttaaaaccaagacaagaatgattcatcttcttataaaaggtatatacctgaatatcaaggaatgaacctgaattcccagtgaaggaagcaggcgagccctttagctacttgcttacaaatgctatggaatgtaatgctaggcagcagcacaaggttggccatgatctggtgaatacagattaggcaggagagcggccatggagaaacagactggtgaggctgcagacgtttgctcatctttgttttgacgcctcttgtcccaagcctcagccttctcctgctttccttgaccttcctgctgttccctcattgtctccagcagcctgcctcagagagtgtccccttcccccagcgtcgttctcaccttacccctgtgcacctttgcctggcaggggaggtgggctttgagccctgctatgccgaagtgctgagggtggtacgaggaaaacttcaccagccagaggaggtccagagaggttccttctatgctttctcttactattatgaccgagctgttgacacagacatgattggtgagttcaccccaggtgtcagtccagagaggaaggtggatagggctgtggtggggaaggtcaaggagaaagagcacttgaggtgctttgtcggggtgattacccacctcttttctagtcactcgaacaaaagggtggaaatgacttagagtcttttggaggtgagagatgaccaaaacaactatatgaggtctttttttttttaacatgtttattgaggtataattggcatacaataagtgcacatttaaagtatacaatttaagttttgtcatgtatacacccatgaatccatcagcacattgaagataataaacatattcaccacaaaaagtttcctcctgtctctttataacttttcttcttatcacaaaagcagtgtttttgcctaactgtgaaagtatatgtacctgatctgtcatggcctgagagagatgaattaatttcctattattgtgggggttttgttgttgttgttgttttggttttttgtttgtttgtttgttttttgagacagagtctcactctgttacccaggctggagtgcaatggcatgatctaggctcactgcaacctctgcctcccgggttcaaccgattctcctgccccagtctcctgagtagctgggattacaggtgcctgccaccacacccggctaattttttttttaatagagacgaggtttcaccatgttggtcaggctggtcttgaactcctgacctcgttatctgccttcctcggcctcccaaagtgctgggattacaggcatgagccaccacacccggcctattgtgttttatgggtctgttttttccattgtggttaaatatacataacatggaatagattgtaaataagtaaattaggttgcatagattacattatgtacatgtgtatataatgaatgaatgaatgaatttccttatgcttccttgaaggcgttttgatatcagataatcttctgttttatttcagattatgaaaaggggggtattttaaaagttgaagattttgaaagaaaagccagggaaggtaagtgtcaggggaagcccttgaaggtaagcctgtgagactgcctgcctactctagtgacctaaagtgacctaaagcacctcagtcagctcagaaggcctatcagaaggctagtttcctttctgagtcttccagtctttgctaaaagttaaaagcattgggtggtagccaggcatggtggcacgcatctgtagtcccagctactcagggcgggaggattgcttgaggccagaaattcaaggttatagtgcactataatcacacctgtgaacagtcactgcattgcagcttaggcaacatagtgagacctctgtctctaaaaaaataaattttttttcagctttatgcagcatagaattatgggcaagaatatgggaatacaagaggttttaggaggccgggcacggtggctcacgcctgtaatcccagcattttgggaggccaaggtgggcggatcacctgaggtcaggagttcaagacagcctggccaacatggtgaaaccccatctctactaaaaatacaaaaattagccaaggaaggtggcaggcgcctgtaatcccagctactcgggaggctgaggtaggagaatcgcttgaacctgggaggcagaggttgtagtgagccaaggttgtgccactgcactccagcctgagcaacagagtgagactccacctcaaaaaaaaaaaaacaaagaggctttagggctttagggaaatggtgaagaccttttttttccttctacatttcttgctttcttttttaaattgaaatagtgttatcagtgttaatgaaacactaagcatcaaaagacatggtaaatagccacagaggcttccttgagaggatcaaaactaccaagagagctaggcacagtggttcgacctgtagtctcagctacttgggaggctgaggcaggaggatcgtgtgaacccaggagcttgaggctgcagggagctgtgatcatgccactgcactccaccctgggtgacagcatgagaccttgtctctaaaaaaaaaaattaataaaaagtttttaaaaattaaaaaataaaatacaaatgatcttatcgagtagcccacagtagggttaaatgatatttccctgtcttctgggcctcaccattaataatagataagggatttagaactaagcccccacaataggtcatagaaacttagcaaataaactagagcccatgtaaatgtgaatagataatcataccagagatgtgcaagttcttcagaagctgcggtcttacagaggcagtcagtgcagtctagtctctgagatgcctaagcattaaccaaagggagacttctgctttgcttattcttcttctccccctaccttttttttttgagacagagtcttgctctgtcacccaggctggagtgcagtggtgagatctcggctcactgcaacctctgccttccaggttcaagcgattctcctgcctcagcctcccgagtagctgggattacagcggtacaccaccacgccctgctaatttttgtatttttagtagagatggggtttcaccacgttggccaggctgatctcaaactcctgacctcaggtgatccacccgcctcagcctcccaaagtgctaggattacaggcgtgagccaccgcgcctggcccctattccacttctttctaagagaaaatcctacacctctcagttagttgcaaacttgagctccactgtttactctctctttcagtgtgtgataacttggaaaacttcacctcaggcagtcctttcctgtgcatggatctcagctacatcacagccctgttaaaggatggctttggctttgcagacagcacagtcttacaggtaagagacaggacaccagagtctcataacagccctcttttgtgggggttgagaaggagtaagagcttgttcagtaatcagagtagctagaagtgaaattatgaggtatttttgtttgggctatggacaaggtactgtgctgggcaccatgaatgtgggaaattatctcaatgcaatggtagcctccgagtgtattaccaggcaagctatcgcacaggtcacagaacagaaagactagcagcccaaattaagatgccaagtcacatggtttatttatttatttatttatttattattatttttttgagatggagtctcgctcttgtttcctgggctggagtgcaatggcatgatctcagctcactgcaaccttcgcctcctgggttcaagcgattcttctgcctcagcctcccaagtagctgggattacaggcatgcgccaccactcctggctaatttttttgtatttttattggagatggggtttcactatgttggccaggctggtctcgaactcctgagaactcctgacctcaggtgatccgcccacctcgaactcccaagtgctgggattacaggcgtgagccactgcacccggcccacatggtttattaaatcagtttagaactcagggtgagaagcaaggggaaagagttggagaggtgaacacagaagacacggtgcaagcaggatgcaagtgccacactctctgaatcttgggttccatttgtcctaggtttatatgtcctgcctgtctctgctgctaatagagtggttacacatactagagctgaagttcggtcatgggagcacaaagacaaaaggtgcctgaggccaccacacaaacttgccctatttggagaggccccaggggcacacacacatggccatttgcattagctcagtcattagcctataagatgggttttctttggcagaggacatgagagaccaagagggtgtcaccagtgagtggcttatttaaggcctcatgaacactgaatgcctcatgcatatgtaatgtgtcatatatatttcatgtgtgcctcgtatatttaatgcctcttgaatcttaggtctttctttgtcctcctgtctctctccatctgtttcagtacctgcaggctctactttatctgtagtaagttatttatccccagttttgggcacagtgtctaggctctattacatcaggtcaacacagaacaatcaactggtttatagacttttttggtggtggtagcatctttatccaacaaaaacttatgtagaatatcagtaatacagccgggcctgatggctcacgcctgtaatcctaacactttgggaggctgaggcgggcggatcacctgaggtcaggagttcgagaccagcctagccaacatggtgaaaccccgtctctactaaaaatacaaaaattagccgggcgtggtggcaggtgcctgtaatcccagctacttgggaggctgaggcaggagaatcacttgaacctgggaggcagaggttccaatgaggagagatcataccattgcactccagccttggcaacaaagagcgaaactccgtctcaaaaaaaaaaaaaaagagtatcagtaatataaaactggtaaaagtggaactattctggttgaagcagagattgggggcctgaaactcctctatcatttggcctccctttttccttcgaagcatttctaagaaacccctaaaattctgaagaaaacaaattgataaaccgataaacactaatctaatcctcttcttatatagttgaggaatttgggtctaaagttttgcccaaggtcactaagctaattgagatatgtactggcttagaatgtcttaagttccctgtttgattatttttttcttttctttttcttttgagaccaagtttcgctcttgttgcccaggctggagtgcaatggtgcaatctcagctcactgcaacctccacctcccgggttcaactgattctcctgcctcagcctccgaagtagctgggattacaggcatgcgccaccatgcctggctaattttgtatttttagtagacacggggtttcaccatgttggccaggctattctcaaacttctgatctcaggtgatccacccgcctcagcctcccaaagtgctagaattataggcatgagccaccactcctggccttttttgttcgtttctttttttttcttttttttttttttttttgagacagggtcttgctctgtcacccatgctggagtgcagtggcatgatctcagttcactgcaacctctgcctcccgggttcaagtgaccctcccacctcagccctctgagtagctgggattacaggtgtgtgccaccactcttgtctaatttttttgtagagacggggttttgccatgttgcccaggctggtcttgaactcctggcctcaagcaatccacctgccttggcctcccaaagtgccaggagtacaggcatgagccactgcgcctggccccatgtttggttattattagtgcttaggaagaggcacttgcttacatagtaggagttgagaagcttggtttgttctttcctacccctagatctattctcacctcctgaccatgctctttctgccacatctattatcattacaagttgccttatctgaaattagtgaatcagaaaataaagcaggggatactttgtgtagtttcaacgttagggaaagttcagaatactgtctgtctaaactatctctctagaaggcctgatgggccacaacctgggccagaagcattcagttcagatatgagaatggtgggtgtaggggcaatggccaatgggccatggccggaaggaaattgttacagagtagtgggaagcctgcaaagactggcttctgtccgttttgccttggtttgcccatgtggatattctttgccaatattttctgcccaagagctgtgcttgctagagttggaaactggatgaaaaggtgaagactttttttcttctcaacagctcacaaagaaagtgaacaacatagagacgggctgggccttgggggccacctttcacctgttgcagtctctgggcatctcccattgaggccacgtacttccttggagacctgcatttgccaacacctttttaaggggaggagagagcacttagtttctgaactagtctggggacatcctggacttgagcctagagatttaggtttaattaattttacacatctaatgtgaactgctgcctaaccactcaagagtacacagctggcaccagagcatcacagagagccctgtgagccaaaaagtatagttttggaacttaaccttggagtgagagcccagggacaggtccctggaaaccaaagaaaaatcgcatttcaaccctttgagtgcctcattccactgaatatttaaattttcctcttaaatggtaaactgacttattgcaatcccaagacccatcaatatcagtatttttttcctccctatacagtgccctgcccacccttatctgcacccacctcccctgaaaaagagagaaaaaaaaaaacctggttttgctttccatgtataattcaacaacgcaaaatgggaccatgtcagaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatcagtcaactctgggattaatgaacatatccgactttatgggtatgtgtatattcagtgccagtaccacctcccaggctaatgtgttaacagtgttttctatgattctaaacttgttttctttgtatttctaagaaatacaactaggccctaacttttggtctgtggtcagaggtcagtgtctgtgctattccaggatctattatttcagtttgcccttttattctctccgtttgtaacagtaccttcctgtcctggtccctgatcactttagctaatatcctttgaattatttatctagttcagagtttccaataccgttcctgacaaaaccccacttggatttggttggctctctcagcccacatcagtacagtggaccaacatttccagggagaaccatatttaatgtccctcatgctctctttttgaatccaagtgctcagagctcttgactgtgaattatttaccccaaattcattatcttgcacttttttttgagatggagtcttgctctgttgctcaggctagagtggagtggcgcaatctcagctcactgcaacctccgcccccaggttcaagcgattcttgttctcagcctcctgaagagctgggattacaggtgcccaccaccattcctggctaatttttgtatttgtagtagagatggggtttcaccatgttggccaggctggtttccaactcctgatctcaattgatccacccgcttcccaaagtgctgggattacaggcatgagacaccgcgcctggccttatcttgcactttcaacataatcatccctgcttctcatctgccctgcagtgctcttggacctggaagatctccctgtggtctggcccctttgccttggttgttaacctccagcttctttgcaggagtgtatttccccaaaacttgtggctttcacagtagactccgtttccatcctctctctcacaaaggatgttaagtatgcctggccctcacacagtccatgggaaaccttatttttaacattactccattgagtcaataaatatttaccatctgctgtgtgcaagttactaggcaaatttctgtatccttgtccctaaaattcttgtctttaaattcattgtggaatttctttagacttcacactgacttttattactaaggtcacctttataccaactgccttcctcaaaatgcttataatgaaataacagaatcttgagttggaaacagcccaaagaaataatccaatgttgtactcagtgcagaattccctagaatttctaacaggttgtcattcagcttctgctaagccatgttcaaacagcttattccatttggaactgcactgatattaaaaaaaattccttatattgagctgaaatctacctatcttctaagtggtcttagttctgctctaatctctccttccaaaatctttggatcttttgaaaaaagttcctcccaagttcttttataagtgacatgacttttagaccccttcccatctttgtcaacaaaagtagggtgccagaccagtcacagaacactaaatgtcatccatgtttccttcagtagaaaccagcagttttaaaagaggtaagctgtgttcactaaagactgttccagcttgacaaatgcagagatataagtctctggtctttaatcactgtgggggccattttgtaaaacacacatactgtccagcagactcctttggtcatcccaaatacctccgaactccagggaagatgca

SEQ ID NO: 13371 - DNA, 27923 bp, Human
aggcgatctgcctgcctcagcctcccaaagtgctgggattagaagtgtgaaccaccacgcccagccataatttctaatacagtatgtacctgcgctcacaaaatttaagactcggttaaacttaaaacttaagatcaagtaatatattatttctgcatatatctaatcaatctttcaataaatgttaattaaagacctactgttcgtcaggcactgtgctaaacctggatccaactatgaacaagacaaacttggaatttacaatctagcgcaaaaggggcaaagttaacagagtaactatgctgacaaggaagatactgagataatgaataatggtgggaaagggcaactccagatactgtgttctaagaaagactctttgggaggtgacatctaaaaagagaactgaaactgaaaaaaaaaaatgtttatatgtttgagtcatcttttggtctcccaaagcacctagcattatgcctttcatgtagcaggtacttaatatagctcaccttggcttcaatttcttcattcctgcaatgaacttccaagactccttccaaatataaaatgtttttgtctaagggaaggaaacctatatatcaataaaatcgatatatagttgggatgaggatggtagaactaaaaatgagtttaaaaatgactgcaagaccctaactctctaaagcagaaccaagaggaaaagcatgggagtataccaaaacaacttaattgttacttgaaatgacttgcattttacacaatatataaacagaaatcgttaattcactcagccttaagaaacaacacgtaaagcagatggaagacaggttgcgacctgtgcaagacgacacttaaaagctcaatactgattctcctcgcgactctcagggcgaggggccgagaacgtcccccgcttctcttgctgccacggcaatggtcccaaactgaggagacaggagagagatcatgtttctcttgcggttcagtatcgagatgaggtcagccagcagccctgcgagggtttgtgagaatcattccatccgtgcgctcaatcagaagagaactgatcctttcaatgggtaccccaaggagaaaactacagtaagccacgtcctccagaaacatctcctcctcgaccctcagcctcgcccaaatagagataaggaaggcacagggcgacccccctgtccttttacccagaatgagtccctccctagtgccctcctccacacgcctggtacagagcggggaaactgggcacctccggagctgctgtgaagaaccggtgagctgaagacggcgatggatctcaagaaaaaaaataaaagggaaaggagaagagcccaagaaagaaatgtatgttcgaggggcagagacagagtggatgttcccagtagagcaaagaaggaggctgcaggcaaagatctctaagccggctcttaccgtctgtgggagacgccatcttccaacccatgtcacgtgacgtggccaaccgtcggcgggaaaacgaggttccataagccacgcccccaaagagaaaccctatccccaactcgcagcccagtctcattccctcgcctcatagggcaatctttgcctagccccgcccctaagtatagccacgccccttacgcggatgttgaggtggagcgactgcaaaattcttgaagggtcttatttacttttttcagtgggggggtggggcctcggttccgcccttggccaatcggagttccaggttaggggggcgtcttccccgtgtgctcggtagggagtgtccaagtcaggggcgtcttctctacctccgcctacgtcattggctgaggtggcagagggcgagagcattttcgctcctaaccaatcacttatccccaggacgggggtgtgaggggaggaatcaggtgttcggaccagtgattggctggagaaaatagtcctccccaccaatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggcgagtgagggtggtgccaaggcaccatgaagctaggaattggatcctttccgtccgctccctgagccatcctcgggcgggaccaccttcttggcccaacccctttttggccagacctcctacccgacctgtgcggccctgtcccatgcccagccctcacttcataacctccctggtcccggatccaaccctgggctgttacccttggccctctacccttttactcctaagcctcctcttttctggctctcgcccactctccttctccagctctgcccgctccctgctgtcactctcttgccctcatctctccatccgcccaccgtctttcctttttacctctgcaccagccttctctctctcccccagaaactactctttttggttactctgtcccctgccgtgagcgtccactttgccattgctcccttcccccaccctacttcactatccgtggtgatctgaggtaagggggaggggggacgcgaggggcgagggtcagtgtatgaactttgaatttccttctagaggtggactctagattttcaccaaaggcagccatttgctaagctattttccctaagtgtggctctttgtattttccatggactggctgtcccctttcttgccaaaactttgagttaaactttttctcagctaagttacagtttacatagatagggcacatctacatagatagggtagataagggcacacagttaaagctaccagtatgttccatgtatgttcaaggtaccaaacatctttaaaacgggtgatagaaagtgggagccaggtaagacaagaagtctaagttcccaccccaaaatcagctcttctagtgctacacaccctcatctctgcacttgggggattgagtcctctctgaagccaacctaaggagaaatggtaaagctacaggagttgcatgcctgaggcctgtaatctccaactctgtttatagtctttcccctgttcatggcctaccaaggatttagagtatgtggcaagatttaccgcaggcaagaaacagtctgcaagaaacaacagtgccgttcttattcattacatccagtctgagaatttcctctatattgctgagcttttaggtaatattagtattcaccaggtttccgtgagttctagtaaagaaacttgggcagttttaagattcttggcagagtcagcaaagattcatttttaaatatgctatttaatggggaaggtagaaaggatgagtttgaagggtttggcagatggtctggcctcactcatatttcttgctgcgatccttgttctgttctagtatctttttttagtagcaggaaaacaaagtttccaccctatatttttcttaccaacttcttgaaatcttttactgaaattggcttttttcctttgcctcctcttcccctcccatcacaatgagtcattgagaaccttaagaaagtattttgtccttttccatcaaggagaagaatctctctttccatgtacttttatttcagaaacagacactatgtattttctgattcatttggagaaacttctgaagtgacctggaaaagaacagatagagtaatcctcagccaactaggagttgtaacgtgaatctttgattaaaagttcgataaaaagtagcctacgggccaggcgctgtagctcctgcctgtaatccctgcactttgggaggccaaggtgggtggatcacctgaggtcaggagttcgagaccagcctgaccaacatggtaaaaccccttctctactaaaaatacaaaaattagccgggtgtggtggcgggcgactgtaatcccagctactcaggaagttgaggcaggagaatcgcttgaacccggaagacggaggttgcagtgagctgagatcgtgccattgcactccagcctgggcgacagagcaagactccatcaaaaaaaaaaaaaaaaaaaaaaaaaacctcgattttggcagccatgaatattagagaactatcaaaaggatttatagaggagaaagttaatgttttcaattattttaagtattcagcttatttttctctgccacgaagagtagtcaaacttaacctaaaacctctctctgctccttgtgatattatcactcccatgcagagataaaggaatgttcgagacagggtctcgctctgtcacccaggctggagtgcagtggtgcaatcacaactcacagcagcctcgacctcccacgctgaagtgattcttccatctcagccctccgagtagctgcaacaacagatcgtgcccccatgccagctaatttttgtattttttgtagagacagggtttcaccatgttgcccaggctggtcttgaactcttaaactcaagctatcctcccacctcagcctcccaaagtgttgggactacaggcacgaaccgctgcacctgggcaagaaaattactcttgaagagatgtagcgacttgcactgtcggtgatatggttaccgaactagtaactgatggggctgaaaattcagaacttaagtcttgccatctctttctatgttaggcactgacataggcttacagtaaaatgctcactgaaagctcctttattgtactgcaataagtgataaacaataggagtatctgggatactgtggggacctagggaaagagccaagtattgcaggactagcaggccatgaaccaggagaggaaggagttccttataaaggatatagcaagtaggaagtaaacatctagagagcagcagtttggggtgactggccacaggatagtttcttcagcaacaatgctaatgggtgtttcttaggaaatgaagaaaagatagaagatcgaacctgtcaaaaaactatatgaatatgttctattataccagatgtagtgctttttacatcctcttaacagcagggaggctgtatacaagtgaaaaaataaaatttaagtggcctagaatgctcaagttggctgatcagtgcattgtctgccaacttgagagtactgaaacaatatcaaatgattgcttggcgagtactcattctttcattgtgcaaaatattgcttactaagtacttactctcttccaggaattgtgctaggggctggggacacaacaatctagtgacctcaaaggagagaaagttaatcattagacaagctattatttcatagcgtgagatgagaaataaaggaatttgggtgctttatgagcttcacaatcagctgcttaccatagacctgaggttgagacttcctagagaaagtgatgatggctgagtggggacctaaaggagtaggaatgagccaaggaaattagatgaaacagtgccaggcaagagagagcagcatgtgcaagagcaaagaaagcaagacacacgttaaattgcaggagcatagagaacagggaggaaagtagccagttatgtaactagaaaagcaaagatactatgtagcgttttctaagcaacatcaaggggattagtctttattccaagggcagtggaaagccaaagaagaattttaaacaagggaataatctgaccagatttatgtttcagaaagaccctctgattatgggatggaaactagattcagaaagtttaagagtaggctgggtgtgatggctcatgcctgtaatcccaacactttgggtggcccaggcaggaggatcgcttgaggctaagagttcaaaaccagccctggcaagatagggaggccccatctctacaaaaaaaaattttttttaattagctgggcatggtggcatgtgcctgtactcctaggtacttgggagactgaggcaagaggatcacttgagcctgagagcgaggtcgtgtgcacctgtggtcccaggtacttgggaggctaaggcaggaggatcacctaagccctggagattgaggctacagtgagctgtggttgtgccactgcactctagcctgggtgacagagtgagactctgtctcaaaaaaaaaaaaaaaaagaaagagtttaacattagaggctgagagatgtgttaggaagctattatggaaggtcaagtgagagacaatgatggtatagactgggataatggcaggacagctagaggtgagtgatgtgtttcaaacaattctaggacagactgccaggagttttttgcttccctgcagagagagagggaggaattggaatagtatctgggtttctcctttggcaacttgttaaggagtagccctatttaccgagaggtgggctataggaggcatagcaaactggcaaaaggaagatgcagagtttagcttttgcttttgttttttggtttttgtttttttaagatagggtctcgctctgtcacccaggctggagtgcagtggcacaatcgcagctcactgtagcctcaatctccaaggcttaggtgatcctcctgccttagcctcccaagtacctgggaccacaggtgcacatgaccatgcccaactaatttttaaaattatccgtagaggtcacatgtcgtggctcacacctgtcatcccagaactttgggaggccaaggtgggcagatcatttgaggccaggagttcaagaccagcctggccaacatgacaaaaccgcatctccactaaaaatacaaaaaattaggccaggcgcagtggctcacgcctgtaatcccagcactttgggaggctgaggcgggcggatcatgaggtcaggagatcgagaccatcctggctaacatggtgaaaccccatctctactaaaaatacaaaaaactagccaggcatggtggcgggcgcctgtagtcccagttactcaagaggctgaggcaggagaaggtgtgaacccaggaggcggagcttgcggtgagccaagatcgcgcaactgcactccagcctgggcgacagagtgagactctgtctcaaaaaaagaaaaaaaaaaaaaacaataagaaaaaaaaattagccgggtgtggtggcatatgcctgtaatcccagctactcaggaggctgaggcaggagaatcgcctgaacccgggaggtggaggttgcagtgagccgagattgcgccattgtactccattgagtgcaggcaggtctcaaattcctgaacgcaagtgatcttcccacctcagcctcccaaagtgctgggattacaggcgtgagctactgtgcccagccacctttttttaacatgtgcccaagtaacatccaaatagagatgtggtaaagataattacgtgggtatcacctgaagaggaaaatactggccaaggactaaagagttgggcatcatcaggatctagatagttaagccatgagagttgataaaatcacccaaggagcatatacagaatgagaagaaaagaaggcctaggaccaagccttgggaaacttaaagagttaatggcagcctggtggggtggctcacccctgtaatcccagcactttgggaggccaagatggtcagatcacctgaggtcaggagttcgagaccaacctggccaacaaggtgaaacactgtctctactaaaaatacaaaaatgtggccaggtgcagtggctcacacctgtaatcccagcactttgggaggctgaggcaggcagatcacttgaggtcaggagtttgagaccagcctggccaacatgttgaaaccccatctctactaaaaatacaaaaaattagctggatgtggtggcacatgcctgtaatcccagctactcagaaagctgaggcaggagaatcacttgaacccgggaggtggaggttgcagtgagccaagattgcaccactgcactccagcctgggtgacagagtgagactctgtctcaaaaaaataaaataataaaagcaaattagctgggtgtggtggtatgtgcctgtggtctcagctatttgggaggctgaggcaggaagatggcttgagcccaggagatggaggctgcagtgagctatgatcatgccactgcattccagcctaggagacaggacgagaccctatctcaaaaaaaaaaagtatatacctcttcatccagtccacatatattgatcgtgcaccactgtctcggtcacttttcctgcatggagcttgctggctaccttctccattaggttgagttcagttttgtaggtttgctagtaggaagttgagaagttctcatctgatggtttctgtgtgctctgaagtaagaaaaacaaagtcagctcctgaaagtacaagaggaattagtagaattgggagttttaagataaagttgtggaatagcaaagagtgaaaataaacaataagtgtttattatttatagaaatggagtctcgttatgttccccaagctggtcttgaactgggctcaagagatcctcctgcctcagcttcccgagtagttgggactacaggcagaaatcaccgtgccgttatttacaatgacataacaataagatttaatgagtaccagctttgtgctaactacttttctataactggacagtcctgatcaggtttaatctttaactctgaagtaggtgaacaagacagatgcagtgtcaaccctcctgaaactgacagtctttatgggtaacagataagtacccaggtgctgtggcttggatatggttggtttgtctccaccaaaactcatgttgaaatttaatctccaatgtgatagtgttgggacctagtgggaggtgtttgggtcatgggggtggatccctcatgaatggctttgtgctgtagtgagtgaattcttgctcttttgagactggattagttcccatgggaatggattagttcctgtgtgagtgggctataaagccaggatacccccccagttttgcctcttcacacaggtctgcttcccctttgatcttctctgttatattatgacacaggacagaagccctcgccagaagctagagccattcccttgaacttcccagcctgcagaatcatgaactaaataaactacttttccttataaattgcccagtctcaggtattttgttatagcaacacaaaacggaataagataccaaacaattacaacacagagagataagcctgaaacgggaagtattggctgctttcagaggacaaaaaagggcctcttaacctagtttggggtaggaagcagacaggaatgggcttctattttattcagcagatatttactgaacacctactacctaccgagtactatattggtattgggaacatagctataaataagacatgatgggctccaggagagtgtcagtggtttgaaatggctttggtagggaatagaagagcaaacagatgaggtatttggaaggactatctgctggaccaaaggaccaccaccttttcctgggcagtgctgcaggcacccttcatgcagctctatactctggttaacagagtcccttttcaggcaagataaaagattattagattgcagctttcctttatatcccagtcctgagtattttagtttgctcattttgattggcttaagtatttcttaaatcaactttgataacatatatataggctgggtgcagtggcttacacctgtaatcccagcactctgggaggctgaggcgggtggatcacctgaggtcaggagtttgagaccagccaggccaacatggtgaaaccccatctctactaaaaatacaaaaaaaataaaataaaattagccaggcatggtggcgggtgtctgtaatctcagctactcaggaggctgaggcaggagaaaagcttgaacccaggaggtggaggttgcagtgagccaaggtcatgccactgtactccagcctggtcaatgagagcaaaattctgtctcaaaaaataaataaataaaaagaaaattagctgggcgtggtggcagacacctataatctgagctacttggcaggctgaggcaggagaatcgcttgaacacgggaggcagaggttgcagtgagccgagatcatgccactgcactccagcctgggcgacagagtgagactccatctcaaaaaatcaactttgataacatatatacagacttttttagtgagttacaatttgagagttatcttgttgaaactgatcctccccgtttactgattttactccatcaaatattatctatccaacacattttttcctttaatgtacctatggcatttcaatatagctttattaaaataaaattgacacaaaacaatctgtacatatttaaagtatgcagtttgatgagttttaacatttgtatacacctgtgaaaatagcatcacaatcaacataatgaacatatgtccatcaccccaaaaagtttccctcgtcatccctaggtaaccactgttctgctttctgatattacagatttgtttgcattctctagtgttacataagtagaatcatacagtatgtacttttattatctaacttctgtctcttgccataattattatgactatttatattgcatgtatcagcaggtcattcctttttttgctgagtagtattccagtgtatgaatataccacattagtttccttattcacccatccaatggtagacattgggttgtttccaagttttgggctactacaaataaagttcttatgaacattcatttttcaaatacctatatggacataattttaattgcatttggtaataaattttgatttatatttacattgattatatactctattacttatatttatatttacattgattttttttttgagacaaggtctccctctctcttcctggctggagtgcagtggcataatcacggttcactgcagcctcaccctcccgggctgaagcaatcctcccaccttggcctccctagtagctgggaccacaggcatgtgccaccactgcctggctaattttttaattttttgtagacaaggttttgccatgttgcccagggtggtctcaaaactcctagactcaagtgatatacccgtctcagcttcccaaagtgctgagattacaggcgtgagtcaccatgcccagcacattgattttatatgatcttaaattcagtacctattgtgttagataccatgctaagtattttcatattgttagatttatggtacatttgccaggcccaaattaggaaaatataatgacaaaaagattttttttaatcagtactatcctggaaatataggacatgattattatggtttattgtttgttcatagtttgctgtgtcatagattcatatcttttctctttaatgactgtatggcctttgagagaaacataccccctatatactatagcaaatagcatatagtagctatttgctaaattttaaataactttctgctctcatttatcaaaataatcgttcttttgcctcacaggtttcttccaaggtgaaatccagtcccacctggtattcagcatcttccttctcttcttcagtggtgagtttatttggcatagaggttgacttctgagaaggaattcagtatagttttgggtatctctatcttctttacataattgtcatcagagtgtatgtgaaactttctagttttttcctccttttggattatttccctcctgaaatggattaccatgtcaaaagatacaaacattttcatggcttctagaggttctgctgaccctgccagatagttgtcttcttcttaatgacctttagagtggtttttacagatcatctgtctgtcaaccacttccagcatctaaaatctaataaataaggactattgctcaaattctttctacacagaagtatgcacacactgtaccacagtaggtcaccattttttggttcatagaccgctttaaaaatttagtgtcccagcactttgggaggctgaggcaggtggatcacgaggtcaagagatcgagaccatcctggccaacatggggaaaccacatctctactaaaaatacaaaacttagctgggcatggtggcacgcacctgtagtcccagctactctgcgggctgaggcaggagaatcgcttgaattcgggaggcggaggttgcagtgagccaagatcgcaccattgcactccagcctgatgacagagcgagactccgtttcaaaaaaaaaaaaaaaaatttagtgaaaggggccgggcgcagtggctcacccctgtaatcccagcactttgggaggctgaggcaggtggattgtcagagttcaaaagttcgagaccagcctgggagacatggtgaaaccccatctctacaaaaaattagccaggcgtggtggtgcgtacctatggtcccagctgcctgggagggtgaggtagagggactgcttgagcctgggaggcagaggttgcagtaagccaagattgtgccactgcactccaacctgggtgacaaagtagactctatgttaaaaaaaaaaaaaattagttaaagtgagctatatctcagaaaaaaatacatagaaacattttcaaaatctttttttttttttttttgagatggagtcttactctgtcacccaggctggaatgcagtggcgtgatctcagctcactgcaacctccacctcccaggttcaagtgattctcctgcctcaacctcccgaatagctaggattacagtcgcatgccaccaaaaccagttgatttttgtgtttttagtagagacaaggtttcaccatgttgtccatggttggtctagaactcctgacttcaactgatccacctgcctcggcctcccaaagtgctgggattacaggcgtgagccatttgcccagccaaaaatcttttgatcataaaggtaatacatgctcacagtaatgtaacagtcagctgggccaaaaagtcataatagctaatctttattaacagagttgctgcttttttagtataagcttcataatatcgtgtttctactcatgaagttccactgtgtgaatagcagggaatttcccattctcagagagatcacagtattgagaggctgtgccacatcttaatatatactatagtctgggcacgatgactcacgcctgtaatcccagcactttgagagcctgacgcaggtggatcacttgagcccaggagttcgagaccagccaggcaatatggccaaaccccgtctctatcaaaagtacaaaaaaattagctgggcatggtagcatgtgcctgtagtcccagctgctcaggaggctgaggtgggagaatcacctaagccctgggggttgaggctgcagtgagtcatgatcacactacactccagcctgggcaacagagtgagaccatgtctcaaaaaaataaaaaataaaaaataagggccaggtgcagaggctcacgcctgtaatcctagcactttgggaggccgaggtgggtggatcacctgaggtcaggagttcgagatcagtctggccgacatggtgaaaccccatctctactcaaaatacaaaaattagttgggtgttgtggcgggtgtctgtaatctcagctactcgaagggctgaggcaagagaattgctcgaacccgggaatcagaggttgcagtgagccgagatcataccactgtgtgctccagactgggggacaagagcgaaactctgtctcaaaaaaaaaataaacacacacacacagaatagatagggatattatgtgtctctttcctagtggtaacatttctaaagaccagaagattccgttatcaacttgttttctttccttttggtgcaagggaaagggaaaagcaaagcaattagctaatacaaagtttcatgtttttgtttgtttgtttgtttgtttgtttttttcagccaactgtaaagctcttcattggtgggaaattcgttgaatccaaaagtgacaaatggatcgatatccacaacccagtaagcgaagctgctttgggacttcaacttatgagcctagaattctagggacatgatgggcaagaagggacctgggtgtctgttgtaaagcacatagtgccacttctgtgactggatgtacagtggagaaggtgagtcaggcaaaggatcatgtgcttatttttctcatcaggccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttggtatgaaatctaaatggtatgcttttccaaactgtcacctagggcatgtttgtcactctcacagagaccttttcagccaccctcccttactctgcagtatgcagagacgttgatcatgactctctcccttgtactgcatctcctccagtcttattcttcctttgctacctcagaatttaaaagaggaacattcttgcattaatttctatttgtgtgtcttctctctagaaagaaattgccaagttaatcacattggaacaagggaagaccctagctgatgctgaaggagatgtatttcgaggccttcgtaagctgggagccccttatgggacttttgggaaggaccaaaggaagatgggaggcaaagatcgcagaatgggaggttgcttcttcctttacatagattttgccatcccatgatatcttttttaatacttgtgaaaaatggcagtattcagtatccctaagactgatttactttactctttactcaaatgatcttccagtgggtatatacatatcgctgtatttttcccattcagagaatctcattttgcacaaacccttaacttggaagggcaagtcagtgtaccctgcaccccttcattggcctgaaccacttcctgtcctcagggctgaagagaacaggacaaagctaactagtacacagtgtggagagctgatggcctgacttctgtgttccagaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaaggtaactgcccttatgcatatggctacttaatctggctaccaaaaaatcaaggtgttgagtgatggttggatgttttaggataaggaacctacttgtaaggaggaaaggatttactcattttaacctccatgtttgttgatgattttgccatctttgtgcgccaaggtaactgattggggaatagcagtgcttgttgccctacagtatatattgggacactagaaatatggattagggctagacacagataagattaaaaagaaacttttttcttcagtgtgaagagaatacatgagggtatttaattcagagaatttgcagatctcagagatactgaaggccttctaattcatgtaataatagctaatacttaaatagtgcttctgtgtttcaggcaccgttcctagtgctttttatctattaatctttataatcaccctttgaggtaggtattatttttccattttgcagaagagaaaaatgagacatagtgaaattaattagcccaaagtcacagtgctagaaaccgtcaaagccaggatgtgtatacccatccaggaaggctgactctgatttttgcttttaaaaactacactatattacctcttacatgagaacacaatagtgtctgagtgtcccagtacatagtcaccattgaggaaatattgttattcttttttttgagatggagtctccctctgtcgcccagactggagagcagtggtgcgatctcggctcactctacccgctgcctcccaggttcaagcaattttcctgcctctgcctcttaaatagctgggattacaggcatgcgccaccgtgccccactaattttgttatttttagtacagatggggtttcaccatgttggccaggctagtctcaaactcctgacctcaggtgatccacccgcctcggcctcccaaagtgctgggattacaggtgtgagccactgtgccttgcctattgttattcttaaaggacaaaaaagaagggttcagtattcaaaggctgttattttggaggaaaataggagttgcagccttcaaagttagattaaggctgggtgcagtggcacatacctgtgatcccagcactttgggaggtgaaggcaggcggatcacttgagcccaggagttcgagaccagcctgggccatgtggcgaaacccccgtctctacaaaaaaaatacaaaaattagccaggaatggtggcatgtgcaggtagtcccatgaggtgggaagacagcttgagcctggcaaacagaggttgcagtgagccaagactgtaccactgtactctagcctaggtgaaacagtgagaccctgtctcaaaaaaaaaaaaaaaaaaaggttagattagaagtagaaattctggaatagcaaatgagaaaaatcatgaaaggaaagagactaaatagaatttatttttatattttttattgttttgagatggagttttgctcttgttgcccaggctgaggcgcaatggcacaatctcggctcgctgcaacctctgcctcccgggttcaagcaattctcctgcctcagactcccaagtagctgggattacaggtgcccaccaccacatttggctaatttttttgtatttttagtagagacagggtttcaccatattggctaggaaggtctcgaactcctgacctcaggtgatccacctgcctcggcctcccaaagtgctggaattacaggcatgcgccaccgtgtccagccggctaaatagaatttaaaagaaacaaggagagaacttcacaatgagaatccagtacagaaaaacacaggcctgatgcagtggctcacacctgtaatcccagcattttgggaggccaaggcgagtggatcacgaggtcaggagttcaagaccagcctggccaagattgtgaaaccccgtgtctactaaaaatacaaaaattaggcaggcatggtggtgggtgcctataatcccagctgcttgggaggctgaggcagagaattgcttgaacctgggaggcggaggttgcagtgagccgaaattgtgccactgcactccagcctgggcaacagagcgagactccgtctcaaaaaaaaaaaaaaaaaaaaagaaaaagtaaaagaaaaacacaggaaaacttcaaatccatagcagtggggaaaggggaaatttgccatgttgagaatccatttgctcctttgtgagtgatcatttattttcttcttaaagctgtaaattttatttgcgatcatccggacatcaaagcaatcagctttgtgggatccaacaaggcaggagagtatatcttcgagagaggatcaagacatggcaagagggttcaagccaatatggtgacttcttattccttttttctccaatctttgttctatatatgaaaattacctaggaacagaccttcagcagagaggccactcatcccactccaatgtcagtgtttctttcttttttttgagacagagtctctctgtcaccaagctggagtgcagtggcatgatctcggctcactgcaacctctgcctcccgggttcaagcgattctcctgcctcagcctcccgagtagctgggaatacaagcacatgccacagcgcccggctaatttttctattttttttcagtagagacagggtttcaccatgttggccaggatggtttcgatctcctgacctcatgatctgcccgcctcggcctcccaaagtgctgggattacaggcgtaagccttaccatatcctcctgaatgtcttctctttaatcatgaaccttttgaggagtttcattctaagtcacgttaatcactttttttctttttttttgagacagagtcttactctgtcacccaggctagagtgcagtggtgccatctcagctcactgcaacctccacctcccaggttctaacaattctcatgcctcagcctcctgagtagctgggattacaggtgcctaccaccacacccagctaatttttgtattttaagtagagacagggtttcttggccaagctggtcttgaactcctgacctcaagtgatccacccacctcagcctcccaaagtgctgggattacaggcatgagccaccatgcctggcctctttcttgaaattctacatcaagaggtctactttctgttttgcctttcagctggttactggcattattgctgtaaggctgtaagttctttttttttttttttttaacattgctcttcatataactaaaaaacccagcagacaacaaattcctgttttttgtttgtttgtttgttttgagacaggggtctcactctgtcacccagtctggagtacaatggtgtgatcttggctcactgcaacctccgcctcccaggatcaagtggtccccctacctcagcttcccaagtagctgggaccacagactggtgccattatgcctggctaattttttgtattttttgtagagatggtgtttcactatgttgcctaggctggtcttgaactcctgacctcaagttatccttctcacctcagccttccaaagtgctgggattacaggcattagccaccacacctggtccactgcttaatttcttagcttagttgtatttggccaaggaagactcatgtgctttctgcatttttttttagggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggtaatcaatcacctgacttgcccccttagattttgcatctgtggcattaagctcttgggttctgtcactggccttggccagtgggaacaatcatgtctattcttgccatttcctctctttatactgtacttgtcatttggagtcatcttgttagcagtctttttttttaaagcacaggctgtctgttacccaagctggagtgcagtggcaccatcctagctcatggcagcctcaaactgttgggctcaagtgatcctcctgcctcagcctcctgagcagcttggaccacaggtgcgggccaccacctggctaatttttttattttttgtaaatatgaagtctcactttgttgcccaggctggtctggaactcctgggctcaagcagtcctcctgccttggcctcctaaagctttgggattacaggcatgagccctggcagcagtcataatttatgttaatgaggaccttaaattcttctgtgttgttttacaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaaggtgaacaactttcacttcacaaatatgagagctgaaggcaccttaaaggctatagaatctcatccctctaatttattaatgaaaatacttaatgactaagaccttatctcttgccaggattgatcaattattttatctggagtctgaatgagcctctccttctaactcccaaccaaactctttccactataccagcagtctgcagactttccataaagggatagatatttccagctttgcagggatatagtgtctgttgcaactaaactctgacattgtagtgtgagatcagctataaacattgtgtggctgtgttccaaaaaaaatgttatttatggacactgatatttgaatttcatatcattttatatatgattaattttttttcaaccatttaaaaatgcaaaaaccatttttaacttggggctgtacaaaaacaggcaggaagccacatttggcccacaggctatagtttgccaaacgctatcttatcttatactggtttgttaatgttttctctcccctctccctcttgctgcctagcttatggctactgcagtgtctcaatcaatatatcaaccacccaatatttattgaaagtgacaaaaataattgacttgtcaatttttatttatcaaaactttgaaagtctctcagctaacatgacttaaaaattgaggttatgaggcattttttgaaattcatatatccttactataatagtgaatcatcaagtgttgaatgtaagtgcagtagaaattatgaaatctcttgccacagaaccatacagaaaaatccgtttatcagcaacaaacattaattgcatggtgaaggatgttttgagtgtctgcgacctgatatcaaaatataaacatacagacatatttgggaggcaaaggagtgaataagaatggattatttatgttacagaaaacagcatggggtttctgtaaagagaaaaattatcctggtatatttactatagattggatttataaaaaataaattttcatgtaactttttgataacaattggatgaaactagtcgttcaggtattaaaaaggcagctgatgatgggtcatgaactaaagatacagtcccttaaaggaagtgtggttattgttgataggaattccaagttgtttatatgattggtaacttggaagacggaatacacttgagagaggactttttttttaaataggtgatttgaaatgaaaagagattagtaatatgaaagttgtccacgtaaatgatgtgtagtaagtgaaagtaccaaataagcataaaatactcagaatccaaaaagctgacttcttttctggatgcatcactcctggcagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggttcgtgaacagaatttttaagagattcttatatccatttactatttcctaagaggaaacagtaaataatggtgagtcattggtttaagattgcccccatgacctcccacattgccccatttcttcctcaggaatgaaagttcatggggtagaggatagggtagaaggtgggtatttaaaactggtctctgatgcctttgtgtttctaaatggagagttcctttgtccttaggatatgacacggatttgttctgttttaggtgggagtgaatgtccccattccagtgcctttgccaatgttctcattcaccggctctcgatcctccttcaggggagacaccaatttctatggcaaacaggtaacttttgagttaaattttttgtcttttcctttaagaaattttcttaaagatattcaggagcaaggattctgcaaggaagggactgccagcagcatctgtgaggtcataatcagtgcttctcagaaggttccctaaaaaagatttaaaagttaacaaaattttgccaaagctgcttcttcctgaataattcaaagcaacaaagttttgaggaaagagcatggggaagtctaagcctttgtatatgccatttcctgagtgtgtgaccctcttccccatctctcccctttcatctgactaactcctaatcatctgtcatgtctcactttaaaaaatgagctcctccagaaaatctcctccaactaccaccacccctccctcagtgctgggtagtgtgaccccagtgtgttcccattgcacgtattttttctgtaatagttattcatttacaaaaaatgttgttgagcacgttctttgtagcagacattattattactattattattattattttttttttttttgagacacagtctcgctctgttgcccaggctggagtgctgtggcatggtcttagctcactgcaacctccgcctcctgggttcaagcacttctcctgcctcagcctcccgaatagctgggactacaggtgcctgccaccatgcctggataattttttgttttttagtagagacagggtttcaccatgttggccaggctggtcttgaactcctgaccttgtgatccacccacctcagcctcccaaagcactgggattacaggtgtgagccactctgcccggtctgtagcagacattattttaggcactatgaatacagcactgaacaagaaaagtaaagcagatctggaaccaaattgcctgtgttcaaatcccagctaagccagttattagctgtctgactttgggggataccattaattttttttttttttttgagacagagtctcactctgtcgcacaggctggggtgcggtggcacaatcttggctcactgcaacctccgcctcccaggttcaagcaattctcctgcctcagcctcccaagtagctgggattacagatgcccaccaccacacttggctaatttttgtatttttagtggagatagggtttcaccattttggccaggctggtctcgaattcctgacctcaggtgatccgcctgcctcagcctcctaaagtgctgggattacaggcatgagccaccacagccaaccaggataccttctttatgccttaaatttattcacgtataaaatgaataacaatagtacctatgtatttcataacattgtaaggactgaattatcactattggccaggtgcagtggcttacgcctgtaatcccagcactttgggaggctgaggcaggcagatcacctgaagtcaggagtttgagaccaatctggccaacatggcaaaaccccctctactaaaaataaaacaattagccaggtgtggtggcaggtgcctataatcccagctactcgggaggctgaggcagaagaatcctttgaatctgggaggcggaagttgcagtgagccgagattgcaccactggactccagcctgggcaacagagcaagactccatctcaaaaaaaaaaaaaagaagaattattactattgccacatcggccaacaggtgcatatgtcccgaggcaggaagaagcatggcacattcagacagcggaaatgggctggggcacagtgagcaaatgagaagaaaaggaagaaatgaagttagagaggcaggcaggggttgagtcatgtagggctctttaagccatttaaagaagccctcatcagactgtagttgttatctacttatctgcagtacctggaacagagcaggctgcccaaacatttgttgaacaaataggctaggggaagttctttctagtcataggactagagccattttgaaaccttcattaataaattacatgttttgttatacaagtctccccttttataggttgattttttttttctgtgccagctatgtgctgccacagggcgagggatgtggggcttttttattttatttatgtttgggttattaaaaaattaacaatgggattgcatagcattatgacagtgtggccaaatggttaagaagtcaacactttggtatttggaggttgattatatagtttgtatattagtcacagcttttggttttttgttttggggtttttttgatggaatctttctctgtcacccaggctggagtatagtggcatgatcttggctcactgcaacctcagcctccagggttcaagcaattctcgtatctatgcctcccgagtagctgggattacaggcacgtgccaccacacccgccaatttttgtatttgtagtagagacggggtttcgccatgttggccaggctggtctcgacctccttacctcaggtgatctgcctgcctcggcctcccaaagtgctgggattacaggagtgagtcaccgcacccggcctagtcacagcttttgtaaaaatgactaatttgatactagtaacatttcttttaagcaaaacagagtacaactattgtttaaaaattgttccctgcccaccctctccatttatttatttttttgagatgggagttttgctctgttgcccaggctggagtgcaatggtgcattctcggctcacttgcaacctccacctcccaggttcaagcaattctgcctcaggctccaccacgcccagctttttttttttttttttttttttttttttcccagtagagacgaggtttcgccatgttgggccaggctggtcttgagctcatggcctcaagtgatccgcctacctcagcctcccaaagtgctgatattacaagtgtgagccaccgctcctggctgcaccccccagtttaattattataaattactctggtaatctggtaaaatgtcattctagcttgctagtaattatataagtgttagatctgcacaatgtattctcttttgctcaagcctactcttataaactatatctatatatagagagagttaaatatgctgaatttttgggctcacatgttataggtaattgagaagtgaatttgtataatgtcagacattttactttagatttctaagatactttgggtttgccacttcaatatagagctcatgatctctgataattatcagaaatggccgctgggtacagtggctcatgcctgtgatcccagaactttgggagaccaagactggcggatcacctgaggtcaggggttcaagaccagcttggccaacatggtgctagccaacatgggctaatctgaaattagcccttctctactaaaaatacaaaaatagctgggcatggtggcacacacttgtaatcccagctattcagaaggctgaggcaggagaatcacatgaacctgggaggcagaggttgcagtgagccaagatcacaccactgcactccagcctgggcaacagagcaagactctgtctcaaaataaataaataaataaataaatggcctactatataatagctgggggcacggtggctcacacttgtaattccagcactttgagaggccgaggaaggcggatcacttgaggccgggagttcgagaccagcctggccaacatggtgaaaccccatctccactaaaaatacaaaaattagccaggcgtggtagcaggtgcctgtaatcccagctactcgagaggctgaggcaggagagctgcttgaacccgggaggcagaggttgcagtgagctgagatcatgccactgcactccagcctaagtgacagagcaagactccatctcaaacaaaaaagaaagaaatactagtttcagcataataatgatggctaaggtttgattgtttactatctgccaggtattatgttaaatgttttagatcaattatcttaggaacaatatatattggattctgattgcatttctcaattaggaaagtgagtagcactttataatacctccttcaaaagctaattaaaagaagaatcatgaaaccccagaaatatatgctaactttttttctgttttccttagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtaattccatcattttgggaggccacagtgggcagattgcttgagcccaggagttgaagaacgtggcgaaaccccgtatctattatttaaaaaaattgaaaaagtaaaaaaagaaaagggaaaaaaaattttttaaagaagatgttccaataattgcaagaagaactcttagatggggaaacaggacagaaataactcaccgcttttggttgatcctcaaacatagcgctacctaaatgccactgggagagacctcctgcaaagttttctttagcccctcttttatcccacaatacacaagatataatccatttttatatatcccaaagttgtggcaacagcttctttcttttctgctcaatgccactttgtttcctagtaattcatgaccactattaattctatcattgtcactgctcctgcttaagatcacttctcaaggatacctcagtaagcaatggataaatcaactttttgttatatgtgccaagtactaagtttcagggttctcttcagcaatcattaattaatacttcagccattaattcagatgcaaataattttcttttttcttttttttgagatggagtttcactcttgttgcccaggctggagtgcaatggcgtgatctcagctcaccgcaacctccgcctcccaggttcaagcgattctcctgcctcagcccccctagtagctgggattacaggcatgcgccaccacacccagctaattttgtatttttagtagagacggggtttctccgtgttggtcaggctggtctcgaactcctgacctcaggtgatccgcctgcctcggcctcccaaagtgctgggattacaggcatgagccaccacacccagccagatgcaaataattttcttagaaaattatttcaaaagttattttaggcccagaaatcaaggattgttccaaccatgaaaatgggtaagacacctgccttaagcaaatctaacctgctattacttgccaaattttatatattcttttctcttgcctgtatttctaattagtgatttgtttaatgaagaactcttcatgtagagcaattaactgggcctaagaaatttcgaagctttccatgacataaagtggttaaaaaaaaatgctttgacagtcttcttctgccattagttcaactgcctttacgctttttttttttttttttttttgagatggagtttcactcttgttgcccaggctagagtgcaatggcgtgatcttggctcactgcaacctctgcctcccgggttcaagcaattctcctgcctcagcctcctgagtagctgggatttcaggcatacgccaccatgcctggctaattttgtatttttagtagagacagggtttctccatgttggtcaggctggtctcgaactcccgacctcaggtgatctgcctgccttggcctcccaaagtgctgggattacaggtgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatgataaaaaaaaaaaagaccttgaaaatgttgtgtaccctgtggatttgaggcttattactaccacctggctggataaaatgtcaaaaccttcaa
